US009163255B2

(12) United States Patent
Chakraborty et al.

(10) Patent No.: US 9,163,255 B2
(45) Date of Patent: Oct. 20, 2015

(54) POLYNUCLEOTIDES DERIVED FROM CHICKPEA AND USES THEREOF

(75) Inventors: Subhra Chakraborty, New Delhi (IN); Niranjan Chakraborty, New Delhi (IN); Asis Datta, New Delhi (IN); Nasheeman Asraf, New Delhi (IN); Swaraj Basu, New Delhi (IN); Papri Nag, New Delhi (IN); Manindra Singh, New Delhi (IN)

(73) Assignee: National Institute of Plant Genome Research, New Delhi (IN)

( * ) Notice: Subject to any disclaimer, the term of this patent is extended or adjusted under 35 U.S.C. 154(b) by 610 days.

(21) Appl. No.: 13/393,340

(22) PCT Filed: Aug. 30, 2010

(86) PCT No.: PCT/IN2010/000573
§ 371 (c)(1),
(2), (4) Date: Feb. 29, 2012

(87) PCT Pub. No.: WO2011/024207
PCT Pub. Date: Mar. 3, 2011

(65) Prior Publication Data
US 2012/0159668 A1 Jun. 21, 2012

(30) Foreign Application Priority Data
Aug. 29, 2009 (IN) .......................... 1565/DEL/2009

(51) Int. Cl.
*C12N 15/82* (2006.01)
*C07K 14/415* (2006.01)
(52) U.S. Cl.
CPC .......... *C12N 15/8282* (2013.01); *C07K 14/415* (2013.01)
(58) Field of Classification Search
None
See application file for complete search history.

(56) References Cited

PUBLICATIONS

GenBank. Medicago trunculat clone MTYF5_F6_F7_F81G-G-2 unknown mRNA. 2008. Accession BT051691.1.*
Ashraf, N., et al., "Comparative analyses of genotype dependent expressed sequence tags and stress-responsive transcriptome of chickpea wilt illustrate predicted and unexpected genes and novel regulators of plant immunity," *BMC Genomics* 10:415, BioMed Central Ltd., England (2009).
Coram, T.E. and Pang, E.C.K., "Isolation and analysis of candidate ascochyta blight defence genes in chickpea. Part I. Generation and analysis of an expressed sequence tag (EST) library," *Physiol. Mol. Plant Pathol.* 66:192-200, Elsevier Ltd., England (2005).
Coram, T.E. et al., "Functional genomics in chickpea: an emerging frontier for molecular-assisted breeding," *Funct. Plant Biol.* 34:861-873, CSIRO Pub., Australia (2007).

Datta, S., et al., "IPCM_34 Wilt resistant chickpea leave library (JG 315) *Cicer arietinum* cDNA clone IPCM_34, mRNA sequence," retrieved from EBI Database accession No. GE213134, accessed Jun. 7, 2012.
Ewing, R.M., et al., "Large-Scale Statistical Analyses of Rice ESTs Reveal Correlated Patterns of Gene Expression," *Genome Res.* 9:950-959, Cold Spring Harbor Laboratory Press, United States (1999).
Gray, W.M., "Plant Defence: A New Weapon in the Arsenal," *Curr. Biol.* 12:R352-R354, Elsevier Science Ltd., England (2002).
Jantasuriyarat, C., et al., "Large-Scale Idnetification of Expressed Sequence Tags Involved in Rice and Rice Blast Fungus Interaction," *Plant Physiol.* 138:105-115. American Society of Plant Biologists, United States (2005).
Katagiri, F., "A global view of defense gene expression regulation—a highly interconnected signaling network," *Curr. Opin. Plant Biol.* 7:506-511, Current Biology Ltd., England (2004).
Koornneef, A. and Pieterse, M.J., "Cross Talk in Defense Signaling," *Plant Physiol.* 146:839-844, American Society of Plant Biologists, United States (2008).
LeBlanc, J.C., et al., "Global Response to Desiccation Stress in the Soil Actinomycete *Rhodococcus jostii* RHA1," *Appl. Environ. Microbiol.* 74:2627-2636, American Society for Microbiology, United States (2008).
Li, X., et al., "Genome-Wide Analysis of Basic/Helix-Loop-Helix Transcription Factor Family in Rice *Arabidopsis*," *Plant Physiol.* 141:1167-1184, American Society of Plant Biologists, United States (2006).
Melamed, D., et al., "Yeast translational response to high salinity: Global analysis reveals regulation at multiple levels," *RNA* 14:1337-1351, Cold Spring Harbor Laboratory Press, United States (2008).
Moskal, W., et al., "*Medicago truncatula* full length cdna cloning project," retrieved from EBI Database accession No. B7FHX6, accessed Jun. 7, 2012.
Murre, C., et al., "A New DNA Binding and Dimerization Motif in Immunoglobulin Enhancer Binding, *daughterless*, *MyoD*, and *myc* Proteins," *Cell* 56:777-783, United States (1989).
Nagata, T., et al., "Comparative molecular biological analysis of membrane transport genes in organisms," *Plant Mol. Biol.* 66:565-585, Kluwer Academic, Netherlands (2008).

(Continued)

*Primary Examiner* — Anne Kubelik
(74) *Attorney, Agent, or Firm* — Sterne, Kesssler, Goldstein, Fox P.L.L.C.

(57) ABSTRACT

Polynucleotides isolated from chickpea are disclosed herein. The disclosed polynucleotides of the present invention provide genotype-dependent spatial information on the presence and relative abundance of each gene. The transcriptomic analysis of the polynucleotides revealed (649) non-cannonical genes besides many unexpected candidates with known biochemical functions, which have never been associated with pathostress-responsive transcriptome. The polynucleotides disclosed in the present invention can be used as a molecular tool for isolation of novel genes from plants that can be used for plant improvement. Further, the polynucleotide responsible for improving immunity against fungal pathogen in plants is disclosed herein. The present invention also provides a method of improving immunity against fungal pathogen in plants. Transgenic plants exhibiting improved immunity against fungal pathogen are also provided in the present invention.

10 Claims, 9 Drawing Sheets

(56) References Cited

PUBLICATIONS

Nimbalkar, S.B., et al., "Differentially expressed gene transcripts in roots of resistant and susceptible chickpea plant (*Cicer arietinum* L.) upon *Fusarium oxysporum* infection," *Physiol.Mol. Plant Pathol.* 68:176-188, Elsevier Ltd., England (2006).

Ramírez, M., et al., "Sequencing and Analysis of Common Bean ESTs. Building a Foundation for Functional Genomics," *Plant Physiol.* 137:1211-1227, American Society of Plant Biolgists, United States (2005).

Satoh, K., et al., "Gene Organization in Rice Revealed by Full-Length cDNA Mapping and Gene Expression Analysis through Microarray," *PLoS One* 2:e1235, Public Library of Science, United States (2007).

Takabatake, T., et al., "Microarray-based global mapping of integration sites for the retrotransposon, intracisternal A-particle, in the mouse genome," *Nucleic Acids Res.* 36:e59, Oxford University Press, England (2008).

Toledo-Ortiz, G., et al., "The *Arabidopsis* Basic/Helix-Loop-Helix Transcription Factor Family," *The Plant Cell* 15:1749-1770, American Society of Plant Biologists, United States (2003).

Udall, J.A., et al., "A global assembly of cotton ESTs," *Genome Res.* 16:441-450, Cold Spring Harbor Laboratory Press, United States (2006).

Wellmer, F., "Genome-Wide Analysis of Gene Expression during Early *Arabidopsis* Flower Development," *PLoS Genetics* 2:e117, Public Library of Science, United States (2006).

White, J.A., et al., "A New Set of *Arabidopsis* Expressed Sequence Tags from Developing Seeds. The Metabolic Pathway from Carbohydrates to Seed Oil," *Plant Physiol.* 124:1582-1594, American Society of Plant Physiologists, United States (2000).

International Search Report for International Patent Application No. PCT/IN2010/000573, European Patent Office, Rijswijk, Netherlands, mailed Mar. 16, 2011.

Written Opinion of the International Searching Authority for International Patent Application No. PCT/IN2010/000573, European Patent Office, Rijswijk, Netherlands, mailed Mar. 16, 2011.

\* cited by examiner

POLYNUCLEOTIDES DERIVED FROM CHICKPEA AND USES THEREOF

REFERENCE TO SEQUENCE LISTING SUBMITTED ELECTRONICALLY

The content of the electronically submitted sequence listing, file name sequence_listing.ascii.txt, size 3,528,120 bytes; and date of creation May 21, 2013, filed herewith, is incorporated herein by reference in its entirety.

FIELD OF INVENTION

The present invention relates to polynucleotides derived from chickpea associated with growth and development and hormone and stress response including immunity in plants.

BACKGROUND OF THE INVENTION

The ultimate phenome of any organism is modulated by regulated transcription of many genes. Characterization of genetic makeup is thus crucial for understanding the molecular basis of phenotypic diversity, evolution and response to intra- and extra-cellular stimuli. Living cells have evolved to perceive and integrate different signals from their surroundings and to respond by modulating the appropriate gene expression. Expressed sequence tags (ESTs) provide an invaluable resource for analysis of gene expression associated with specific organs, growth conditions, developmental processes and responses to various environmental stresses (White et al., 2000; Ewing et al., 1999; Jantasuriyarat et al., 2005). It bridges the gap between the genome sequences and gene function. ESTs have been useful for intra- and intergenomic comparisons, gene discovery, generation of single nucleotide polymorphisms (SNPs), cloning of genes from MStag peptide sequences, transcript pattern characterization, identifying splice variants, erroneous annotations in the genome database and incomplete prediction of gene structure (Ramirez et al., 2005; Udall et al., 2006). Further, the transcriptome of cells and organs comprise a focused set of transcripts that fulfills discrete but varied cellular functions. The analyses of organ specific transcriptome provide additional information about localization of gene function and pathway compartmentalization. Whereas the transcriptome research is quite advanced in animals, yeast, bacteria and reference plants like *Arabidopsis* and rice (Takabatake et al., 2008; Melamed et al., 2008; LeBlanc et al., 2008; Wellmer et al., 2006; Satoh et al., 2007) there is relatively less information in crop plants.

Legumes are valuable agricultural and commercial crops that serve as important nutrient sources for human diet and animal feed. About one third of human nutrition comes from legumes and in many developing countries, legumes serve as the only source of protein. Many secondary metabolites in legumes have been implicated in defense and are of particular interest as novel pharmaceuticals. Five tribes constitute the family fabaceae, of which one representative genus each from four tribes have been used to generate ESTs. However, the tribe ciceri having a single genus *Cicer*, remained as the understudied legume. Chickpea is the world's third most important food legume grown in over 40 countries representing all the continents. Despite its importance in plant evolution, role in human nutrition and stress adaptation, very little ESTs and differential transcriptome data is available, let alone genotype-specific gene signatures. It is grown on about 10 mha area worldwide and the global production exceeds 8 million tons. In many water-deficient regions of the world, it serves as an important protein-rich food and an increasingly valuable traded commodity. Chickpea has one of the highest nutritional compositions of edible legume and does not contain any specific major anti-nutritional factor, rather it is used in herbal medicine. Despite the importance of chickpea in the study of plant evolution, its role in nutritional requirement in humans, and stress adaptation nothing is known about the genes responsible for these traits—primarily because it is recalcitrant to genetic analysis. Unlike genetically tractable plants such as tomato, maize and *Arabidopsis*, chickpea produces a limited number of seeds. Furthermore, its genome is large (732 Mbp) as compared to *Arabidopsis* (125 Mbp). Consequently, chickpea has remained outside the realm of both modern genome-sequencing initiatives and large scale functional genomics studies. Currently available completely annotated plant genome sequences make it possible to study the genomes of agriculturally important genetically complex crop plants such as chickpea by comparing the ESTs derived from them. Only very recently, attention has been given from both genomics and proteomics perspect to this important food legume. Because of its evolutionary position as a key node within legumes as well as its nutritional and medicinal significance to humans, chickpea is ideally suited for genomic prospecting.

Transcriptional programs that regulate development and stress response are exquisitely controlled in space and time. Elucidating these programs that underlie development is essential to understand the acquisition of cell and tissue identity. Root in higher plants is a highly organized structure that plays a key role in nutrient acquisition and water uptake besides its primary function of mechanical support to the plant. Nevertheless, it is essentially the entry point for the soil borne pathogens into the plant body. Of the soil borne root pathogen, vascular wilt is the most important disease. Vascular wilt caused by *Fusarium* is ubiquitous evolutionarily and effects crop plants across families. In particular, chickpea wilt, is widespread in occurrence and on an average causes substantial loss of 10 to 15% in production every year worldwide. During the infection process the fungus invades roots and spreads systemically through the host's vascular system, breaking down the cell walls to form gels that block the plant's transport system thereby causing yellowing and wilting symptoms. In general, the wilt symptoms appear as chlorotic spots on the lower leaves followed by discoloration and necrosis. Vascular discoloration occurs from the roots to the young stems, followed by a yellowing and wilting of the leaves before final necrosis. When uprooted the stem is split vertically and internal discoloration is visible in pith and xylem. The susceptible genotypes take less than 25 days for wilting whereas the resistant ones do not show any symptoms of wilting up to 60 days. *Fusarium*, an ubiquitous pathogen that causes disease not only in plants but also is a threat to other living organisms, including human (Nucci & Anaissie, 2007; Sander et al., 1998).

Microarray technology is a powerful tool that can be used to identify the presence and level of expression of a large number of polynucleotides in a single assay. Strength of microarray technology is that it allows the identification of differential gene expression simply by comparing patterns of hybridization.

Immune responses are controlled by dynamic and variable gene expression changes which lead to reprogramming of many cellular functions. It has been postulated that the outcome of the defense response seems to be finely tuned by cross-talk between various signaling pathways (Koornneef and Pieterse, 2008) resulting in quantitative and/or kinetic effects on the resistance response (Katagiri, 2004). Basic helix-loop-helix (bHLH) transcription factors represent a family of proteins that contains a bHLH domain, a motif involved in DNA binding and dimerization (Murre et al., 1989). Members of the bHLH TF superfamily proteins are known to perform diverse regulatory functions. In animals they act as regulatory factors in different processes such as neurogenesis, cardiogenesis, myogenesis, and hematopoiesis (Jones, 2004). Although, the members of bHLH TF superfamily have been studied in mammals, but investigation of plant bHLH is still in its infancy.

The genetic improvements in plants beyond current capabilities are urgently needed for production of more food worldwide, implying thereby enhanced growth and development of plants with increased tolerance to stress. Environmental stresses including disease have major effects on agricultural production and food security. During the past, there have been attempts to develop high yielding plant varieties by engineering stress tolerance. Although there have been isolated instances of reports on developing plants with increased stress tolerance but not much has been achieved towards genetic enhancement of plants in terms of immunity. Thus, there is a critical need to discover molecules such as polynucleotides, genes, ESTs of agricultural importance, their functional analyses and exploitation for sustainable crop production.

SUMMARY OF THE INVENTION

One aspect of the present invention relates to ESTs isolated form chickpea having nucleotide sequence as set forth in SEQ ID NO: 1 to 6272, wherein the ESTs are related to various functions selected from a group consisting of cell signaling, transcription, RNA processing and modification, translation, post translational modification, protein turnover, nucleotide binding, metabolism, cellular transport, homeostasis, hormone response, cell cycle, DNA metabolism, development, cytoskeletal organization, cellular redox, energy metabolism, secondary metabolism, defense and stress response.

Another aspect of the present invention relates to an isolated nucleotide sequence as set forth in SEQ ID NO: 6273 encoding the protein having amino acid sequence as set forth in SEQ ID NO: 6274.

Another aspect of the present invention relates to a recombinant vector comprising the nucleotide sequence as set forth in SEQ ID NO: 6273 encoding the protein having amino acid sequence as set forth in SEQ ID NO: 6274, wherein the nucleotide sequence is operably linked to a promoter.

Another aspect of the present invention relates to a recombinant host cell comprising the nucleotide sequence as set forth in SEQ ID NO: 6273 encoding the protein having amino acid sequence as set forth in SEQ ID NO: 6274, wherein the nucleotide sequence is operably linked to a promoter, wherein the host cell is E. coli, Agrobacterium or yeast.

Yet another aspect of the present invention relates to a method of improving immunity against fungal pathogen in plants, said method comprises transforming a plant cell with a polynucleotide having the nucleotide sequence as set forth in SEQ ID NO: 6273 encoding protein having amino acid sequence as set forth in SEQ ID NO: 6274, selecting the transformed plant cell and regenerating the transformed plant cell into transgenic plant showing improved immunity to the fungal pathogen.

Further aspect of the present invention relates to a transgenic plant having improved immunity against a fungal pathogen, wherein the transgenic plant over-expresses a polynucleotide having the nucleotide sequence as set forth in SEQ ID NO: 6273.

BRIEF DESCRIPTION OF ACCOMPANYING DRAWING

Figure 4:
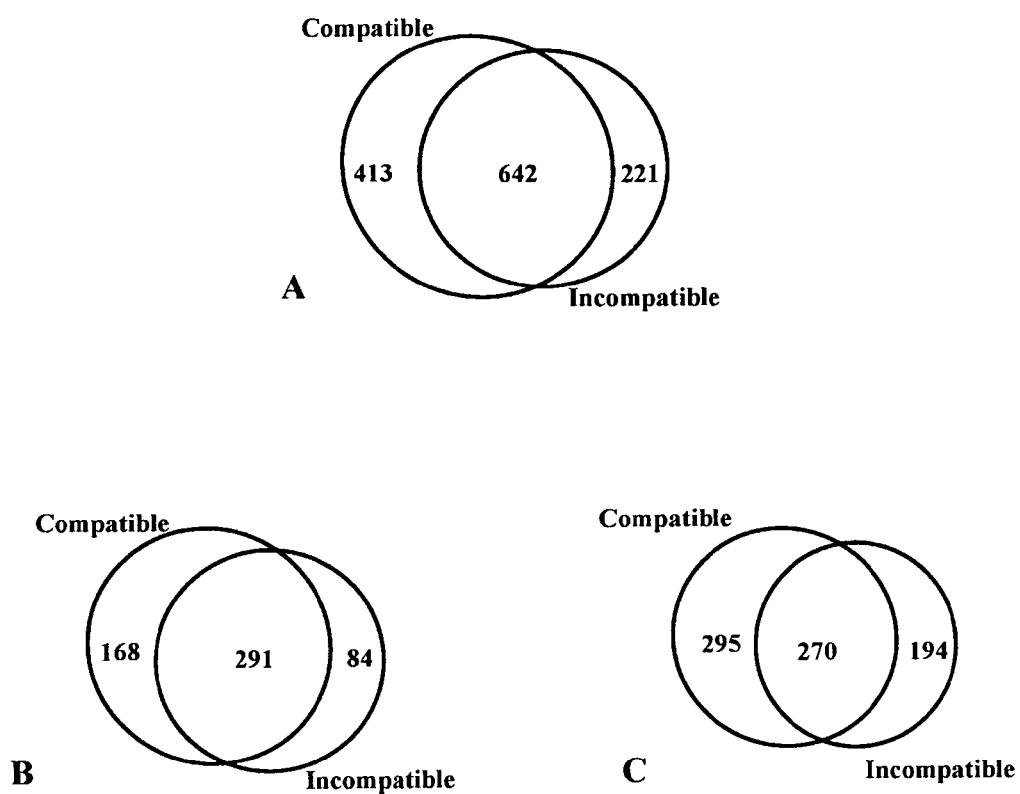

FIG. 4 shows comparative analyses of differentially expressed CaESTs. Venn represents (A) total differential exclusive and common expression pattern during compatible and incompatible interactions, (B) up-regulated differential exclusive and common expression pattern during compatible and incompatible interactions and (C) down-regulated differential exclusive and common expression pattern during compatible and incompatible interactions.

Figure 5:
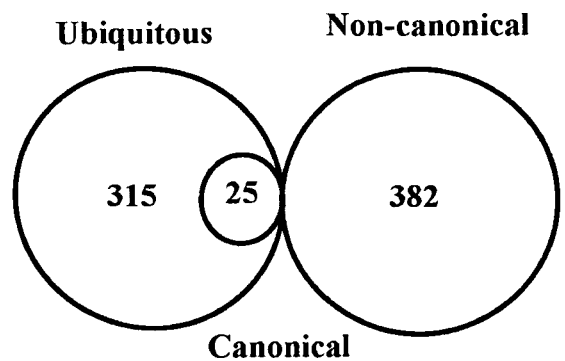

FIG. 5 shows comparative analysis of chickpea stress responsive genes having a differential microarray expression with earlier known stress related genes. Venn represents the overlap between ubiquitous, canonical and non canonical genes and the numbers signify unique and common stress responsive differentially expressed genes.

Figure 6:
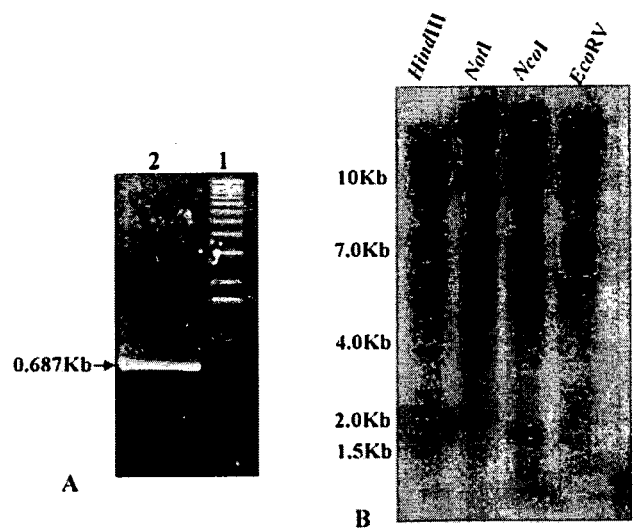

FIG. 6 shows IRF817 is an intronless and low copy number gene. (A) PCR amplified product of IRF817 using genomic DNA as template and ORF end primers. Lane 1 and 2 indicate 1 Kb ladder and PCR product, respectively and (B) Southern blot indicating the copy number of IRF817. Each lane was loaded with 10 µg of chickpea genomic DNA digested with indicated restriction endonucleases and the blot was hybridized with $^{32}$P-labeled full length cDNA of IRF817 as probe. Molecular weight marker in kb is indicated on the left.

Figure 7:
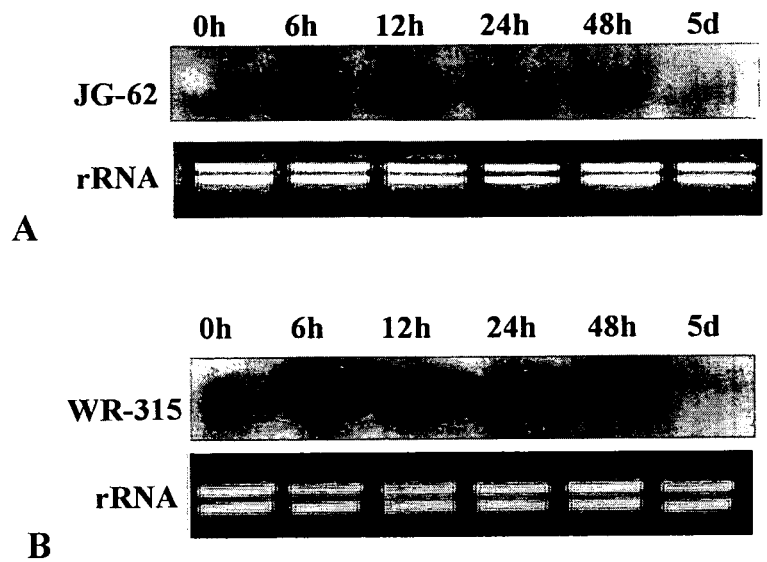

FIG. 7 shows genotype-specific expression pattern of IRF817 in response to patho-stress as determined by northern blot analysis, (A) Susceptible (JG-62) and (B) resistant (WR-315) genotypes of chickpea. The lanes represent various post-infection time points. 20 µg of total root RNA isolated from 25-day old chickpea seedlings harvested at various time points after pathogen infection were separated by 1.5% agarose gel. The RNA blot was hybridized with a $^{32}$P-labeled cDNA fragment of IRF817. The image of ethidium bromide stained rRNA in the lower panel shows equivalent loading and RNA quality.

Figure 8:
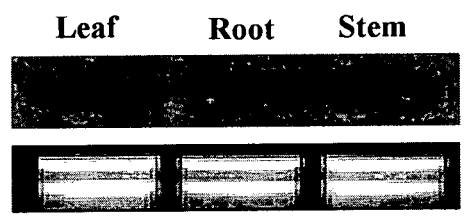

FIG. 8 shows organ specific expression pattern of IRF817 as determined by northern blot analysis. The RNA blot was hybridized with a $^{32}$P-labeled cDNA fragment of IRF817. The image of ethidium bromide stained rRNA in the lower panel shows equivalent loading and RNA quality; L, leaf; R, root; S, stem.

Figure 9:
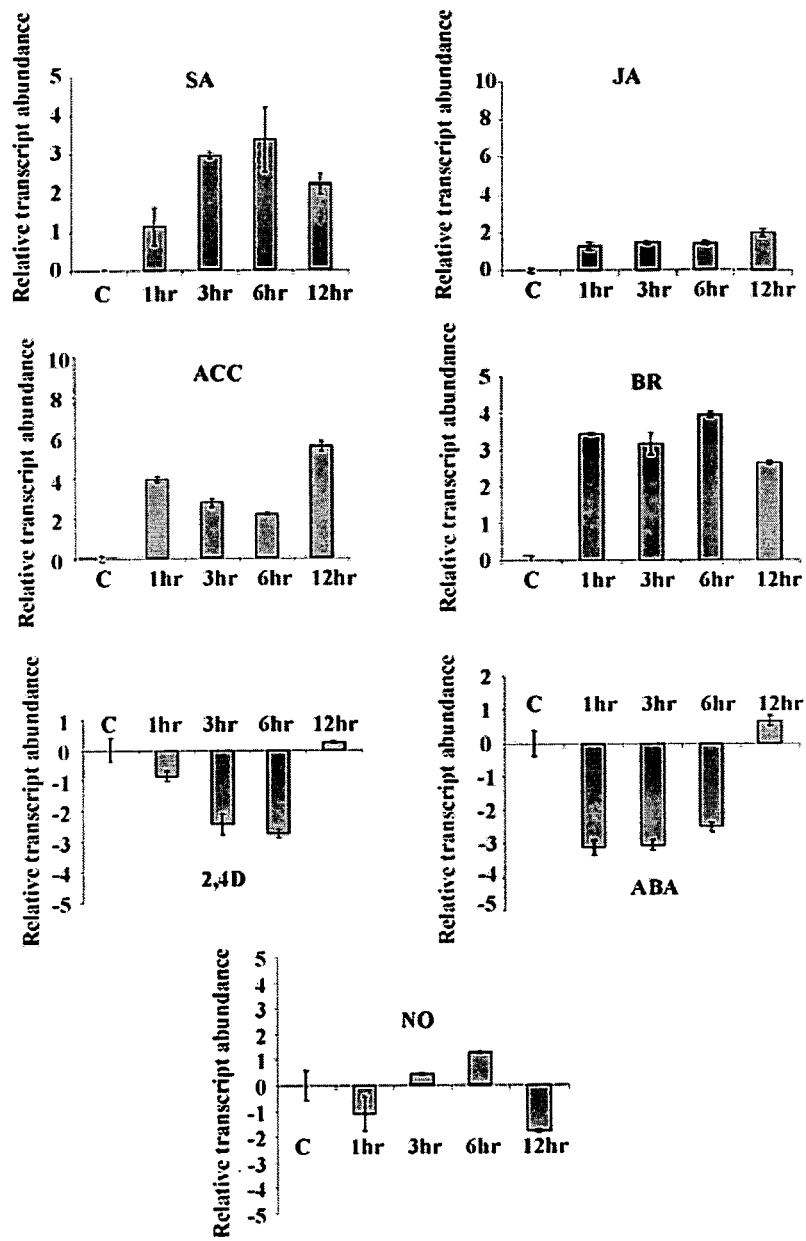

FIG. 9 shows relative transcript level of IRF817 in response to various hormones as determined by real time PCR. Transcript levels were normalized by 18S transcript level. Error bars indicate SD of three real time PCR experiments. C denotes the control.

Figure 10:
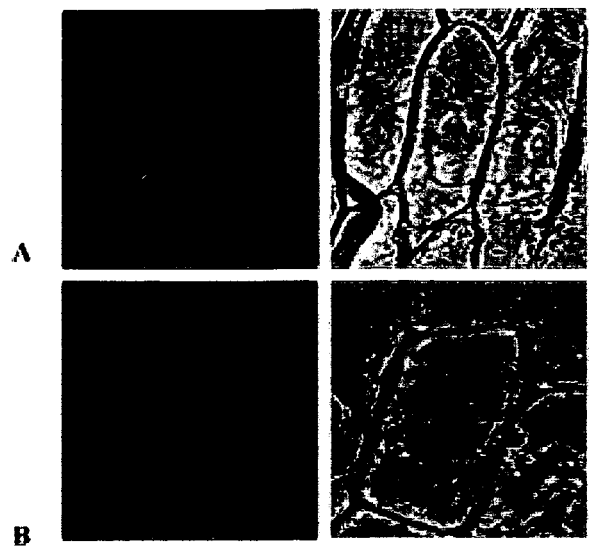

FIG. 10 shows sub-cellular localization of CaIRF817. Onion epidermal cells bombarded with (A) empty vector (GFP) and (B) fusion gene construct (IRF817-GFP). The GFP fluorescence was detected using confocal laser-scanning microscope. The right panel shows the corresponding phase contrast image.

Figure 11:
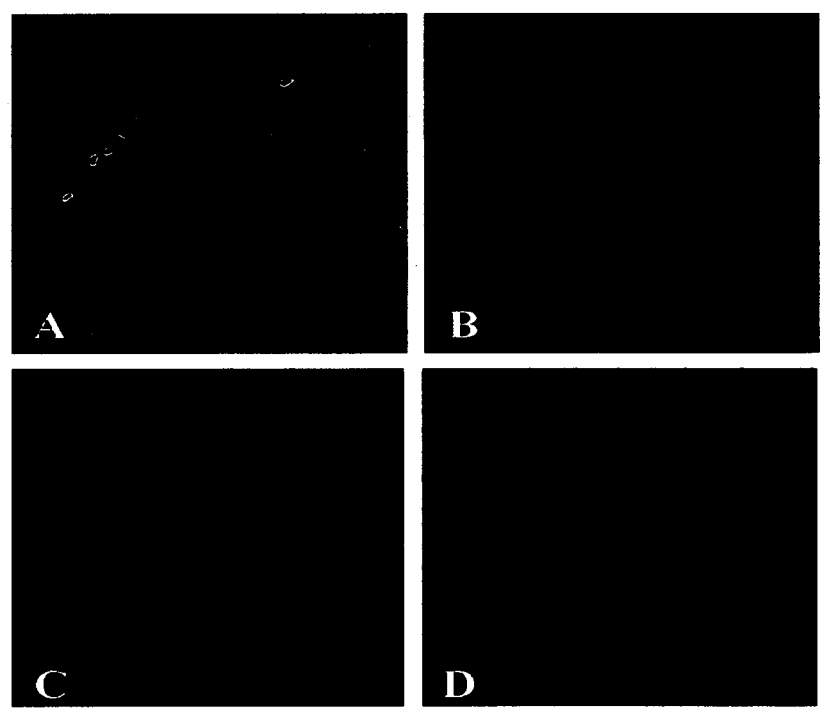

FIG. 11 shows transgenic root expressing IRF817 is immune to patho-stress. (A-D) Root colonization of the pathogen is spatially associated with the absence of intact plant nuclei. Root segment double-stained for intact plant nuclei (DAPI; B and D) and fungal hyphae (WGA-Texas Red; A and C). Control root heavily colonized by fungal hyphae (A) contains only a few DAPI-stained nuclei (B) while transgenic root with minor fungal colonization (C) contains a high number of DAPI-stained nuclei (D).

Figure 12:
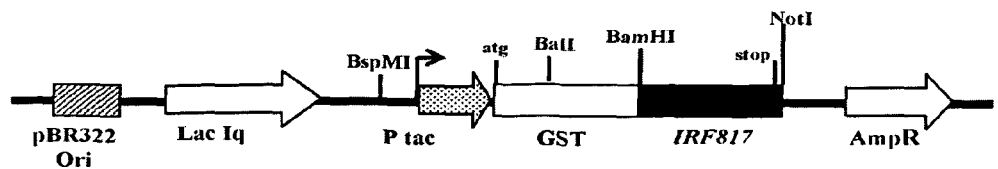

FIG. 12 shows schematic diagram of recombinant bacterial expression vector GST-IRF817

Figure 13:
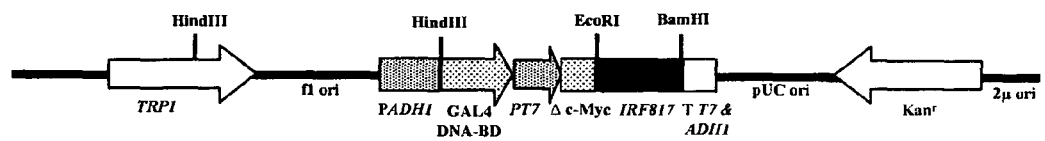

FIG. 13 shows schematic diagram of recombinant yeast expression vector Gal4-IRF817

Figure 14:
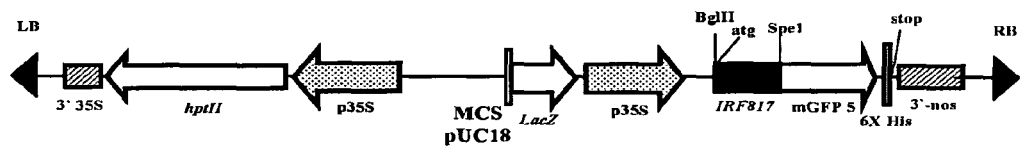
Figure 15:
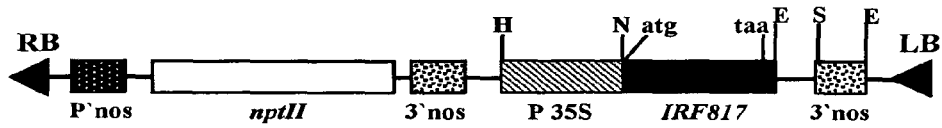

FIG. 14 shows schematic diagram of recombinant plant expression vector IRF817-GFP FIG. 15 shows schematic diagram of recombinant plant expression vector Cam V35S::IRF817

SEQUENCE LISTING: The patent application contains a lengthy sequence listing section. A copy of the sequence listing is provided herein in electronic format.

DETAILED DESCRIPTION OF THE INVENTION

Expressed sequence tags, or ESTs, are short sequences of randomly selected clones from a cDNA (or complementary DNA) library which are representative of the cDNA inserts of these randomly selected clones.

Expressed sequence tags, or ESTs or polynucleotides can be used interchangeably here.

The present invention provides polynucleotides associated with vascular wilt response transcriptome in chickpea. Further, the present invention provides clusters of genes that are regulated in response to a stress condition in chickpea. Such clusters include, for example, plant polynucleotides whose expression is altered in response to a stress condition. The identification of such clusters, using microarray technology, has allowed the identification of various plant genes such as stress-regulated genes and genes associated with hormone response and plant growth and development. Thus, the invention provides isolated polynucleotide portions of chickpea plant stress regulated genes. Such sequences include but not limited to sequences encoding transcription factors; enzymes, including kinases; and structural proteins, chromatin modifiers, signaling molecules, hormone responsive proteins, translational proteins and proteins involved in post-translational modifications and protein fate.

The present invention provides Expressed Sequence Tags (ESTs) isolated from chickpea. The present invention particularly provides 6272 gene sequences of immune-response pathway that would provide genotype-dependent spatial information on the presence and relative abundance of each gene. The sequence assembly led to the identification of a CaUnigene set of 2013 transcripts comprising of 973 contigs and 1040 singletons, two-third of which represent new chickpea genes hitherto undiscovered.

The present invention further provides 209 gene families and 262 genotype-specific SNPs. Further, several novel transcription regulators were identified indicating their possible role in immune response. The transcriptomic analysis revealed 649 non-cannonical genes besides many unexpected candidates with known biochemical functions, which have never been associated with pathostress-responsive transcriptome.

In the present study, two genotypes JG-62 and WR-315 were used which are known to be susceptible and resistant to *Fusarium* wilt, respectively. The localization of the fungus was limited in the resistant cultivar while extensive colonization occurs in susceptible one by fourth to fifth day post infection. Externally the extent of mycelial colonization is manifested in the form of browning of the roots after 72 hours in the susceptible genotype while no such discoloration is evident in the resistant one.

To understand the regulatory networks and metabolic pathways governing genotype-specific cellular responses towards different signals, we have initiated ESTablishing CaUnigene dataset and a genome-wide analysis of gene expression in this food legume. As a first step towards this, we have developed ESTs and stress responsive transcriptome of chickpea, as a basis for future transcriptome and proteome comparisons of genetic mutants, pathogen-infected and/or environmentally challenged plants.

The present invention provides a total of 6272 high quality ESTs were identified, functionally annotated, computationally analysed and classified into different functional categories. Of the 2013 genes, 807 were identified as previously uncharacterized. In addition, we have developed a cDNA based microarray chip and examined the global state of gene expression in the chickpea root during vascular wilt to identify the potential innate immune responsive candidates involved in the complex regulatory network that may function in this organ. These transcriptional signatures often predict previously unknown cellular functions. ESTablished set of pathostress-responsive organ-specific unigenes and the putative differentially expressed genes identified from the present study will provide a foundation for future investigation of the expression and function of the genes and proteins to build the interactome map at system level of chickpea and other legumes. In addition, gene mining of these databases, aided by microarray chip, can be used to select candidate genes involved in plant immunity. In the future, it will also be interesting to compare the spatial and temporal transcriptional complexity that underlies organ-specific innate immune response in other multicellular organisms.

The gene expression profiling led to the identification of 1276 differential genes out of which 413 were specific to susceptible and 221 specific to resistant genotype while 643 were common in both. Using this approach we found that out of 6072 probe sets representing 1749 unigenes present on the microarray, a total of 1276 genes were significantly regulated in at least one of the time points in one of the genotypes. Out of this 1055 were differentially expressed in susceptible and 863 in resistant genotype. Furthermore, among the significantly expressed genes, 413 were unique to susceptible; 221 unique to resistant and 642 common in both the genotypes.

We have identified expression patterns of hallmark defense genes and identification of several novel previously unidentified immune responsive genes.

In order to gain a detailed understanding of how various genes known to perform varied functions have an overall impact on the molecular functioning of the cell in response to different stresses, we developed a multinetwork based on our microarray gene expression data together with known protein-protein interactions. Visual inspection of the resulting interactome revealed highly connected metabolic and regulatory networks. In this study, we have focused our attention on immune responsive regulatory network. 572 genes involved in the regulatory network were found to be differential in the temporal microarray gene expression data. Of the total 572 genes 391 of them came out in the form of a statistically significant protein interaction network. The resulting network was densely organized and consisted of many coherent subnetworks to which biological significance was assigned. These subnetwork modules seemed to have organized roles in stress response and included cellular transport and assembly, transcription, translation and post translational modifications.

The interactome data disclosed in the present invention also suggest the presence of a multi-connected regulatory network and sub-networks comprising of 391 statistically significant candidates for immune-response pathway. Of these, a major transcriptional sub-network revealed presence of many transcription factors as essential regulatory components.

Plant immunity and susceptibility depend on a complex exchange of signals and responses occurring under given environmental conditions. In order to highlight which of the processes hold common ground and which defined immunity and susceptibility through their expression, we evaluated our data by constructing a process map. The results showed for the first time that while translation initiation and elongation seemed to be predominant in susceptible genotype, protein modification particularly phosphorylation was predominant in the resistant one. This suggests that apart from transcriptional control, translational and post translational modifications play a key role in mediating plant immune responses.

Our study establishes a comprehensive catalogue of the immune-responsive root transcriptome with insight into their identity and function. The development, detailed analysis of CaEST datasets and global gene expression by microarray provide new insight into the commonality and diversity of organ-specific immune-responsive transcript signatures and their regulated expression shaping the species specificity at genotype level. This is the first report on differential transcriptome of an unsequenced genome during vascular wilt.

Transcriptome profiling of the *Cicer arietinum L.* under patho-stress identified an array of differentially regulated components. Among the differentially regulated components, an EST was identified as gene encoding for bHLH protein, designated IRF817 (Immune responsive factor 817). We have investigated the gene structure and organization, and demonstrated, for the first time, that IRF817 is involved in immune-response pathway in plants. Expression of IRF817 was found to be regulated not only by patho-stress but also by different hormones and no treatments, suggesting its possible role in cellular development and environmental tolerance besides its role in plant immune response. IRF817 was found to be localized in the nucleus and acts as a regulatory molecule for stress-responsive signaling, including plant immunity. Overexpression of IRF817 in transgenic chickpea roots led to increased immunity compared to wild-type plants.

Chickpea EST Database

In an attempt to construct a functional EST dataset for discovering subset of genotype dependent, organ specific and extra and intra cellular stimuli responsive genes expressed in chickpea, in this study we have constructed two suppression-subtracted cDNA libraries, one from vascular wilt susceptible genotype (JG-62) and the other from resistant genotype (WR-315). The source of RNA for each library was root and collar tissue from the 25-d-old chickpea seedlings challenged with wilt pathogen, *Fusarium oxysporum ciceri* race 1, vs control tissue. In total, 6955 ESTs were generated and sequenced from the two libraries out of which 2908 were from susceptible and 4047 from resistant genotypes. Although no chimeric sequence was found, however about 9.8% of the sequences were discarded due to low quality of the sequence, short sequence length, sequence from other organellar origin or the absence of the insert and the remaining 6272 ESTs were considered for sequence assembly (Table 1). The high quality ESTs that passed the base calling, appropriate length, vector masking and mitochondrial filters were assembled into contigs using CAP3 program. The 6272 high quality sequences had an average read of 366 bp and a cumulative length of 2.29 Mbp. Of the total 6272 ESTs, 1040 were found to be classified as singletons whereas 5232 assembled into 973 contigs (Table 2). The redundancy of clones in the contigs ranged from 2 to 230. The total contigs and singletons comprised a non redundant chickpea unigene (CaUnigene) set of 2013 different transcripts 3.9% of the unigenes (79) contained more than 10 sequences per contig. Of the total high quality ESTs, 1202 were specific to susceptible genotype whereas 2168 were specific to resistant genotype and 2902 were common to both. The abundance of transcripts, shapes or results in a genotype specific function in response to stimuli in a given space and time. Absence of chimeras, high percentage of good quality sequences and good average insert size suggested that the libraries were of high quality (Table 1).

Functional Annotation and Classification of Chickpea ESTs

In order to understand the function of immune-responsive ESTs, the entire set of 2013 CaUnigenes were annotated on the basis of similarities to the known or putative ESTs in the NCBI database. Using the best hits found by BLAST, an inferred putative function was assigned to the sequences and were sorted into various functional categories. We were able to assign function to 60% of the genes while our data analysis revealed that 18.28% of the CaUnigenes belong to no significant homology (NSH) class. In addition, 18.33% and 3.47% of the unigenes matched with hypothetical and unknown proteins respectively. Genes were assigned to the functional classes according to their biochemical function using gene function databases like GO (www.geneontology.org), metacyc (www.metacyc.org) and COG (www.ncbi.nlm.nih.gov/COG). However, the classification of transcripts is only tentative, since the biological function of many genes identified has not yet been established experimentally. The distribution of ESTs into diverse functional classes as shown in additional is described below.

Genes Involved in Regulatory Pathways (Cell Signaling and Transcription and RNA Processing and Modification)

Genes involved in cell signaling, transcription and RNA processing are known to regulate many cellular responses in an organism. Our data showed the presence of different types of protein kinases in both susceptible and tolerant chickpea genotypes. While serine/threonine protein kinase (contig86), Serine/threonine protein kinase active site (CaF1_JIE_03_A_05) and somatic embryogenesis receptor-like kinase were present only in the susceptible genotype; flag-tagged protein kinase domain of putative MAPKKK and protein kinase (CaF1_WIE_51_C_11) were found in the resistant one. Protein kinases are involved in disease response via a signaling cascade presumably conserved in plants, insects and mammals while somatic embryogenesis related kinases are associated with brassinosteroid signaling pathway that plays a key role in plant defense. The EST data revealed many components of calcium signaling such as calmodulin, calcium dependent calmodulin independent kinase, CIP kinase and calcium/calmodulin-regulated receptor-like kinase in both the genotypes indicating an elaborate role of calcium signaling in immune response. The subsets of 14-3-3 proteins were also identified in both susceptible and resistant genotypes. For example, contigs 527, 568, 947 and singletons CaF1_WIE_13_A_05, CaF1_WIE_55_G_01 representing 14-3-3 gene family were present in the resistant genotype while the other member of this gene family, contig 133, was present only in the susceptible one. 14-3-3 has earlier been shown to interact with fusicoccin, the fungal toxin that causes membrane hyperpolarization through activation of plasma membrane $H^+$ ATPase. Other pathostress-responsive signaling components identified are WD40-like protein, response regulator receiver, and leucine-rich repeat (LRR) proteins. While WD40 and LRR proteins were found in both the genotypes, response regulator receiver was exclusive to the susceptible genotype. The LRR proteins are known to play role in defense signaling. While WD40-like proteins are reported to be involved in varied functions including organogenesis; vacuolar trafficking and light signaling their role in immune response is not known.

The potentially increased activity of various signaling pathways is associated with differential expression of many families of transcription factors during plant pathogenesis. The functional class of transcription associated genes, in this study, constituted about 3.58% of the total ESTs that comprised families of transcription factors including zinc finger, MYB, BEL 1-like homeodomain transcription factor, homeodomain leucine zipper HDZ3, G-box binding PG2, Zinc finger GATA-type, putative AP2-binding protein, bHLH and WRKY. While exploring the source of the ESTs coding for these transcription factors, an important and noteworthy observation was that a particular class of transcription regulators showed predominance or was specific to either susceptible or resistant genotype. For example, Myb and HDZ classes were predominant, whereas, PR related transcription factor and WRKY were exclusive to the resistant genotype. On the other hand BEL 1-like homeodomain transcription factor, NOT2/NOT3/NOT5 and G-box binding protein PG2 were found only in the susceptible genotype. This data suggests that interplay of a broad spectrum of transcription factors possibly regulates multiple signaling cascades during immune-stress.

Various RNA binding proteins have potential to modulate gene expression and might be involved in processes like RNA metabolism, mRNA splicing, ribosome biogenesis, transport and translation. We observed the presence of dead box RNA helicase, pre-mRNA processing ribonucleoprotein region, splicing factor 3B subunit 10 and RNA-binding region RNP-1 during vascular wilt of chickpea. All these genes were more abundant in resistant genotype. While dead box RNA helicase was reported to be involved in development and stress responses the role of splicing factor and RNA-binding region RNP-1 in pathostress is yet to be established.

In one embodiment the present invention provides ESTs derived from chickpea, wherein the ESTs are related to signaling. These ESTs are CaF1_JIE_01_D_01 SEQ ID NO:32, CaF1_JIE_02_C_11 SEQ ID NO:97, CaF1_JIE_02_D_11 SEQ ID NO:107, CaF1_JIE_02_H_04 SEQ ID NO:136, CaF1_JIE_03_A_05 SEQ ID NO:147, CaF1_JIE_03_B_10 SEQ ID NO:155, CaF1_JIE_03_C_02 SEQ ID NO:158, CaF1_JIE_03_E_06 SEQ ID NO:178, CaF1_JIE_06_D_11 SEQ ID NO:404, CaF1_JIE_06_F_09 SEQ ID NO:419, CaF1_JIE_07_H_04 SEQ ID NO:508, CaF1_JIE_08_B_09 SEQ ID NO:533, CaF1_JIE_08_B_11 SEQ ID NO:535, CaF1_JIE_08_D_03 SEQ ID NO:548, CaF1_JIE_08_F_01 SEQ ID NO:567, CaF1_JIE_08_H_09 SEQ ID NO:595, CaF1_JIE_08_H_10 SEQ ID NO:596, CaF1_JIE_09_C_10 SEQ ID NO:625, CaF1_JIE_09_E_09 SEQ ID NO:1289, CaF1_JIE_09_F_04 SEQ ID NO:1295, CaF1_JIE_10_E_04 SEQ ID NO:1340, CaF1_JIE_12_B_05 SEQ ID NO:1434, CaF1_JIE_12_B_06 SEQ ID NO:1435, CaF1_JIE_12_E_05 SEQ ID NO:1460, CaF1_JIE_12_E_08 SEQ ID NO:1461, CaF1_JIE_14_A_04 SEQ ID NO:1522, CaF1_JIE_15_B_08 SEQ ID NO:1597, CaF1_JIE_15_B_11 SEQ ID NO:1600, CaF1_JIE_15_D_10 SEQ ID NO:1616, CaF1_JIE_18_G_02 SEQ ID NO:1821, CaF1_JIE_19_A_08 SEQ ID NO:1842, CaF1_JIE_19_F_10 SEQ ID NO:1885, CaF1_JIE_20_A_11 SEQ ID NO:1913, CaF1_JIE_20_G_02 SEQ ID NO:1966, CaF1_JIE_20_H_08 SEQ ID NO:1983, CaF1_JIE_22_G_11 SEQ ID NO:2130, CaF1_JIE_23_B_02 SEQ ID NO:2153, CaF1_JIE_23_B_03 SEQ ID NO:2154, CaF1_JIE_23_G_02 SEQ ID NO:2201, CaF1_JIE_24_F_09 SEQ ID NO:2272, CaF1_JIE_24_G_10 SEQ ID NO:2280, CaF1_JIE_25_B_04 SEQ ID NO:2300, CaF1_JIE_25_G_02 SEQ ID NO:2332, CaF1_JIE_26_D_08 SEQ ID NO:2377, CaF1_JIE_26_G_06 SEQ ID NO:2398, CaF1_JIE_26_H_11 SEQ ID NO:2409, CaF1_JIE_29_F_07 SEQ ID NO:2553, CaF1_JIE_29_G_07 SEQ ID NO:2558, CaF1_JIE_31_D_07 SEQ ID NO:2639, CaF1_JIE_31_D_09 SEQ ID NO:2640, CaF1_JIE_32_E_11 SEQ ID NO:2703, CaF1_JIE_32_F_11 SEQ ID NO:2708, CaF1_JIE_33_A_07 SEQ ID NO:2725, CaF1_JIE_33_B_01 SEQ ID NO:2729, CaF1_JIE_33_B_02 SEQ ID NO:2730, CaF1_JIE_33_B_03 SEQ ID NO:2731, CaF1_JIE_33_C_03 SEQ ID NO:2742, CaF1_JIE_33_D_01 SEQ ID NO:2749, CaF1_JIE_33_E_03 SEQ ID NO:2756, CaF1_JIE_33_H_04 SEQ ID NO:2775, CaF1_JIE_34_H_05 SEQ ID NO:2831, CaF1_JIE_34_H_06 SEQ ID NO:2832, CaF1_JIE_34_H_11 SEQ ID NO:2837, CaF1_JIE_35_C_02 SEQ ID NO:2854, CaF1_JIE_35_E_02 SEQ ID NO:2870, CaF1_JIE_35_G_11 SEQ ID NO:2885, CaF1_JIE_36_F_01 SEQ ID NO:2929, CaF1_JIE_36_G_11 SEQ ID NO:2939, CaF1_JIE_36H_02 SEQ ID NO:2940, CaF1_JIE_37_A_06 SEQ ID NO:2951, CaF1_JIE_37_C_09 SEQ ID NO:2963, CaF1_JIE_38_B_08 SEQ ID NO:3012, CaF1_JIE_39_F_05 SEQ ID NO:3093, CaF1_JIE_39_G_11 SEQ ID NO:3104, CaF1_JIE_40_E_11 SEQ ID NO:3153, CaF1_JIE_41_D_02 SEQ ID NO:3202, CaF1_JIE_41_E_09 SEQ ID NO:3217, CaF1_JIE_41_F_02 SEQ ID NO:3221, CaF1_JIE_41_G_06 SEQ ID NO:3232, CaF1_JIE_41_G_09 SEQ ID NO:3234, CaF1_JIE_42_A_07 SEQ ID NO:3247, CaF1_JIE_42_E_02 SEQ ID NO:3260, CaF1_JIE_42_E_04 SEQ ID NO:3261, CaF1_JIE_42_E_05 SEQ ID NO:3262, CaF1_JIE_42_F_04 SEQ ID NO:3264, CaF1_WIE_01_C_02 SEQ ID NO:646, CaF1_WIE_01_E_07 SEQ ID NO:669, CaF1_WIE_01_G_01 SEQ ID NO:681, CaF1_WIE_02_D_09 SEQ ID NO:726, CaF1_WIE_02_E_09 SEQ ID NO:736, CaF1_WIE_04_A_06 SEQ ID NO:822, CaF1_WIE_04_C_06 SEQ ID NO:840, CaF1_WIE_05_A_09 SEQ ID NO:893, CaF1_WIE_05_E_05 SEQ ID NO:925, CaF1_WIE_06_A_05 SEQ ID NO:960, CaF1_WIE_06_A_06 SEQ ID NO:961, CaF1_WIE_06_C_01 SEQ ID NO:972, CaF1_WIE_08_C_05 SEQ ID NO:1123, CaF1_WIE_08_C_06 SEQ ID NO:1124, CaF1_WIE_08_D_10 SEQ ID NO:1138, CaF1_WIE_08_E_06 SEQ ID NO:1142, CaF1_WIE_08_F_06 SEQ ID NO:1150, CaF1_WIE_08_H_03 SEQ ID NO:1166, CaF1_WIE_09_A_07 SEQ ID NO:1178, CaF1_WIE_09_A_08 SEQ ID NO:1179, CaF1_WIE_09_E_11 SEQ ID NO:1208, CaF1_WIE_09_G_07 SEQ ID NO:1223, CaF1_WIE_12_C_08 SEQ ID NO:3401, CaF1_WIE_12_E_06 SEQ ID NO:3415, CaF1_WIE_13_A_05 SEQ ID NO:3456, CaF1_WIE_13_G_07 SEQ ID NO:3511, CaF1_WIE_18_D_10 SEQ ID NO:3758, CaF1_WIE_19_E_07 SEQ ID NO:3833, CaF1_WIE_19_F_02 SEQ ID NO:3837, CaF1_WIE_21_C_03 SEQ ID NO:3933, CaF1_WIE_21_C_06 SEQ ID NO:3935, CaF1_WIE_21_D_03 SEQ ID NO:3940, CaF1_WIE_21_H_03 SEQ ID NO:3972, CaF1_WIE_21_H_09 SEQ ID NO:3975, CaF1_WIE_22_A_06 SEQ ID NO:3980, CaF1_WIE_23_B_07 SEQ ID NO:4039, CaF1_WIE_24_C_11 SEQ ID NO:4112, CaF1_WIE_24_F_03 SEQ ID NO:4130, CaF1_WIE_24_F_05 SEQ ID NO:4132, CaF1_WIE_24_F_06 SEQ ID NO:4133, CaF1_WIE_24_F_08 SEQ ID NO:4135, CaF1_WIE_24_G_06 SEQ ID NO:4144, CaF1_WIE_24_G_10 SEQ ID NO:4147, CaF1_WIE_25_B_07 SEQ ID NO:4173, CaF1_WIE_25_E_06 SEQ ID NO:4200, CaF1_WIE_25_G_02 SEQ ID NO:4211, CaF1_WIE_26_C_04 SEQ ID NO:4245, CaF1_WIE_26_E_06 SEQ ID NO:4267, CaF1_WIE_27_D_01 SEQ ID NO:4329, CaF1_WIE_29_D_07 SEQ ID NO:4484, CaF1_WIE_29_G_09 SEQ ID NO:4518, CaF1_WIE_29_G_10 SEQ ID NO:4519, CaF1_WIE_31_C_09 SEQ ID NO:4625, CaF1_WIE_31_F_09 SEQ ID NO:4652, CaF1_WIE_32_C_04 SEQ ID NO:4695, CaF1_WIE_32_H_01 SEQ ID NO:4735, CaF1_WIE_33_E_05 SEQ ID NO:4779, CaF1_WIE_33_G_10 SEQ ID NO:4803, CaF1_WIE_33_G_11 SEQ ID NO:4804, CaF1_WIE_33_H_01 SEQ ID NO:4805, CaF1_WIE_33_H_02 SEQ ID NO:4806, CaF1_WIE_33_H_05 SEQ ID NO: 4807, CaF1_WIE_35_G_04 SEQ ID NO:4939, CaF1_WIE_36_C_05 SEQ ID NO:4973, CaF1_WIE_36_C_09 SEQ ID NO:4976, CaF1_WIE_36_C_11 SEQ ID NO:4978, CaF1_WIE_36_H_09 SEQ ID NO:5019, CaF1_WIE_37_B_03 SEQ ID NO:5031, CaF1_WIE_37_E_09 SEQ ID NO:5056, CaF1_WIE_37_H_05 SEQ ID NO:5078, CaF1_WIE_37_H_10 SEQ ID NO:5082, CaF1_WIE_37_H_11 SEQ ID NO:5083, CaF1_WIE_39_G_07 SEQ ID NO:5187, CaF1_WIE_40_B_01 SEQ ID NO:5209, CaF1_WIE_41_C_01 SEQ ID NO:5290, CaF1_WIE_41_C_08 SEQ ID NO:5295, CaF1_WIE_41_F_07 SEQ ID NO:5319, CaF1_WIE_41_G_03 SEQ ID NO:5324, CaF1_WIE_41_H_01 SEQ ID NO:5330, CaF1_WIE_42_H_07 SEQ ID NO:5387, CaF1_WIE_44_E_02 SEQ ID NO:5474, CaF1_WIE_44_E_03 SEQ ID NO:5475, CaF1_WIE_44_E_04 SEQ ID NO:5476, CaF1_WIE_44_F_06 SEQ ID NO:5484, CaF1_WIE_46_G_06 SEQ ID NO:5619, CaF1_WIE_46_H_04 SEQ ID NO:5627, CaF1_WIE_47_C_03 SEQ ID NO:5653, CaF1_WIE_47_E_05 SEQ ID NO:5674, CaF1_WIE_47_G_02 SEQ ID NO:5691, CaF1_WIE_48_C_11 SEQ ID NO:5731, CaF1_WIE_48_F_07 SEQ ID NO:5755, CaF1_WIE_49_B_05 SEQ ID NO:5786, CaF1_WIE_49_G_10 SEQ ID NO:5825, CaF1_WIE_49_H_10 SEQ ID NO:5833, CaF1_WIE_50_B_03 SEQ ID NO:5840, CaF1_WIE_50_G_06 SEQ ID NO:5884, CaF1_WIE_50_G_10 SEQ ID NO:5888, CaF1_WIE_51_A_11 SEQ ID NO:5905, CaF1_WIE_51_C_02 SEQ ID NO:5915, CaF1_WIE_51_C_11 SEQ ID NO:5924, CaF1_WIE_52_F_04 SEQ ID NO:6002, CaF1_WIE_52_H_03 SEQ ID NO:6019, CaF1_WIE_53_A_02 SEQ ID NO:6028, CaF1_WIE_53_B_01 SEQ ID NO:6035, CaF1_WIE_53_H_05 SEQ ID NO:6078, CaF1_WIE_54_C_02 SEQ ID NO:6100, CaF1_WIE_54_C_09 SEQ ID NO:6106, CaF1_WIE_55_B_11 SEQ ID NO:6165 and CaF1_WIE_55_G_01 SEQ ID NO:6199.

In another embodiment the present invention provides ESTs derived from chickpea, wherein the ESTs are related to transcription. These ESTs are CaF1_JIE_01_B_10 SEQ ID NO:19, CaF1_JIE_01_C_05 SEQ ID NO:25, CaF1_JIE_01_E_04 SEQ ID NO:44, CaF1_JIE_01_F_11 SEQ ID NO:58, CaF1_JIE_02_D_03 SEQ ID NO:100, CaF1_JIE_02_D_07 SEQ ID NO:103, CaF1_JIE_02_H_06 SEQ ID NO:138, CaF1_JIE_03_A_02 SEQ ID NO:144, CaF1_JIE_04_B_11 SEQ ID NO:230, CaF1_JIE_04_F_01 SEQ ID NO:259, CaF1_JIE_04_G_10 SEQ ID NO:278, CaF1_JIE_05_E_06 SEQ ID NO:335, CaF1_JIE_06_C_06 SEQ ID NO:392, CaF1_JIE_07_C_04 SEQ ID NO:457, CaF1_JIE_08_A_11 SEQ ID NO:525, CaF1_JIE_11_A_04 SEQ ID NO:1363, CaF1_JIE_11_B_09 SEQ ID NO:1373, CaF1_JIE_12_B_02 SEQ ID NO:1431, CaF1_JIE_12_B_03 SEQ ID NO:1432, CaF1_JIE_12_B_04 SEQ ID NO:1433, CaF1_JIE_12_E_02 SEQ ID NO:1457, CaF1_JIE_12_E_03 SEQ ID NO:1458, CaF1_JIE_12_E_04 SEQ ID NO:1459, CaF1_JIE_14_E_06 SEQ ID NO:1555, CaF1_JIE_15_D_11 SEQ ID NO:1617, CaF1_JIE_15_E_04 SEQ ID NO:1620, CaF1_JIE_15_F_05 SEQ ID NO:1627, CaF1_JIE_16_G_01 SEQ ID NO:1700, CaF1_JIE_17_C_09 SEQ ID NO:1733, CaF1_JIE_17_C_10 SEQ ID NO:1734, CaF1_JIE_17_G_01 SEQ ID NO:1759, CaF1_JIE_17_G_11 SEQ ID NO:1762, CaF1_JIE_17_H_02 SEQ ID NO:1764, CaF1_JIE_18_B_07 SEQ ID NO:1779, CaF1_JIE_19_B_03 SEQ ID NO:1845, CaF1_JIE_19_B_04 SEQ ID NO:1846, CaF1_JIE_19_F_02 SEQ ID NO:1878, CaF1_JIE_20_C_04 SEQ ID NO:1927, CaF1_JIE_20_E_01 SEQ ID NO:1945, CaF1_JIE_21_B_08 SEQ ID NO:2004, CaF1_JIE_21_C_01 SEQ ID NO:2007, CaF1_JIE_21_C_02 SEQ ID NO:2008, CaF1_JIE_21_D_01 SEQ ID NO:2017, CaF1_JIE_21_E_05 SEQ ID NO:2030, CaF1_JIE_21_G_02 SEQ ID NO:2043, CaF1_JIE_22_G_08 SEQ ID NO:2127, CaF1_JIE_24_C_01 SEQ ID NO:2240, CaF1_JIE_24_D_01 SEQ ID NO:2248, CaF1_ME 26_A_111 SEQ ID NO:2354, CaF1_JIE_26_C_10 SEQ ID NO:2370, CaF1_JIE_26_E_10 SEQ ID NO:2387, CaF1_JIE_27_F_10 SEQ ID NO:2456, CaF1_JIE_28_C_10 SEQ ID NO:2487, CaF1_JIE_29_C_11 SEQ ID NO:2539, CaF1_JIE_29_D_11 SEQ ID NO:2545, CaF1_JIE_29_F_06 SEQ ID NO:2552, CaF1_JIE_30_F_06 SEQ ID NO:2598, CaF1_JIE_30_F_07 SEQ ID NO:2599, CaF1_JIE_31_D_03 SEQ ID NO:2637, CaF1_JIE_31_F_02 SEQ ID NO:2650, CaF1_JIE_32_G_05 SEQ ID NO:2712, CaF1_JIE_32_G_06 SEQ ID NO:2713, CaF1_JIE_33_B_09 SEQ ID NO:2737, CaF1_JIE_34_A_11 SEQ ID NO:2787, CaF1_JIE_34_E_02 SEQ ID NO:2811, CaF1_JIE_34_E_03 SEQ ID NO:2812, CaF1_JIE_34_H_03 SEQ ID NO:2830, CaF1_JIE_35_F_07 SEQ ID NO:2877, CaF1_JIE_35_G_01 SEQ ID NO:2879, CaF1_JIE_36_A_09 SEQ ID NO:2897, CaF1_JIE_36_C_03 SEQ ID NO:2908, CaF1_JIE_36_C_09 SEQ ID NO:2910, CaF1_JIE_36_F_05 SEQ ID NO:2931, CaF1_JIE_36_G_01 SEQ ID NO:2936, CaF1_JIE_38_C_09 SEQ ID NO:3018, CaF1_JIE_38_D_02 SEQ ID NO:3020, CaF1_JIE_38_F_04 SEQ ID NO:3037, CaF1_JIE_39_F_01 SEQ ID NO:3090, CaF1_JIE_39_F_03 SEQ ID NO:3092, CaF1_JIE_40_H_07 SEQ ID NO:3177, CaF1_JIE_41_D_04 SEQ ID NO:3204, CaF1_WIE_02_C_04 SEQ ID NO:716, CaF1_WIE_03_A_06 SEQ ID NO:767, CaF1_WIE_03_E_11 SEQ ID NO:798, CaF1_WIE_04_B_03 SEQ ID NO:827, CaF1_WIE_04_B_06 SEQ ID NO:830, CaF1_WIE_04_B_07 SEQ ID NO:831, CaF1_WIE_04_G_07 SEQ ID NO:875, CaF1_WIE_04_G_08 SEQ ID NO:876, CaF1_WIE_05_A_03 SEQ ID NO:889, CaF1_WIE_05_F_04 SEQ ID NO:934, CaF1_WIE_

07_D_10 SEQ ID NO:1062, CaF1_WIE_07_E_11 SEQ ID NO:1072, CaF1_WIE_07_F_05 SEQ ID NO:1077, CaF1_WIE_07_H_04 SEQ ID NO:1096, CaF1_WIE_08_A_11 SEQ ID NO:1108, CaF1_WIE_08_B_11 SEQ ID NO:1118, CaF1_WIE_08_C_11 SEQ ID NO:1128, CaF1_WIE_08_F_09 SEQ ID NO:1153, CaF1_WIE_08_F_11 SEQ ID NO:1155, CaF1_WIE_08_H_04 SEQ ID NO:1167, CaF1_WIE_08_H_05 SEQ ID NO:1168, CaF1_WIE_09_C_11 SEQ ID NO:1191, CaF1_WIE_09_F_08 SEQ ID NO:1216, CaF1_WIE_12_B_03 SEQ ID NO:3386, CaF1_WIE_12_E_10 SEQ ID NO:3419, CaF1_WIE_12_H_05 SEQ ID NO:3446, CaF1_WIE_13_C_11 SEQ ID NO:3478, CaF1_WIE_13_D_02 SEQ ID NO:3480, CaF1_WIE_13_D_03 SEQ ID NO:3481, CaF1_WIE_13_E_01 SEQ ID NO:3487, CaF1_WIE_16_B_05 SEQ ID NO:3606, CaF1_WIE_17_A_01 SEQ ID NO:3644, CaF1_WIE_17_B_02 SEQ ID NO:3656, CaF1_WIE_17_B_09 SEQ ID NO:3662, CaF1_WIE_17_D_10 SEQ ID NO:3682, CaF1_WIE_18_C_07 SEQ ID NO:3747, CaF1_WIE_18_E_08 SEQ ID NO:3766, CaF1_WIE_18_H_03 SEQ ID NO:3791, CaF1_WIE_19_C_08 SEQ ID NO:3820, CaF1_WIE_19_F_04 SEQ ID NO:3839, CaF1_WIE_19_H_01 SEQ ID NO:3853, CaF1_WIE_19_H_04 SEQ ID NO:3855, CaF1_WIE_19_H_07 SEQ ID NO:3858, CaF1_WIE_21_G_01 SEQ ID NO:3960, CaF1_WIE_21_H_08 SEQ ID NO:3974, CaF1_WIE_23_H_10 SEQ ID NO:4086, CaF1_WIE_24_C_08 SEQ ID NO:4109, CaF1_WIE_24_G_03 SEQ ID NO:4141, CaF1_WIE_25_C_10 SEQ ID NO:4184, CaF1_WIE_26_A_11 SEQ ID NO:4232, CaF1_WIE_26_C_02 SEQ ID NO:4243, CaF1_WIE_27_A_03 SEQ ID NO:4301, CaF1_WIE_27_E_08 SEQ ID NO:4344, CaF1_WIE_27_F_05 SEQ ID NO:4352, CaF1_WIE_27_G_04 SEQ ID NO:4362, CaF1_WIE_27_G_05 SEQ ID NO:4363, CaF1_WIE_28_C_08 SEQ ID NO:4400, CaF1_WIE_29_C_10 SEQ ID NO:4476, CaF1_WIE_29_G_06 SEQ ID NO:4515, CaF1_WIE_30_B_08 SEQ ID NO:4544, CaF1_WIE_30_E_03 SEQ ID NO:4567, CaF1_WIE_30_E_09 SEQ ID NO:4572, CaF1_WIE_30_F_09 SEQ ID NO:4581, CaF1_WIE_30_G_08 SEQ ID NO:4591, CaF1_WIE_30_H_09 SEQ ID NO:4599, CaF1_WIE_31_F_11 SEQ ID NO:4654, CaF1_WIE_32_E_05 SEQ ID NO:4710, CaF1_WIE_33_A_03 SEQ ID NO:4748, CaF1_WIE_33_C_09 SEQ ID NO:4768, CaF1_WIE_33_F_08 SEQ ID NO:4791, CaF1_WIE_34_A_11 SEQ ID NO:4819, CaF1_WIE_34_D_01 SEQ ID NO:4836, CaF1_WIE_34_F_11 SEQ ID NO:4861, CaF1_WIE_37_A_10 SEQ ID NO:5028, CaF1_WIE_38_H_03 SEQ ID NO:5139, CaF1_WIE_39_B_01 SEQ ID NO:5153, CaF1_WIE_39_C_01 SEQ ID NO:5161, CaF1_WIE_39_G_02 SEQ ID NO:5183, CaF1_WIE_39_H_04 SEQ ID NO:5192, CaF1_WIE_39_H_07 SEQ ID NO:5195, CaF1_WIE_40_C_09 SEQ ID NO:5224, CaF1_WIE_40_D_05 SEQ ID NO:5229, CaF1_WIE_41_H_07 SEQ ID NO:5336, CaF1_WIE_41_H_11 SEQ ID NO:5340, CaF1_WIE_44_H_07 SEQ ID NO:5498, CaF1_WIE_45_A_02 SEQ ID NO:5502, CaF1_WIE_45_A_03 SEQ ID NO:5503, CaF1_WIE_45_E_07 SEQ ID NO:5534, CaF1_WIE_45_F_04 SEQ ID NO:5540, CaF1_WIE_46_E_02 SEQ ID NO:5600, CaF1_WIE_46_F_07 SEQ ID NO:5613, CaF1_WIE_47_G_08 SEQ ID NO:5697, CaF1_WIE_49_B_01 SEQ ID NO:5783, CaF1_WIE_49_C_09 SEQ ID NO:5798, CaF1_WIE_50_D_04 SEQ ID NO:5858, CaF1_WIE_51_F_10 SEQ ID NO:5946, CaF1_WIE_52_E_04 SEQ ID NO:5994, CaF1_WIE_52_E_05 SEQ ID NO:5995, CaF1_WIE_52_G_02 SEQ ID NO:6009, CaF1_WIE_52_G_11 SEQ ID NO:6017, CaF1_WIE_52_H_09 SEQ ID NO:6025, CaF1_WIE_53_F_03 SEQ ID NO:6067, CaF1_WIE_54_A_01 SEQ ID NO:6081, SEQ ID NO:6211 and CaF1_WIE_56_C_04 SEQ ID NO:6234.

In another embodiment the present invention provides ESTs derived from chickpea, wherein the ESTs are related to RNA processing and modification. These ESTs are CaF1_JIE_02_A_10 SEQ ID NO:78, CaF1_JIE_02_B_07 SEQ ID NO:85, CaF1_JIE_02_C_02 SEQ ID NO:89, CaF1_JIE_03_C_03 SEQ ID NO:159, CaF1_JIE_03_H_02 SEQ ID NO:203, CaF1_JIE_04_B_01 SEQ ID NO:220, CaF1_JIE_06_G_09 SEQ ID NO:428, CaF1_JIE_09_C_11 SEQ ID NO:626, CaF1_JIE_12_D_06 SEQ ID NO:1452, CaF1_JIE_14_B_10 SEQ ID NO:1534, CaF1_JIE_14_C_10 SEQ ID NO:1543, CaF1_JIE_16_B_02 SEQ ID NO:1658, CaF1_JIE_16_B_03 SEQ ID NO:1659, CaF1_JIE_16_D_04 SEQ ID NO:1678, CaF1_JIE_16_F_02 SEQ ID NO:1693, CaF1_JIE_17_C_07 SEQ ID NO:1731, CaF1_JIE_18_D_11 SEQ ID NO:1801, CaF1_JIE_19_B_01 SEQ ID NO:1844, CaF1_JIE_21_C_03 SEQ ID NO:2009, CaF1_JIE_21_C_11 SEQ ID NO:2016, CaF1_JIE_22_A_02 SEQ ID NO:2062, CaF1_JIE_22_B_03 SEQ ID NO:2074, CaF1_JIE_26_E_05 SEQ ID NO:2384, CaF1_JIE_26_E_07 SEQ ID NO:2386, CaF1_JIE_28_F_10 SEQ ID NO:2507, CaF1_JIE_28_F_11 SEQ ID NO:2508, CaF1_JIE_30_A_10 SEQ ID NO:2575, CaF1_JIE_31_F_01 SEQ ID NO:2649, CaF1_JIE_32_B_03 SEQ ID NO:2680, CaF1_JIE_36_C_01 SEQ ID NO:2906, CaF1_JIE_37_D_05 SEQ ID NO:2967, CaF1_JIE_38_D_05 SEQ ID NO:3023, CaF1_JIE_38_E_07 SEQ ID NO:3032, CaF1_JIE_38_F_07 SEQ ID NO:3039, CaF1_JIE_38_G_07 SEQ ID NO:3046, CaF1_JIE_40_E_03 SEQ ID NO:3148, CaF1_JIE_40_H_08 SEQ ID NO:3178, CaF1_JIE_41_F_01 SEQ ID NO:3220, CaF1_WIE_01_C_06 SEQ ID NO:650, CaF1_WIE_01_D_06 SEQ ID NO:659, CaF1_WIE_02_E_11 SEQ ID NO:738, CaF1_WIE_05_A_05 SEQ ID NO:891, CaF1_WIE_06_F_08 SEQ ID NO:1002, CaF1_WIE_07_E_01 SEQ ID NO:1064, CaF1_WIE_07_G_03 SEQ ID NO:1086, CaF1_WIE_08_B_04 SEQ ID NO:1111, CaF1_WIE_10_C_04 SEQ ID NO:1254, CaF1_WIE_10_H_11 SEQ ID NO:3307, CaF1_WIE_11_G_10 SEQ ID NO:3367, CaF1_WIE_12_C_03 SEQ ID NO:3396, CaF1_WIE_13_B_08 SEQ ID NO:3465, CaF1_WIE_14_A_01 SEQ ID NO:3524, CaF1_WIE_15_G_03 SEQ ID NO:3591, CaF1_WIE_15_H_11 SEQ ID NO:3599, CaF1_WIE_17_C_01 SEQ ID NO:3665, CaF1_WIE_18_F_02 SEQ ID NO:3771, CaF1_WIE_19_C_11 SEQ ID NO:3822, CaF1_WIE_20_A_04 SEQ ID NO:3864, CaF1_WIE_20_C_10 SEQ ID NO:3876, CaF1_WIE_21_A_06 SEQ ID NO:3919, CaF1_WIE_21_F_04 SEQ ID NO:3955, CaF1_WIE_21_H_04 SEQ ID NO:3973, CaF1_WIE_22_D_09 SEQ ID NO:4000, CaF1_WIE_23_D_09 SEQ ID NO:4051, CaF1_WIE_26_A_08 SEQ ID NO:4230, CaF1_WIE_26_D_11 SEQ ID NO:4261, CaF1_WIE_26_E_104 SEQ ID NO:4265, CaF1_WIE_26_E_05 SEQ ID NO:4266, CaF1_WIE_26_E_07 SEQ ID NO:4268, CaF1_WIE_27_F_09 SEQ ID NO:4356, CaF1_WIE_27_F_10 SEQ ID NO:4357, CaF1_WIE_27_G_10 SEQ ID NO:4368, CaF1_WIE_27_H_10 SEQ ID NO:4377, CaF1_WIE_28_D_09 SEQ ID NO:4410, CaF1_WIE_28_H_02 SEQ ID NO:4437, CaF1_WIE_28_H_08 SEQ ID NO:4442, CaF1_WIE_29_A_11 SEQ ID NO:4455, CaF1_WIE_29_B_06 SEQ ID NO:4461, CaF1_WIE_29_B_11 SEQ ID NO:4466, CaF1_WIE_29_C_08 SEQ ID NO:4474, CaF1_WIE_29_F_03 SEQ ID NO:4501, CaF1_WIE_29_F_10 SEQ ID NO:4508, CaF1_WIE_29_G_11 SEQ ID NO:4520, CaF1_WIE_31_B_11 SEQ ID NO:4619, CaF1_WIE_31_E_02 SEQ ID NO:4637, CaF1_WIE_32_H_11 SEQ ID NO:4745, CaF1_WIE_34_E_05 SEQ ID NO:4848, CaF1_WIE_34_G_06 SEQ ID NO:4866, CaF1_WIE_35_D_11 SEQ ID NO:4916, CaF1_WIE_35_E_07 SEQ ID NO:4922, CaF1_WIE_35_G_05 SEQ ID NO:4940, CaF1_WIE_37_B_06 SEQ ID NO:5033, CaF1_WIE_37_B_09 SEQ ID NO:5036, CaF1_WIE_37_F_03 SEQ ID NO:5059, CaF1_WIE_40_H_03 SEQ ID NO:5265, CaF1_WIE_41_E_03 SEQ ID NO:5308, CaF1_WIE_41_G_01 SEQ ID NO:5322, CaF1_WIE_41_G_02 SEQ ID NO:5323, CaF1_WIE_42_E_03 SEQ ID NO:5368, CaF1_WIE_42_F_05 SEQ ID NO:5374, CaF1_WIE_42_F_10 SEQ ID NO:5378, CaF1_WIE_42_G_03 SEQ ID NO:5381, CaF1_WIE_42_H_05 SEQ ID NO:5386, CaF1_WIE_43_A_02 SEQ ID NO:5389, CaF1_WIE_43_A_03 SEQ ID NO:5390, CaF1_WIE_43_F_03 SEQ ID NO:5427, CaF1_WIE_43_F_05 SEQ ID NO:5429, CaF1_WIE_43_F_10 SEQ ID NO:5431, CaF1_WIE_45_G_04 SEQ ID NO:5546, CaF1_WIE_45_H_02 SEQ ID NO:5554, CaF1_WIE_45_H_07 SEQ ID NO:5559, CaF1_WIE_46_G_08 SEQ ID NO:5621, CaF1_WIE_48_H_11 SEQ ID NO:5774, CaF1_WIE_50_C_02 SEQ ID NO:5850, CaF1_WIE_50_E_06 SEQ ID NO:5870, CaF1_WIE_50_H_01 SEQ ID NO:5890, CaF1_WIE_51_A_03 SEQ ID NO:5897, CaF1_WIE_51_A_09 SEQ ID NO:5903, CaF1_WIE_52_B_03 SEQ ID NO:5967, CaF1_WIE_52_F_06 SEQ ID NO:6004, CaF1_WIE_52_G_07 SEQ ID NO:6013, CaF1_WIE_53_D_04 SEQ ID NO:6052, CaF1_WIE_55_C_11 SEQ ID NO:6174 and CaF1_WIE_55_E_11 SEQ ID NO:6190.

Genes Involved in Translation, Post Translational Modifications and Protein Turnover Cellular processes like translation, post translational event and protein turnover are crucial for cell survival under different developmental stages and varied environmental conditions.

In the present study, this class constituted about 8.84% of ESTs and comprised predominantly the ribosomal proteins apart from some translation initiation factors. Genes encoding major ribosomal proteins such as S6, S8, S9, and L24/L26 were found both in susceptible and resistant genotypes. Translation factor SUI1 homolog and eukaryotic elongation factors (EF-1α and EF-2) play a pivotal role in protein biosynthesis. Their presence in CaUnigene set is indicative of their role in immune response.

A particularly sensitive, rapid and reversible response to environmental stimuli or to a programmatic change in cell state is the post-translational modification of specific proteins. In our study, 4.27% of the CaUnigenes correspond to proteins involved in protein modifications and turnover. The presence of cysteine proteinases and cyclophilin-type peptidyl-prolyl cis-trans isomerases more predominantly in resistant genotype indicate their role in pathostress responses. The presence of heat shock protein, DnaJ is interesting as it has been shown to be involved in different environmental stresses including high temperature and salinity treatment. Our results revealed the presence of a wide range of proteins involved in protein turnover that include ubiquitin conjugating enzyme E2, ubiquitin-protein ligase, 20S proteasome alpha 6 subunit, F-box protein and protein disulphide in both the genotypes. In plants, ubiquitin/proteasome pathway of protein degradation has been implicated in defense. These results suggest that regulated protein synthesis, modification and protein turnover may play central role in enabling plants to alter their proteome to maximize their chances of survival under adverse conditions.

In yet another embodiment the present invention provides ESTs derived from chickpea, wherein the ESTs are related to translation, ribosomal structure and biogenesis. These ESTs are CaF1_JIE_01_A_04 SEQ ID NO:3, CaF1_JIE_01_B_09 SEQ ID NO:18, CaF1_JIE_01_C_01 SEQ ID NO:21, CaF1_JIE_01_C_03 SEQ ID NO:23, CaF1_JIE_01_D_04 SEQ ID NO:35, CaF1_JIE_01_F_7 SEQ ID NO:55, CaF1_JIE_01_G_03 SEQ ID NO:60, CaF1_JIE_01_H_07 SEQ ID NO:69, CaF1_JIE_02_B_01 SEQ ID NO:80, CaF1_JIE_02_B_02 SEQ ID NO:81, CaF1_JIE_02_G_01 SEQ ID NO:124, CaF1_JIE_02_G_02 SEQ ID NO:125, CaF1_JIE_02_H_10 SEQ ID NO:141, CaF1_JIE_03_C_04 SEQ ID NO:160, CaF1_JIE_03_F_05 SEQ ID NO:187, CaF1_JIE_03_F_09 SEQ ID NO:191, CaF1_JIE_03_G_07 SEQ ID NO:198, CaF1_JIE_03_H_03 SEQ ID NO:204, CaF1_JIE_03_H_04 SEQ ID NO:205, CaF1_JIE_04_A_06 SEQ ID NO:214, CaF1_JIE_04_B_03 SEQ ID NO:222, CaF1_JIE_04_B_04 SEQ ID NO:223, CaF1_JIE_04_C_04 SEQ ID NO:234, CaF1_JIE_05_B_09 SEQ ID NO:307, CaF1_JIE_05_B_11 SEQ ID NO:309, CaF1_JIE_05_F_03 SEQ ID NO:343, CaF1_JIE_05_H_05 SEQ ID NO:364, CaF1_JIE_05_H_06 SEQ ID NO:365, CaF1_JIE_05_H_11 SEQ ID NO:370, CaF1_JIE_06_A_05 SEQ ID NO:374, CaF1_JIE_06_A_07 SEQ ID NO:376, CaF1_JIE_06_E_07 SEQ ID NO:407, CaF1_JIE_06_G_01 SEQ ID NO:421, CaF1_JIE_06_G_03 SEQ ID NO:423, CaF1_JIE_06_G_06 SEQ ID NO:426, CaF1_JIE_06_G_07 SEQ ID NO:427, CaF1_JIE_07_A_03 SEQ ID NO:438, CaF1_JIE_07_B_07 SEQ ID NO:450, CaF1_JIE_07_C_09 SEQ ID NO:462, CaF1_JIE_07_D_09 SEQ ID NO:473, CaF1_JIE_07_E_09 SEQ ID NO:482, CaF1_JIE_07_E_10 SEQ ID NO:483, CaF1_JIE_07_H_03 SEQ ID NO:507, CaF1_JIE_09_B_06 SEQ ID NO:613, CaF1_JIE_09_D_03 SEQ ID NO:629, CaF1_JIE_09_D_07 SEQ ID NO:1276, CaF1_JIE_09_H_07 SEQ ID NO:1314, CaF1_JIE_10_B_07 SEQ ID NO:1329, CaF1_JIE_10_B_08 SEQ ID NO:1330, CaF1_JIE_11_E_07 SEQ ID NO:1397, CaF1_JIE_12_B_09 SEQ ID NO:1438, CaF1_JIE_14_F_03 SEQ ID NO:1561, CaF1_JIE_14_F_04 SEQ ID NO:1562, CaF1_JIE_14_G_11 SEQ ID NO:1574, CaF1_JIE_16_C_11 SEQ ID NO:1675, CaF1_JIE_16_G_09 SEQ ID NO:1706, CaF1_JIE_17_D_04 SEQ ID NO:1739, CaF1_JIE_17_E_09 SEQ ID NO:1749, CaF1_JIE_17_E_10 SEQ ID NO:1750, CaF1_JIE_17_F_09 SEQ ID NO:1756, CaF1_JIE_17_F_10 SEQ ID NO:1757, CaF1_JIE_17_F_11 SEQ ID NO:1758, CaF1_JIE_18_B_02 SEQ ID NO:1777, CaF1_JIE_18_C_11 SEQ ID NO:1793, CaF1_JIE_18_D_01 SEQ ID NO:1794, CaF1_JIE_18_D_02 SEQ ID NO:1795, CaF1_JIE_18_E_01 SEQ ID NO:1802, CaF1_JIE_18_E_02 SEQ ID NO:1803, CaF1_JIE_18_F_09 SEQ ID NO:1818, CaF1_JIE_18_F_10 SEQ ID NO:1819, CaF1_JIE_18_H_02 SEQ ID NO:1830, CaF1_JIE_20_B_10 SEQ ID NO:1922, CaF1_JIE_20_C_06 SEQ ID NO:1929, CaF1_JIE_20_D_04 SEQ ID NO:1937, CaF1_JIE_20_E_04 SEQ ID NO:1948, CaF1_JIE_20_F_09 SEQ ID NO:1963, CaF1_JIE_20_G_07 SEQ ID NO:1971, CaF1_JIE_20_H_04 SEQ ID NO:1979, CaF1_JIE_21_B_05 SEQ ID NO:2001, CaF1_JIE_21_B_06 SEQ ID NO:2002, CaF1_JIE_21_E_07 SEQ ID NO:2031, CaF1_JIE_21_F_04 SEQ ID NO:2036, CaF1_JIE_21_G_06 SEQ ID NO:2047, CaF1_JIE_23_A_02 SEQ ID NO:2142, CaF1_JIE_23_E_04 SEQ ID NO:2182, CaF1_JIE_23_F_04 SEQ ID NO:2192, CaF1_JIE_24_A_

02 SEQ ID NO:2221, CaF1_JIE_24_F_08 SEQ ID NO:2271, CaF1_JIE_24_H_09 SEQ ID NO:2289, CaF1_JIE_25_A_04 SEQ ID NO:2293, CaF1_JIE_25_B_03 SEQ ID NO:2299, CaF1_JIE_25_C_01 SEQ ID NO:2304, CaF1_JIE_25_D_09 SEQ ID NO:2316, CaF1_JIE_25_F_01 SEQ ID NO:2325, CaF1_JIE_25_F_08 SEQ ID NO:2330, CaF1_JIE_25_H_10 SEQ ID NO:2345, CaF1_JIE_27_F_01 SEQ ID NO:2448, CaF1_JIE_29_E_11 SEQ ID NO:2551, CaF1_JIE_30_A_07 SEQ ID NO:2573, CaF1_JIE_30_E_07 SEQ ID NO:2593, CaF1_JIE_31_C_03 SEQ ID NO:2632, CaF1_JIE_31_G_03 SEQ ID NO:2660, CaF1_JIE_33_H_02 SEQ ID NO:2773, CaF1_JIE_33_H_05 SEQ ID NO:2776, CaF1_JIE_34_D_05 SEQ ID NO:2806, CaF1_JIE_34_D_07 SEQ ID NO:2807, CaF1_JIE_34_D_10 SEQ ID NO:2809, CaF1_JIE_36_H_11 SEQ ID NO:2947, CaF1_JIE_37_C_05 SEQ ID NO:2961, CaF1_JIE_37_H_07 SEQ ID NO:2994, CaF1_JIE_38_D_06 SEQ ID NO:3024, CaF1_JIE_38_E_08 SEQ ID NO:3033, CaF1_JIE_38_G_11 SEQ ID NO:3050, CaF1_JIE_39_D_04 SEQ ID NO:3079, CaF1_JIE_40_D_02 SEQ ID NO:3140, CaF1_JIE_40_F_09 SEQ ID NO:3160, CaF1_JIE_41_D_11 SEQ ID NO:3210, CaF1_JIE_42_G_03 SEQ ID NO:3267, CaF1_WIE_01_F_10 SEQ ID NO:679, CaF1_WIE_01_G_03 SEQ ID NO:683, CaF1_WIE_02_F_05 SEQ ID NO:742, CaF1_WIE_02_H_10 SEQ ID NO:761, CaF1_WIE_03_B_09 SEQ ID NO:773, CaF1_WIE_03_C_02 SEQ ID NO:776, CaF1_WIE_03_G_09 SEQ ID NO:808, CaF1_WIE_03_G_10 SEQ ID NO:809, CaF1_WIE_04_C_08 SEQ ID NO:842, CaF1_WIE_04_E_10 3 SEQ ID NO:854, CaF1_WIE_04_F_11 SEQ ID NO:871, CaF1_WIE_04_H_10 SEQ ID NO:886, CaF1_WIE_04_H_11 SEQ ID NO:887, CaF1_WIE_05_H_08 SEQ ID NO:954, CaF1_WIE_06_D_02 SEQ ID NO:980, CaF1_WIE_06_E_07 SEQ ID NO:992, CaF1_WIE_06_H_05 SEQ ID NO:1018, CaF1_WIE_06_H_06 SEQ ID NO:1019, CaF1_WIE_06_H_11 SEQ ID NO:1024, CaF1_WIE_07_B_05 SEQ ID NO:1038, CaF1_WIE_07_B_09 SEQ ID NO:1042, CaF1_WIE_07_C_01 SEQ ID NO:1045, CaF1_WIE_07_C_09 SEQ ID NO:1051, CaF1_WIE_07_E_06 SEQ ID NO:1068, CaF1_WIE_07_F_08 SEQ ID NO:1080, CaF1_WIE_07_G_02 SEQ ID NO:1085, CaF1_WIE_07_G_06 SEQ ID NO:1089, CaF1_WIE_07_H_01 SEQ ID NO:1094, CaF1_WIE_07_H_10 SEQ ID NO:1101, CaF1_WIE_08_C_08 SEQ ID NO:1126, CaF1_WIE_08_F_08 SEQ ID NO:1152, CaF1_WIE_09_C_10 SEQ ID NO:1190, CaF1_WIE_09_E_03 SEQ ID NO:1200, CaF1_WIE_09_E_08 SEQ ID NO:1205, CaF1_WIE_09_E_09 SEQ ID NO:1206, CaF1_WIE_09_F_06 SEQ ID NO:1214, CaF1_WIE_09_G_02 SEQ ID NO:1218, CaF1_WIE_09_G_04 SEQ ID NO:1220, CaF1_WIE_09_H_04 SEQ ID NO:1227, CaF1_WIE_10_A_01 SEQ ID NO:1234, CaF1_WIE_10_C_05 SEQ ID NO:1255, CaF1_WIE_10_H_09 SEQ ID NO:3305, CaF1_WIE_11_A_06 SEQ ID NO:3312, CaF1_WIE_11_C_04 SEQ ID NO:3328, CaF1_WIE_11_F_07 SEQ ID NO:3355, CaF1_WIE_11_G_01 SEQ ID NO:3360, CaF1_WIE_11_H_10 SEQ ID NO:3375, CaF1_WIE_12_A_04 SEQ ID NO:3379, CaF1_WIE_12_B_07 SEQ ID NO:3390, CaF1_WIE_12_B_10 SEQ ID NO:3393, CaF1_WIE_12_D_05 SEQ ID NO:3407, CaF1_WIE_12_E_11 SEQ ID NO:3420, CaF1_WIE_12_G_04 SEQ ID NO:3434, CaF1_WIE_12_H_08 SEQ ID NO:3448, CaF1_WIE_13_D_05 SEQ ID NO:3482, CaF1_WIE_13_E_02 SEQ ID NO:3488, CaF1_WIE_13_E_05 SEQ ID NO:3491, CaF1_WIE_13_E_10 SEQ ID NO:3495, CaF1_WIE_13_F_02 SEQ ID NO:3498, CaF1_WIE_13_F_10 SEQ ID NO:3504, CaF1_WIE_13_G_03 SEQ ID NO:3507, CaF1_WIE_13_G_08 SEQ ID NO:3512, CaF1_WIE_14_C_02 SEQ ID NO:3531, CaF1_WIE_14_G_01 SEQ ID NO:3551, CaF1_WIE_14_G_08 SEQ ID NO:3555, CaF1_WIE_14_H_11 SEQ ID NO:3561, CaF1_WIE_16_C_10 SEQ ID NO:3615, CaF1_WIE_16_D_09 SEQ ID NO:3618, CaF1_WIE_16_G_03 SEQ ID NO:3631, CaF1_WIE_16_G_11 SEQ ID NO:3636, CaF1_WIE_17_A_02 SEQ ID NO:3645, CaF1_WIE_17_A_08 SEQ ID NO:3651, CaF1_WIE_17_B_08 SEQ ID NO:3661, CaF1_WIE_17_E_04 SEQ ID NO:3687, CaF1_WIE_18_C_05 SEQ ID NO:3745, CaF1_WIE_18_D_08 SEQ ID NO:3756, CaF1_WIE_18_D_09 SEQ ID NO:3757, CaF1_WIE_18_E_02 SEQ ID NO:3761, CaF1_WIE_18_E_05 SEQ ID NO:3763, CaF1_WIE_18_F_01 SEQ ID NO:3770, CaF1_WIE_18_G_02 SEQ ID NO:3781, CaF1_WIE_19_A_08 SEQ ID NO:3802, CaF1_WIE_19_F_10 SEQ ID NO:3845, CaF1_WIE_19_F_11 SEQ ID NO:3846, CaF1_WIE_20_B_06 SEQ ID NO:3868, CaF1_WIE_20_E_06 SEQ ID NO:3888, CaF1_WIE_21_C_01 SEQ ID NO:3931, CaF1_WIE_21_C_02 SEQ ID NO:3932, CaF1_WIE_21_F_09 SEQ ID NO:3957, CaF1_WIE_22_F_06 SEQ ID NO:4011, CaF1_WIE_23_A_10 SEQ ID NO:4035, CaF1_WIE_23_C_09 SEQ ID NO:4045, CaF1_WIE_24_C_09 SEQ ID NO:4110, CaF1_WIE_24_D_08 SEQ ID NO:4119, CaF1_WIE_24_E_09 SEQ ID NO:4126, CaF1_WIE_24_G_05 SEQ ID NO:4143, CaF1_WIE_24_H_02 SEQ ID NO:4150, CaF1_WIE_24_H_05 SEQ ID NO:4153, CaF1_WIE_25_A_03 SEQ ID NO:4160, CaF1_WIE_25_C_11 SEQ ID NO:4185, CaF1_WIE_25_D_03 SEQ ID NO:4187, CaF1_WIE_25_D_09 SEQ ID NO:4193, CaF1_WIE_25_H_10 SEQ ID NO:4222, CaF1_WIE_26_B_09 SEQ ID NO:4239, CaF1_WIE_26_B_10 SEQ ID NO:4240, CaF1_WIE_26_C_01 SEQ ID NO:4242, CaF1_WIE_26_C_11 SEQ ID NO:4251, CaF1_WIE_26_D_09 SEQ ID NO:4259, CaF1_WIE_26_G_03 SEQ ID NO:4279, CaF1_WIE_26_G_06 SEQ ID NO:4282, CaF1_WIE_26_H_10 SEQ ID NO:4297, CaF1_WIE_27_C_01 SEQ ID NO:4320, CaF1_WIE_27_E_10 SEQ ID NO:4346, CaF1_WIE_27_F_04 SEQ ID NO:4351, CaF1_WIE_27_G_07 SEQ ID NO:4365, CaF1_WIE_27_H_02 SEQ ID NO:4371, CaF1_WIE_28_A_05 SEQ ID NO:4381, CaF1_WIE_28_B_01 SEQ ID NO:4387, CaF1_WIE_28_D_02 SEQ ID NO:4404, CaF1_WIE_28_E_02 SEQ ID NO:4413, CaF1_WIE_29_A_10 SEQ ID NO:4454, CaF1_WIE_29_B_03 SEQ ID NO:4458, CaF1_WIE_29_B_04 SEQ ID NO:4459, CaF1_WIE_29_F_01 SEQ ID NO:4499, CaF1_WIE_29_G_07 SEQ ID NO:4516, CaF1_WIE_30_C_04 SEQ ID NO:4550, CaF1_WIE_30_E_08 SEQ ID NO:4571, CaF1_WIE_30_F_10 SEQ ID NO:4582, CaF1_WIE_30_H_08 SEQ ID NO:4598, CaF1_WIE_31_B_01 SEQ ID NO:4611, CaF1_WIE_31_E_01 SEQ ID NO:4636, CaF1_WIE_31_F_01 SEQ ID NO:4645, CaF1_WIE_31_G_02 SEQ ID NO:4655, CaF1_WIE_32_B_11 SEQ ID NO:4691, CaF1_WIE_32_E_04 SEQ ID NO:4709, CaF1_WIE_33_D_07 SEQ ID NO:4773, CaF1_WIE_34_A_04 SEQ ID NO:4813, CaF1_WIE_34_F_09 SEQ ID NO:4859, CaF1_WIE_34_H_04 SEQ ID NO:4872, CaF1_WIE_35_A_03 SEQ ID NO:4879, CaF1_WIE_35_B_04 SEQ ID NO:4890, CaF1_WIE_35_B_06 SEQ ID NO:4892, CaF1_WIE_35_D_08 SEQ ID NO:4913, CaF1_WIE_35_D_09 SEQ ID NO:4914, CaF1_WIE_36_C_08 SEQ ID NO:4975, CaF1_WIE_36_G_01 SEQ ID NO:5002, CaF1_WIE_36_H_02 SEQ ID NO:5012,

CaF1_WIE_38_A_08 SEQ ID NO:5090, CaF1_WIE_38_B_09 SEQ ID NO:5098, CaF1_WIE_38_C_08 SEQ ID NO:5106, CaF1_WIE_38_C_10 SEQ ID NO:5108, CaF1_WIE_38_D_08 SEQ ID NO:5113, CaF1_WIE_38_F_09 SEQ ID NO:5128, CaF1_WIE_38_G_01 SEQ ID NO:5130, CaF1_WIE_38_G_10 SEQ ID NO:5135, CaF1_WIE_39_D_05 SEQ ID NO:5172, CaF1_WIE_39_G_03 SEQ ID NO:5184, CaF1_WIE_39_H_06 SEQ ID NO:5194, CaF1_WIE_40_A_01 SEQ ID NO:5198, CaF1_WIE_40_A_02 SEQ ID NO:5199, CaF1_WIE_40_B_03 SEQ ID NO:5211, CaF1_WIE_40_E_03 SEQ ID NO:5236, CaF1_WIE_40_F_03 SEQ ID NO:5246, CaF1_WIE_40_F_08 SEQ ID NO:5250, CaF1_WIE_40_F_10 SEQ ID NO:5252, CaF1_WIE_40_H_09 SEQ ID NO:5270, CaF1_WIE_40_H_10 SEQ ID NO:5271, CaF1_WIE_41_B_07 SEQ ID NO:5285, CaF1_WIE_41_B_08 SEQ ID NO:5286, CaF1_WIE_41_D_06 SEQ ID NO:5301, CaF1_WIE_41_D_10 SEQ ID NO:5304, CaF1_WIE_41_F_09 SEQ ID NO:5320, CaF1_WIE_41_H_09 SEQ ID NO:5338, CaF1_WIE_42_A_05 SEQ ID NO:5344, CaF1_WIE_42_A_10 SEQ ID NO:5347, CaF1_WIE_42_C_05 SEQ ID NO:5355, CaF1_WIE_42_C_06 SEQ ID NO:5356, CaF1_WIE_42_C_09. SEQ ID NO:5358, CaF1_WIE_42_F_04 SEQ ID NO:5373, CaF1_WIE_43_B_04 SEQ ID NO:5400, CaF1_WIE_43_C_04 SEQ ID NO:5407, CaF1_WIE_43_G_02 SEQ ID NO:5433, CaF1_WIE_43_G_06 SEQ ID NO:5435, CaF1_WIE_44_A_05 SEQ ID NO:5444, CaF1_WIE_44_C_06 SEQ ID NO:5459, CaF1_WIE_44_G_09 SEQ ID NO:5492, CaF1_WIE_45_B_09 SEQ ID NO:5516, CaF1_WIE_45_C_10 SEQ ID NO:5524, CaF1_WIE_45_D_05 SEQ ID NO:5526, CaF1_WIE_45_F_07 SEQ ID NO:5543, CaF1_WIE_45_G_07 SEQ ID NO:5549, CaF1_WIE_46_B_06 SEQ ID NO:5576, CaF1_WIE_46_C_09 SEQ ID NO:5588, CaF1_WIE_46_D_03 SEQ ID NO:5592, CaF1_WIE_47_D_09 SEQ ID NO:5667, CaF1_WIE_47_E_11 SEQ ID NO:5679, CaF1_WIE_47_F_05 SEQ ID NO:5684, CaF1_WIE_47_G_04 SEQ ID NO:5693, CaF1_WIE_47_H_02 SEQ ID NO:5702, CaF1_WIE_48_A_08 SEQ ID NO:5713, CaF1_WIE_48_A_09 SEQ ID NO:5714, CaF1_WIE_48_C_08 SEQ ID NO:5728, CaF1_WIE_48_C_09 SEQ ID NO:5729, CaF1_WIE_48_E_04 SEQ ID NO:5743, CaF1_WIE_48_G_07 SEQ ID NO:5762, CaF1_WIE_49_B_04 SEQ ID NO:5785, CaF1_WIE_49_H_06 SEQ ID NO:5829, CaF1_WIE_50_A_02 SEQ ID NO:5834, CaF1_WIE_50_B_04 SEQ ID NO:5841, CaF1_WIE_50_C_03 SEQ ID NO:5851, CaF1_WIE_50_C_06 SEQ ID NO:5853, CaF1_WIE_50_D_08 SEQ ID NO:5862, CaF1_WIE_50_E_03 SEQ ID NO:5867, CaF1_WIE_50_F_05 SEQ ID NO:5877, CaF1_WIE_51_C_09 SEQ ID NO:5922, CaF1_WIE_51_H_05 SEQ ID NO:5953, CaF1_WIE_51_H_06 SEQ ID NO:5954, CaF1_WIE_52_A_07 SEQ ID NO:5961, CaF1_WIE_52_B_05 SEQ ID NO:5969, CaF1_WIE_53_A_10 SEQ ID NO:6034, CaF1_WIE_53_F_02 SEQ ID NO:6066, CaF1_WIE_53_F_05 SEQ ID NO:6069, CaF1_WIE_53_F_07 SEQ ID NO:6071, CaF1_WIE_53_G_02 SEQ ID NO:6075, CaF1_WIE_54_B_09 SEQ ID NO:6097, CaF1_WIE_54_D_03 SEQ ID NO:6111, CaF1_WIE_55_D_04 SEQ ID NO:6178, CaF1_WIE_56_A_02 SEQ ID NO:6219, CaF1_WIE_56_A_06 SEQ ID NO:6222, CaF1_WIE_56_B_01 SEQ ID NO:6227, CaF1_WIE_56_E_07 SEQ ID NO:6247, CaF1_WIE_56_F_03 SEQ ID NO:6251, CaF1_WIE_56_H_10 SEQ ID NO:6271 and CaF1_WIE_56_H_11 SEQ ID NO:6272.

Another embodiment of the present invention provides ESTs derived from chickpea, wherein the ESTs are related to post translational modification, protein turn over and chaperons. These ESTs are CaF1_JIE_02_C_01 SEQ ID NO:88, CaF1_JIE_02_C_05 SEQ ID NO:92, CaF1_JIE_02_E_08 SEQ ID NO:113, CaF1_JIE_03_B_09 SEQ ID NO:154, CaF1_JIE_03_G_08 SEQ ID NO:199, CaF1_JIE_04_E_10 SEQ ID NO:257, CaF1_JIE_04_F_08 SEQ ID NO:266, CaF1_JIE_04_G_03 SEQ ID NO:272, CaF1_JIE_05_B_05 SEQ ID NO:303, CaF1_JIE_07_G_07 SEQ ID NO:500, CaF1_JIE_07_H_01 SEQ ID NO:505, CaF1_JIE_07_H_09 SEQ ID NO:513, CaF1_JIE_07_H_11 SEQ ID NO:515, CaF1_JIE_08_D_04 SEQ ID NO:549, CaF1_JIE_09_E_08 SEQ ID NO:1288, CaF1_JIE_11_B_08 SEQ ID NO:1372, CaF1_JIE_11_D_10 SEQ ID NO:1391, CaF1_JIE_12_A_01 SEQ ID NO:1422, CaF1_JIE_12_A_03 SEQ ID NO:1424, CaF1_JIE_13_D_04 SEQ ID NO:1496, CaF1_JIE_13_D_05 SEQ ID NO:1497, CaF1_JIE_13_E_02 SEQ ID NO:1498, CaF1_JIE_14_C_08 SEQ ID NO:1541, CaF1_JIE_14_D_03 SEQ ID NO:1546, CaF1_JIE_15_A_03 SEQ ID NO:1583, CaF1_JIE_15_H_02 SEQ ID NO:1642, CaF1_JIE_17_A_07 SEQ ID NO:1721, CaF1_JIE_17_C_02 SEQ ID NO:1727, CaF1_JIE_17_C_03 SEQ ID NO:1728, CaF1_JIE_17_D_05 SEQ ID NO:1740, CaF1_JIE_17_D_06 SEQ ID NO:1741, CaF1_JIE_17_E_04 SEQ ID NO:1746, CaF1_JIE_17_F_02 SEQ ID NO:1752, CaF1_JIE_18_E_11 SEQ ID NO:1810, CaF1_JIE_19_G_07 SEQ ID NO:1891, CaF1_JIE_19_G_08 SEQ ID NO:1892, CaF1_JIE_19_G_09 SEQ ID NO:1893, CaF1_JIE_20_A_10 SEQ ID NO:1912, CaF1_JIE_21_A_08 SEQ ID NO:1993, CaF1_JIE_21_E_11 SEQ ID NO:2034, CaF1_JIE_21_F_09 SEQ ID NO:2040, CaF1_JIE_23_C_08 SEQ ID NO:2168, CaF1_JIE_23_D_09 SEQ ID NO:2177, CaF1_JIE_23_E_10 SEQ ID NO:2188, CaF1_JIE_23_F_09 SEQ ID NO:2197, CaF1_JIE_26_G_10 SEQ ID NO:2401, CaF1_JIE_29_H_02 SEQ ID NO:2561, CaF1_JIE_30_G_01 SEQ ID NO:2601, CaF1_JIE_30_G_11 SEQ ID NO:2607, CaF1_JIE_31_H_06 SEQ ID NO:2671, CaF1_JIE_32_B_11 SEQ ID NO:2685, CaF1_JIE_32_G_01 SEQ ID NO:2709, CaF1_JIE_33_B_11 SEQ ID NO:2739, CaF1_JIE_33_C_02 SEQ ID NO:2741, CaF1_JIE_34_D_02 SEQ ID NO:2804, CaF1_JIE_34_D_03 SEQ ID NO:2805, CaF1_JIE_34_E_04 SEQ ID NO:2813, CaF1_JIE_34_E_05 SEQ ID NO:2814, CaF1_JIE_34_G_02 SEQ ID NO:2822, CaF1_JIE_35_A_01 SEQ ID NO:2838, CaF1_JIE_35_D_08 SEQ ID NO:2867, CaF1_JIE_37_A_03 SEQ ID NO:2948, CaF1_JIE_37_D_03 SEQ ID NO:2966, CaF1_JIE_37_F_02 SEQ ID NO:2976, CaF1_JIE_37_F_07 SEQ ID NO:2978, CaF1_JIE_38_A_07 SEQ ID NO:3001, CaF1_JIE_39_D_06 SEQ ID NO:3080, CaF1_JIE_39_E_01 SEQ ID NO:3083, CaF1_WIE_01_F_02 SEQ ID NO:673, CaF1_WIE_01_F_03 SEQ ID NO:674, CaF1_WIE_01_H_09 SEQ ID NO:697, CaF1_WIE_03_C_01 SEQ ID NO:775, CaF1_WIE_03_E_02 SEQ ID NO:792, CaF1_WIE_03_G_02 SEQ ID NO:806, CaF1_WIE_04_G_02 SEQ ID NO:872, CaF1_WIE_06_A_04 SEQ ID NO:959, CaF1_WIE_06_B_05 SEQ ID NO:967, CaF1_WIE_06_B_06 SEQ ID NO:968, CaF1_WIE_06_B_11 SEQ ID NO:971, CaF1_WIE_06_C_06 SEQ ID NO:977, CaF1_WIE_06_E_04 SEQ ID NO:990, CaF1_WIE_06_G_11 SEQ ID NO:1013, CaF1_WIE_06_H_04 SEQ ID NO:1017, CaF1_WIE_07_A_11 SEQ ID NO:1033, CaF1_WIE_07_B_07 SEQ ID NO:1040, CaF1_WIE_07_E_03 SEQ ID NO:1066, CaF1_WIE_

07_F_01 SEQ ID NO:1073, CaF1_WIE_07_F_02 SEQ ID NO:1074, CaF1_WIE_07_G_10 SEQ ID NO:1092, CaF1_WIE_07_H_05 SEQ ID NO:1097, CaF1_WIE_08_D_11 SEQ ID NO:1139, CaF1_WIE_08_H_10 SEQ ID NO:1172, CaF1_WIE_08_H_11 SEQ ID NO:1173, CaF1_WIE_09_A_10 SEQ ID NO:1181, CaF1_WIE_09_F_04 SEQ ID NO:1212, CaF1_WIE_09_H_06 SEQ ID NO:1229, CaF1_WIE_10_A_02 SEQ ID NO:1235, CaF1_WIE_10_A_03 SEQ ID NO:1236, CaF1_WIE_10_B_07 SEQ ID NO:1249, CaF1_WIE_10_C_11 SEQ ID NO:1260, CaF1_WIE_10_E_05" SEQ ID NO:3275, CaF1_WIE_10_E_10 SEQ ID NO:3279, CaF1_WIE_10_E_11 SEQ ID NO:3280, CaF1_WIE_11_A_07 SEQ ID NO:3313, CaF1_WIE_11_B_07 SEQ ID NO:3322, CaF1_WIE_11_C_05 SEQ ID NO:3329, CaF1_WIE_11_F_06 SEQ ID NO:3354, CaF1_WIE_11_F_11 SEQ ID NO:3359, CaF1_WIE_12_D_04 SEQ ID NO:3406, CaF1_WIE_12_F_09 SEQ ID NO:3428, CaF1_WIE_13_H_10 SEQ ID NO:3522, CaF1_WIE_14_C_09 SEQ ID NO:3534, CaF1_WIE_14_E_10 SEQ ID NO:3544, CaF1_WIE_14_F_08 SEQ ID NO:3549, CaF1_WIE_14_F_09 SEQ ID NO:3550, CaF1_WIE_14_G_09 SEQ ID NO:3556, CaF1_WIE_15_F_08 SEQ ID NO:3590, CaF1_WIE_16_E_10 SEQ ID NO:3625, CaF1_WIE_17_D_05 SEQ ID NO:3677, CaF1_WIE_17_D_07 SEQ ID NO:3679, CaF1_WIE_17_E_07 SEQ ID NO:3690, CaF1_WIE_17_E_09 SEQ ID NO:3692, CaF1_WIE_17_H_07 SEQ ID NO:3720, CaF1_WIE_18_B_06 SEQ ID NO:3737, CaF1_WIE_18_C_01 SEQ ID NO:3741, CaF1_WIE_18_C_06 SEQ ID NO:3746, CaF1_WIE_18_C_09 SEQ ID NO:3749, CaF1_WIE_18_D_11 SEQ ID NO:3759, CaF1_WIE_18_F_03 SEQ ID NO:3772, CaF1_WIE_18_G_03 SEQ ID NO:3782, CaF1_WIE_19_B_08 SEQ ID NO:3812, CaF1_WIE_19_D_09 SEQ ID NO:3828, CaF1_WIE_19_E_03 SEQ ID NO:3830, CaF1_WIE_20_E_08 SEQ ID NO:3890, CaF1_WIE_20_F_05 SEQ ID NO:3896, CaF1_WIE_20_F_07 SEQ ID NO:3897, CaF1_WIE_21_A_10 SEQ ID NO:3922, CaF1_WIE_21_C_09 SEQ ID NO:3936, CaF1_WIE_21_D_01 SEQ ID NO:3939, CaF1_WIE_21_E_09 SEQ ID NO:3951, CaF1_WIE_21_F_11 SEQ ID NO:3959, CaF1_WIE_22_08 SEQ ID NO:3988, CaF1_WIE_23_H_09 SEQ ID NO:4085, CaF1_WIE_24_D_11 SEQ ID NO:4120, CaF1_WIE_24_E_06 SEQ ID NO:4124, CaF1_WIE_25_A_02 SEQ ID NO:4159, CaF1_WIE_25_E_02 SEQ ID NO:4196, CaF1_WIE_25_E_05 SEQ ID NO:4199, CaF1_WIE_26_A_02 SEQ ID NO:4225, CaF1_WIE_26_G_04 SEQ ID NO:4280, CaF1_WIE_27_B_03 SEQ ID NO:4311, CaF1_WIE_27_B_09 SEQ ID NO:4317, CaF1_WIE_27_D_06 SEQ ID NO:4332, CaF1_WIE_27_E_07 SEQ ID NO:4343, CaF1_WIE_27_F_07 SEQ ID NO:4354, CaF1_WIE_27_G_01 SEQ ID NO:4359, CaF1_WIE_27_H_03 SEQ ID NO:4372, CaF1_WIE_28_C_06 SEQ ID NO:4398, CaF1_WIE_29_B_05 SEQ ID NO:4460, CaF1_WIE_29_D_11 SEQ ID NO:4487, CaF1_WIE_29_E_02 SEQ ID NO:4489, CaF1_WIE_29_E_05 SEQ ID NO:4492, CaF1_WIE_29_G_01 SEQ ID NO:4510, CaF1_WIE_30_B_10 SEQ ID NO:4546, CaF1_WIE_30_G_02 SEQ ID NO:4585, CaF1_WIE_31_C_03 SEQ ID NO:4622, CaF1_WIE_32_A_09 SEQ ID NO:4679, CaF1_WIE_32_B_01 SEQ ID NO:4682, CaF1_WIE_32_B_05 SEQ ID NO:4685, CaF1_WIE_32_C_06 SEQ ID NO:4697, CaF1_WIE_32_E_06 SEQ ID NO:4711, CaF1_WIE_33_F_07 SEQ ID NO:4790, CaF1_WIE_33_G_06 SEQ ID NO:4799, CaF1_WIE_34_A_02 SEQ ID NO:4811, CaF1_WIE_34_B_10 SEQ ID NO:4826, CaF1_WIE_34_C_02 SEQ ID NO:4828, CaF1_WIE_34_D_03 SEQ ID NO:4838, CaF1_WIE_34_F_10 SEQ ID NO:4860, CaF1_WIE_34_G_04 SEQ ID NO:4864, CaF1_WIE_35_A_04 SEQ ID NO:4880, CaF1_WIE_35_A_05 SEQ ID NO:4881, CaF1_WIE_35_A_11 SEQ ID NO:4886, CaF1_WIE_35_C_02 SEQ ID NO:4898, CaF1_WIE_35_C_03 SEQ ID NO:4899, CaF1_WIE_35_C_11 SEQ ID NO:4906, CaF1_WIE_35_D_01 SEQ ID NO:4907, CaF1_WIE_35_F_04 SEQ ID NO:4930, CaF1_WIE_35_F_06 SEQ ID NO:4931, CaF1_WIE_35_G_10 SEQ ID NO:4945, CaF1_WIE_35_H_02 SEQ ID NO:4947, CaF1_WIE_35_H_04 SEQ ID NO:4949, CaF1_WIE_36_D_01 SEQ ID NO:4979, CaF1_WIE_36_F_01 SEQ ID NO:4996, CaF1_WIE_36_F_09 SEQ ID NO:5000, CaF1_WIE_36_F_11 SEQ ID NO:5001, CaF1_WIE_36_H_04 SEQ ID NO:5014, CaF1_WIE_36_H_05 SEQ ID NO:5015, CaF1_WIE_37_B_08 SEQ ID NO:5035, CaF1_WIE_37_E_01 SEQ ID NO:5048, CaF1_WIE_38_B_05 SEQ ID NO:5096, CaF1_WIE_38_C_07 SEQ ID NO:5105, CaF1_WIE_39_C_05 SEQ ID NO:5164, CaF1_WIE_39_G_08 SEQ ID NO:5188, CaF1_WIE_40_G_05 SEQ ID NO:5257, CaF1_WIE_40_G_10 SEQ ID NO:5262, CaF1_WIE_41_A_05 SEQ ID NO:5276, CaF1_WIE_41_A_08 SEQ ID NO:5278, CaF1_WIE_42_F_01 SEQ ID NO:5372, CaF1_WIE_42_H_11 SEQ ID NO:5388, CaF1_WIE_43_A_05 SEQ ID NO:5392, CaF1_WIE_43_B_10 SEQ ID NO:5404, CaF1_WIE_43_F_11 SEQ ID NO:5432, CaF1_WIE_44_A_06 SEQ ID NO:5445, CaF1_WIE_44_D_03 SEQ ID NO:5466, CaF1_WIE_44_D_07 SEQ ID NO:5470, CaF1_WIE_44_F_01 SEQ ID NO:5481, CaF1_WIE_44_H_02 SEQ ID NO:5495, CaF1_WIE_46_B_03 SEQ ID NO:5574, CaF1_WIE_46_E_01 SEQ ID NO:5599, CaF1_WIE_46_E_09 SEQ ID NO:5605, CaF1_WIE_47_F_03 SEQ ID NO:5682, CaF1_WIE_47_H_03 SEQ ID NO:5703, CaF1_WIE_47_H_10 SEQ ID NO:5709, CaF1_WIE_49_F_03 SEQ ID NO:5815, CaF1_WIE_50_B_05 SEQ ID NO:5842, CaF1_WIE_50_D_05 SEQ ID NO:5859, CaF1_WIE_50_F_06 SEQ ID NO:5878, CaF1_WIE_50_H_07 SEQ ID NO:5893, CaF1_WIE_51_E_07 SEQ ID NO:5937, CaF1_WIE_51_F_01 SEQ ID NO:5941, CaF1_WIE_51_H_09 SEQ ID NO:5955, CaF1_WIE_52_A_04 SEQ ID NO:5959, CaF1_WIE_52_B_09 SEQ ID NO:5973, CaF1_WIE_52_B_10 SEQ ID NO:5974, CaF1_WIE_52_C_05 SEQ ID NO:5979, CaF1_WIE_52_G_04 SEQ ID NO:6011, CaF1_WIE_53_A_05 SEQ ID NO:6030, CaF1_WIE_53_D_07 SEQ ID NO:6054, CaF1_WIE_53_D_08 SEQ ID NO:6055, CaF1_WIE_53_G_09 SEQ ID NO:6077, CaF1_WIE_54_A_03 SEQ ID NO:6083, CaF1_WIE_54_B_04 SEQ ID NO:6092, CaF1_WIE_54_D_04 SEQ ID NO:6112, CaF1_WIE_55_D_03 SEQ ID NO:6177, CaF1_WIE_55_D_08 SEQ ID NO:6180, CaF1_WIE_55_F_02 SEQ ID NO:6192, CaF1_WIE_55_F_11 SEQ ID NO:6198, CaF1_WIE_55_G_07 SEQ ID NO:6205, CaF1_WIE_55_H_11 SEQ ID NO:6218, CaF1_WIE_56_C_07 SEQ ID NO:6237, CaF1_WIE_56_E_10 SEQ ID NO:6250 and CaF1_WIE_56_G_03 SEQ ID NO:6259.

Genes Encoding Nucleotide Binding Proteins

In our study, GTP binding proteins were found to be the major class of nucleotide binding proteins in susceptible as well as resistant genotypes. The stress-responsive predominant GTP binding proteins were of Ras, Rab and Ran type. ESTs encoding ras-like small monomeric GTP-binding protein and GMPase were present in the susceptible genotype while Rab, RABIC, GTP cyclohydrolase and RabGAP/TBC were found only in the resistant one. However, ESTs encoding Ras small GTPase and RAB1X were identified in both the genotypes. GTP binding proteins are reported to be associated with a wide range of growth and developmental processes besides their role in plant defense.

Accordingly the present invention provides ESTs derived from chickpea, wherein the ESTs are related to nucleotide binding proteins. These ESTs are CaF1_JIE_01 B_11 SEQ ID NO:20, CaF1_JIE_02_G_04 SEQ ID NO:126, CaF1_JIE_02_G_10_SEQ ID NO:132, CaF1_JIE_05_D_03 SEQ ID NO:321, CaF1_JIE_13_C_08 SEQ ID NO:1493, CaF1_JIE_24_B_11 SEQ ID NO:2239, CaF1_JIE_25_F_04 SEQ ID NO:2327, CaF1_JIE_25_F_09 SEQ ID NO:2331, CaF1_JIE_25_H_01 SEQ ID NO:2340, CaF1_JIE_27_C_04 SEQ ID NO:2427, CaF1_JIE_29_C_03 SEQ ID NO:2534, CaF1_JIE_29_H_06 SEQ ID NO:2564, CaF1_JIE_32_G_03 SEQ ID NO:2710, CaF1_WIE_01_H_06 SEQ ID NO:695, CaF1_WIE_05_F_09 SEQ ID NO:937, CaF1_WIE_07_C_06 SEQ ID NO:1049, CaF1_WIE_07_D_11 SEQ ID NO:1063, CaF1_WIE_10_B_02 SEQ ID NO:1244, CaF1_WIE_14_G_02 SEQ ID NO:3552, CaF1_WIE_23_G_08 SEQ ID NO:4076, CaF1_WIE_25_E_04 SEQ ID NO:4198, CaF1_WIE_25_H_03 SEQ ID NO:4217, CaF1_WIE_26_H_09 SEQ ID NO:4296, CaF1_WIE_29_B_02 SEQ ID NO:4457, CaF1_WIE_29_F_09 SEQ ID NO:4507, CaF1_WIE_34_C_03 SEQ ID NO:4829, CaF1_WIE_36_A_09 SEQ ID NO:4962, CaF1_WIE_39_F_08 SEQ ID NO:5181, CaF1_WIE_41_E_07 SEQ ID NO:5312, CaF1_WIE_44_E_07 SEQ ID NO:5478, CaF1_WIE_46_A_07 SEQ ID NO:5569, CaF1_WIE_46_A_08 SEQ ID NO:5570, CaF1_WIE_46_D_06. SEQ ID NO:5595, CaF1_WIE_49_F_06 SEQ ID NO:5817 and CaF1_WIE_52_C_06 SEQ ID NO:5980.

Genes Involved in Metabolism

Developmental changes and stress responses are often correlated with or result in adjustments in various metabolic pathways. The functional class of metabolism comprised of about 14.56% of the unigenes and represented the largest class apart from NSH and hypothetical proteins. The genes present in this class represented several biochemical pathways such as carbohydrate, fatty acid, energy and protein metabolism besides nitrogen and nucleotide metabolism. The genes involved in carbohydrate metabolism comprised alcohol dehydrogenase (ADH), glyceraldehyde3-phosphate dehydrogenase (GAPDH), enolase, fructose-bisphosphate aldolase, malate dehydrogenase, phosphoenol pyruvate (PEP) carboxylase and triosephosphate isomerase and were present in both the genotypes. Most of these enzymes are known to show altered expression in response to stress. Though very little is known about the direct role of these proteins in defense, many such enzymes are involved in maintaining metabolite pool that may drive the metabolic processes to overcome such stresses. Polygalactouronase inhibiting protein (PGIP) was present in both the susceptible and resistant genotypes. The PGIPs are cell wall proteins, which act against fungal polygalactouronases that are important pathogenecity factors. Besides their classical function, they also form long chain oligogalactouronides and facilitate the activation of plant defense responses. We observed the presence of β1,3-glucanase, a PR 2 family protein, which was earlier shown to be expressed in response to pathogen infection.

The genes involved in lipid biosynthesis, for example, acyl Co-A synthetase and acyl Co-A binding proteins were found to be present in both the genotypes. The enzyme acyl Co-A synthetase has been shown to be induced in response to compatible and incompatible interactions between *Xanthomonas* and *Capsicum* annum while Acyl Co-A binding proteins play an important role in intracellular transport and formation of acyl Co-A pools. ESTs encoding desaturases in the CaUnigene set showed varied substrate specificity between the two genotypes. For example, oleate and sterol desaturases were found in the susceptible genotype and putative desaturase-like protein was present in the resistant one. Desaturases catalyze the formation of double bonds in lipids thereby increasing the lipid fluidity, which might be required as an adjustment associated with membrane stability under progressive wilting. ESTs corresponding to other lipid metabolism genes such as serine C-palmitoyltransferase, was also found to be present in stressed tissues. Identification of sterol metabolism related enzymes such as sterol methyl transferases and oxysterol binding proteins suggest the occurrence of lipid modifications during pathostress. Presence of HMG Co-A reductase which catalyzes the synthesis of mevalonate, a specific precursor of plant defense metabolite sesquiterpene phytoelexins, is indicative of its role in cell defense.

Several amino acids act as precursors for the synthesis of specialized metabolites, during varied cellular adaptations. ESTs encoding enzymes involved in amino acid metabolism, for example, arginine decarboxylase, aspartate aminotransferase, and cysteine synthase were identified in both the genotypes. Recent evidence suggests that arginine decarboxylase, involved in putrescine biosynthesis, is induced in response to various environmental stresses. Proline dehydrogenase and many proline-rich proteins were identified in resistant genotype. Proline dehydrogenase is the rate-limiting enzyme in proline degradation and serves important functions in stress responses.

Nucleotide metabolism related genes such as nuleoside diphosphate kinase (NDK), adenine nucleotide translocator and polynucleotide phosphorylase were also identified in both, the genotypes. Previously, it has been shown that the overexpressing NDK provides higher ability to eliminate $H_2O_2$, indicating its potential role in the management of reactive oxygen species under stress.

Another embodiment of the present invention provides ESTs derived from chickpea, wherein the ESTs are related to metabolism. These ESTs are CaF1_JIE_01_A_05 SEQ ID NO:4, CaF1_JIE_01_B_02 SEQ ID NO:11, CaF1_JIE_01_B_03 SEQ ID NO:12, CaF1_JIE_01_B_04 SEQ ID NO:13, CaF1_JIE_01_B_07 SEQ ID NO:16, CaF1_JIE_01_C_07 SEQ ID NO:27, CaF1_JIE_01_C_08 SEQ ID NO:28, CaF1_JIE_01_C_09 SEQ ID NO:29, CaF1_JIE_01_D_02 SEQ ID NO:33, CaF1_JIE_01_D_07 SEQ ID NO:37, CaF1_JIE_01_E_03 SEQ ID NO:43, CaF1_JIE_01_E_06 SEQ ID NO:46, CaF1_JIE_01_E_10 SEQ ID NO:49, CaF1_JIE_01_F_04 SEQ ID NO:52, CaF1_JIE_01_F_06 SEQ ID NO:54, CaF1_JIE_01_G_04 SEQ ID NO:61, CaF1_JIE_01_G_06 SEQ ID NO:63, CaF1_JIE_01_G_08 SEQ ID NO:64, CaF1_JIE_02_A_11 SEQ ID NO:79, CaF1_JIE_02_D_02 SEQ ID NO:99, CaF1_JIE_02_E_01 SEQ ID NO:108, CaF1_JIE_02_E_06 SEQ ID NO:112, CaF1_JIE_02_E_09 SEQ ID NO:114, CaF1_JIE_02_F_03 SEQ ID NO:117, CaF1_JIE_02_F_09 SEQ ID NO:122, CaF1_JIE_02_G_07 SEQ ID NO:129, CaF1_JIE_02_H_02 SEQ ID NO:134, CaF1_JIE_03_A_04 SEQ ID NO:146, CaF1_JIE_03_C_01 SEQ ID NO:157, CaF1_JIE_03_D_01 SEQ ID NO:166, CaF1_JIE_03_E_01 SEQ ID NO:174, CaF1_JIE_03_E_02 SEQ ID NO:175, CaF1_JIE_03_E_08 SEQ ID NO:179, CaF1_JIE_03_F_01 SEQ ID NO:183, CaF1_JIE_03_F_03 SEQ ID NO:185, CaF1_JIE_03_F_04 SEQ ID NO:186, CaF1_JIE_03_F_06 SEQ ID NO:188, CaF1_JIE_03_F_07 SEQ ID NO:189, CaF1_JIE_03_G_02 SEQ ID NO:194, CaF1_JIE_03_H_

11 SEQ ID NO:209, CaF1_JIE_04_C_03 SEQ ID NO:233, CaF1_JIE_04_C_06 SEQ ID NO:236, CaF1_JIE_04_D_01 SEQ ID NO:240, CaF1_JIE_04_D_03 SEQ ID NO:242, CaF1_JIE_04_D_08 SEQ ID NO:246, CaF1_JIE_04_D_10 SEQ ID NO:248, CaF1_JIE_04_E_02 SEQ ID NO:251, CaF1_JIE_04_E_09 SEQ ID NO:256, CaF1_JIE_04_F_10 SEQ ID NO:268, CaF1_JIE_04_H_05 SEQ ID NO:284, CaF1_JIE_04_H_10 SEQ ID NO:288, CaF1_JIE_05_B_03 SEQ ID NO:301, CaF1_JIE_05_13104 SEQ ID NO:302, CaF1_JIE_05_D_09 SEQ ID NO:327, CaF1_JIE_05_E_03 SEQ ID NO:332, CaF1_JIE_05_F_04 SEQ ID NO:344, CaF1_JIE_05_F_07 SEQ ID NO:347, CaF1_JIE_05_F_11 SEQ ID NO:350, CaF1_JIE_05_G_03 SEQ ID NO:353, CaF1_JIE_06_A_01 SEQ ID NO:371, CaF1_JIE_06_B_05 SEQ ID NO:383, CaF1_JIE_06_D_01 SEQ ID NO:395, CaF1_JIE_06_D_03 SEQ ID NO:397, CaF1_JIE_06_D_05 SEQ ID NO:399, CaF1_JIE_06_D_07 SEQ ID NO:400, CaF1_JIE_06_D_09 SEQ ID NO:402, CaF1_JIE_06_E_01 SEQ ID NO:405, CaF1_JIE_06_F_11 SEQ ID NO:420, CaF1_JIE_06_G_05 SEQ ID NO:425, CaF1_JIE_06_H_01 SEQ ID NO:429, CaF1_JIE_06_H_04 SEQ ID NO:431, CaF1_JIE_06_H_09 SEQ ID NO:435, CaF1_JIE_07_A_02 SEQ ID NO:437, CaF1_JIE_07_A_09 SEQ ID NO:442, CaF1_JIE_07_B_06 SEQ ID NO:449, CaF1_JIE_07_C_02 SEQ ID NO:455, CaF1_JIE_07_C_08 SEQ ID NO:461, CaF1_JIE_07_F_01 SEQ ID NO:485, CaF1_JIE_07_F_02 SEQ ID NO:486, CaF1_JIE_07_G_09 SEQ ID NO:502, CaF1_JIE_07_G_11 SEQ ID NO:504, CaF1_JIE_07_H_07 SEQ ID NO:511, CaF1_JIE_08_A_02 SEQ ID NO:517, CaF1_JIE_08_B_05 SEQ ID NO:529, CaF1_JIE_08_C_11 SEQ ID NO:545, CaF1_JIE_08_F_02 SEQ ID NO:568, CaF1_JIE_08_G_04 SEQ ID NO:579, CaF1_JIE_08_H_04 SEQ ID NO:590, CaF1_JIE_08_H_08 SEQ ID NO:594, CaF1_JIE_09_C_04 SEQ ID NO:621, CaF1_JIE_09_D_04 SEQ ID NO:1273, CaF1_JIE_09_D_10 SEQ ID NO:1279, CaF1_JIE_09_E_01 SEQ ID NO:1281, CaF1_JIE_09_E_04 SEQ ID NO:1284, CaF1_JIE_09_F_06 SEQ ID NO:1296, CaF1_JIE_09_G_06 SEQ ID NO:1305, CaF1_JIE_09_G_09 SEQ ID NO:1307, CaF1_JIE_09_G_10 SEQ ID NO:1308, CaF1_JIE_09_H_08 SEQ ID NO:1315, CaF1_JIE_10_A_08 SEQ ID NO:1321, CaF1_JIE_10_B_09 SEQ ID NO:1331, CaF1_JIE_10_D_03 SEQ ID NO:1337, CaF1_JIE_10_F_01 SEQ ID NO:1342, CaF1_JIE_10_H_03 SEQ ID NO:1354, CaF1_JIE_11_A_07 SEQ ID NO:1364, CaF1_JIE_11_A_08 SEQ ID NO:1365, CaF1_JIE_11_A_09 SEQ ID NO:1366, CaF1_JIE_11_D_01 SEQ ID NO:1384, CaF1_JIE_11_D_02 SEQ ID NO:1385, CaF1_JIE_11_D_03 SEQ ID NO:1386, CaF1_JIE_11_D_09 SEQ ID NO:1390, CaF1_JIE_11_E_04 SEQ ID NO:1394, CaF1_JIE_11_E_05 SEQ ID NO:1395, CaF1_JIE_11_E_10 SEQ ID NO:1400, CaF1_JIE_11_F_02 SEQ ID NO:1401, CaF1_JIE_11_F_06 SEQ ID NO:1405, CaF1_JIE_11_G_03 SEQ ID NO:1410, CaF1_JIE_11_G_06 SEQ ID NO:1413, CaF1_JIE_11_G_10 SEQ ID NO:1417, CaF1_JIE_11_H_08 SEQ ID NO:1420, CaF1_JIE_11_H_10 SEQ ID NO:1421, CaF1_JIE_12_A_11 SEQ ID NO:1429, CaF1_JIE_12_B_01 SEQ ID NO:1430, CaF1_JIE_12_C_04 SEQ ID NO:1443, CaF1_JIE_12_C_05 SEQ ID NO:1444, CaF1_JIE_12_C_11 SEQ ID NO:1448, CaF1_JIE_12_D_01 SEQ ID NO:1449, CaF1_JIE_12_D_02 SEQ ID NO:1450, CaF1_JIE_12_F_09 SEQ ID NO:1465, CaF1_JIE_12_F_10 SEQ ID NO:1466, CaF1_JIE_12_G_09 SEQ ID NO:1470, CaF1_JIE_12_G_10 SEQ ID NO:1471, CaF1_JIE_12_H_08 SEQ ID NO:1475, CaF1_JIE_13_A_01 SEQ ID NO:1477, CaF1_JIE_13_E_03 SEQ ID NO:1499, CaF1_JIE_13_E_07 SEQ ID NO:1500, CaF1_JIE_13_G_02 SEQ ID NO:1508, CaF1_JIE_13_G_04 SEQ ID NO:1509, CaF1_JIE_13_H_03 SEQ ID NO:1517, CaF1_JIE_14_B_09 SEQ ID NO:1533, CaF1_JIE_14_B_11 SEQ ID NO:1535, CaF1_JIE_14_D_06 SEQ ID NO:1548, CaF1_JIE_14_D_09 SEQ ID NO:1550, CaF1_JIE_14_D_10 SEQ ID NO:1551, CaF1_JIE_14_F_02 SEQ ID NO:1560, CaF1_JIE_14_F_06 SEQ ID NO:1564, CaF1_JIE_14_F_11 SEQ ID NO:1566, CaF1_JIE_14_H_02 SEQ ID NO:1575, CaF1_JIE_14_H_05 SEQ ID NO:1577, CaF1_JIE_14_H_06 SEQ ID NO:1578, CaF1_JIE_14_H_09 SEQ ID NO:1580, CaF1_JIE_15_A_10 SEQ ID NO:1590, CaF1_JIE_15_B_02 SEQ ID NO:1592, CaF1_JIE_15_B_05 SEQ ID NO:1594, CaF1_JIE_15_B_09 SEQ ID NO:1598, CaF1_JIE_15_B_10 SEQ ID NO:1599, CaF1_JIE_15_D_09 SEQ ID NO:1615, CaF1_JIE_15_G_02 SEQ ID NO:1632, CaF1_JIE_15_G_03 SEQ ID NO:1633, CaF1_JIE_15_G_08 SEQ ID NO:1637, CaF1_JIE_15_G_10 SEQ ID NO:1639, CaF1_JIE_15_H_01 SEQ ID NO:1641, CaF1_JIE_15_H_08 SEQ ID NO:1646, CaF1_JIE_16_B_05 SEQ ID NO:1660, CaF1_JIE_16_C_03 SEQ ID NO:1667, CaF1_JIE_16_C_04 SEQ ID NO:1668, CaF1_JIE_16_D_01 SEQ ID NO:1676, CaF1_JIE_16_D_11 SEQ ID NO:1682, CaF1_JIE_16_E_01 SEQ ID NO:1683, CaF1_JIE_16_F_08 SEQ ID NO:1698, CaF1_JIE_16_G_05 SEQ ID NO:1702, CaF1_JIE_16_H_06 SEQ ID NO:1711, CaF1_JIE_16_H_08 SEQ ID NO:1713, CaF1_JIE_16_H_11 SEQ ID NO:1715, CaF1_JIE_17_A_03 SEQ ID NO:1718, CaF1_JIE_17_A_04 SEQ ID NO:1719, CaF1_JIE_17_B_01 SEQ ID NO:1723, CaF1_JIE_17_D_03 SEQ ID NO:1738, CaF1_JIE_17_F_04 SEQ ID NO:1753, CaF1_JIE_17_G_04 SEQ ID NO:1760, CaF1_JIE_17_H_07 SEQ ID NO:1766, CaF1_JIE_17_H_09 SEQ ID NO:1767, CaF1_JIE_18_A_07 SEQ ID NO:1772, CaF1_JIE_18_C_02 SEQ ID NO:1784, CaF1_JIE_18_C_03 SEQ ID NO:1785, CaF1_JIE_18_C_04 SEQ ID NO:1786, CaF1_JIE_18_C_10 SEQ ID NO:1792, CaF1_JIE_18_F_01 SEQ ID NO:1811, CaF1_JIE_18_F_02 SEQ ID NO:1812, CaF1_JIE_18_F_08 SEQ ID NO:1817, CaF1_JIE_19_A_05 SEQ ID NO:1840, CaF1_JIE_19_D_01 SEQ ID NO:1862, CaF1_JIE_19_E_04 SEQ ID NO:1871, CaF1_JIE_19_E_06 SEQ ID NO:1872, CaF1_JIE_19_E_10 SEQ ID NO:1875, CaF1_JIE_19_F_03 SEQ ID NO:1879, CaF1_JIE_19_F_08 SEQ ID NO:1883, CaF1_JIE_19_F_11 SEQ ID NO:1886, CaF1_JIE_19_G_06 SEQ ID NO:1890, CaF1_JIE_19_H_05 SEQ ID NO:1899, CaF1_JIE_19_H_08 SEQ ID NO:1901, CaF1_JIE_19_H_09 SEQ ID NO:1902, CaF1_JIE_20_B_08 SEQ ID NO:1920, CaF1_JIE_20_D_06 SEQ ID NO:1939, CaF1_JIE_20_D_07 SEQ ID NO:1940, CaF1_JIE_20_E_03 SEQ ID NO:1947, CaF1_JIE_20_E_08 SEQ ID NO:1952, CaF1_JIE_20_E_10 SEQ ID NO:1954, CaF1_JIE_20_F_07 SEQ ID NO:1962, CaF1_JIE_20_G_09 SEQ ID NO:1973, CaF1_JIE_20_H_01 SEQ ID NO:1976, CaF1_JIE_21_A_02 SEQ ID NO:1988, CaF1_JIE_21_A_04 SEQ ID NO:1989, CaF1_JIE_21_A_10 SEQ ID NO:1995, CaF1_JIE_21_C_10 SEQ ID NO:2015, CaF1_JIE_21_G_03 SEQ ID NO:2044, CaF1_JIE_21_G_09 SEQ ID NO:2048, CaF1_JIE_21_H_03 SEQ ID NO:2052, CaF1_JIE_21_H_05 SEQ ID NO:2054, CaF1_JIE_22_A_05 SEQ ID NO:2065, CaF1_JIE_22_A_06 SEQ ID NO:2066, CaF1_JIE_22_A_07 SEQ ID NO:2067, CaF1_JIE_22_A_09 SEQ ID NO:2069, CaF1_JIE_22_B_04 SEQ ID

NO:2075, CaF1_JIE_22_B_05 SEQ ID NO:2076, CaF1_JIE_22_B_10 SEQ ID NO:2081, CaF1_JIE_22_D_01 SEQ ID NO:2090, CaF1_JIE_22_E_04 SEQ ID NO:2102, CaF1_JIE_22_E_09 SEQ ID NO:2106, CaF1_JIE_22_E_10 SEQ ID NO:2107, CaF1_JIE_22_G_01 SEQ ID NO:2120, CaF1_JIE_23_A_04 SEQ ID NO:2144, CaF1_JIE_23_A_07 SEQ ID NO:2147, CaF1_JIE_23_A_08 SEQ ID NO:2148, CaF1_JIE_23_D_10 SEQ ID NO:2178, CaF1_JIE_23_E_08 SEQ ID NO:2186, CaF1_JIE_23_F_10 SEQ ID NO:2198, CaF1_JIE_23_F_11 SEQ ID NO:2199, CaF1_JIE_23_G_04 SEQ ID NO:2203, CaF1_JIE_24_B_01 SEQ ID NO:2231, CaF1_JIE_24_D_03 SEQ ID NO:2250, CaF1_JIE_24_D_07 SEQ ID NO:2254, CaF1_JIE_24_E_07 SEQ ID NO:2262, CaF1_JIE_25_B_01 SEQ ID NO:2297, CaF1_JIE_25_B_05 SEQ ID NO:2301, CaF1_JIE_25_C_06 SEQ ID NO:2306, CaF1_JIE_25_D_05 SEQ ID NO:2312, CaF1_JIE_25_D_08 SEQ ID NO:2315, CaF1_JIE_25_F_07 SEQ ID NO:2329, CaF1_JIE_25_G_11 SEQ ID NO:2339, CaF1_JIE_26_A_01 SEQ ID NO:2347, CaF1_JIE_26_B_01 SEQ ID NO:2355, CaF1_JIE_26_B_02 SEQ ID NO:2356, CaF1_JIE_26_C_07 SEQ ID NO:2368, CaF1_JIE_26_C_11 SEQ ID NO:2371, CaF1_JIE_26_D_05 SEQ ID NO:2375, CaF1_JIE_26_E_01 SEQ ID NO:2381, CaF1_JIE_26_E_11 SEQ ID NO:2388, CaF1_JIE_26_F_01 SEQ ID NO:2389, CaF1_JIE_26_F_11 SEQ ID NO:2396, CaF1_JIE_26_G_07 SEQ ID NO:2399, CaF1_JIE_27_A_02 SEQ ID NO:2411, CaF1_JIE_27_A_04 SEQ ID NO:2413, CaF1_JIE_27_A_09 SEQ ID NO:2416, CaF1_JIE_27_A_10 SEQ ID NO:2417, CaF1_JIE_27_B_09 SEQ ID NO:2423, CaF1_JIE_27_C_06 SEQ ID NO:2429, CaF1_JIE_27_C_11 SEQ ID NO:2432, CaF1_JIE_27_D_02 SEQ ID NO:2434, CaF1_JIE_27_D_10 SEQ ID NO:2441, CaF1_JIE_27_F_05 SEQ ID NO:2452, CaF1_JIE_27_F_08 SEQ ID NO:2454, CaF1_JIE_27_F_09 SEQ ID NO:2455, CaF1_JIE_27_G_01 SEQ ID NO:2457, CaF1_JIE_28_A_08 SEQ ID NO:2472, CaF1_JIE_28_A_09 SEQ ID NO:2473, CaF1_JIE_28_A_10 SEQ ID NO:2474, CaF1_JIE_28_B_05 SEQ ID NO:2477, CaF1_JIE_28_B_09 SEQ ID NO:2479, CaF1_JIE_28_B_10 SEQ ID NO:2480, CaF1_JIE_28_C_06 SEQ ID NO:2484, CaF1_JIE_28_C_11 SEQ ID NO:2488, CaF1_JIE_28_D_10 SEQ ID NO:2495, CaF1_JIE_28_F_08 SEQ ID NO:2505, CaF1_JIE_28_F_09 SEQ ID NO:2506, CaF1_JIE_28_G_10 SEQ ID NO:2512, CaF1_JIE_28_H_08 SEQ ID NO:2517, CaF1_JIE_29_D_08 SEQ ID NO:2542, CaF1_JIE_29_D_10 SEQ ID NO:2544, CaF1_JIE_30_A_06 SEQ ID NO:2572, CaF1_JIE_30_D_08 SEQ ID NO:2589, CaF1_JIE_30_G_08 SEQ ID NO:2605, CaF1_JIE_30_H_01 SEQ ID NO:2608, CaF1_JIE_30_H_03 SEQ ID NO:2609, CaF1_JIE_30_H_04 SEQ ID NO:2610, CaF1_JIE_30_H_10 SEQ ID NO:2614, CaF1_JIE_31_A_04 SEQ ID NO:2618, CaF1_JIE_31_A_09 SEQ ID NO:2622, CaF1_JIE_31_A_10 SEQ ID NO:2623, CaF1_JIE_31_B_03 SEQ ID NO:2624, CaF1_JIE_31_B_11 SEQ ID NO:2630, CaF1_JIE_31_E_09 SEQ ID NO:2646, CaF1_JIE_31_E_10 SEQ ID NO:2647, CaF1_JIE_31_E_11 SEQ ID NO:2648, CaF1_JIE_31_F_08 SEQ ID NO:2655, CaF1_JIE_31_G_10 SEQ ID NO:2665, CaF1_JIE_32_C_04 SEQ ID NO:2688, CaF1_JIE_32_D_02 SEQ ID NO:2691, CaF1_JIE_32_D_06 SEQ ID NO:2694, CaF1_JIE_32_E_08 SEQ ID NO:2700, CaF1_JIE_32_H_11 SEQ ID NO:2720, CaF1_JIE_33_B_06 SEQ ID NO:2734, CaF1_JIE_33_B_07 SEQ ID NO:2735, CaF1_JIE_33_B_08 SEQ ID NO:2736, CaF1_JIE_33_B_10 SEQ ID NO:2738, CaF1_JIE_33_C_06 SEQ ID NO:2744, CaF1_JIE_33_C_07 SEQ ID NO:2745, CaF1_JIE_33_C_08 SEQ ID NO:2746, CaF1_JIE_33_E_04 SEQ ID NO:2757, CaF1_JIE_33_F_05 SEQ ID NO:2762, CaF1_JIE_34_C_10 SEQ ID NO:2801, CaF1_JIE_34_D_01 SEQ ID NO:2803, CaF1_JIE_34_F_05 SEQ ID NO:2819, CaF1_JIE_34_F_06 SEQ ID NO:2820, CaF1_JIE_34_H_01 SEQ ID NO:2828, CaF1_JIE_35_B_04 SEQ ID NO:2847, CaF1_JIE_35_B_07 SEQ ID NO:2850, CaF1_JIE_35_B_09 SEQ ID NO:2851, CaF1_JIE_35_B_10 SEQ ID NO:2852, CaF1_JIE_35_C_03 SEQ ID NO:2855, CaF1_JIE_35_C_06 SEQ ID NO:2858, CaF1_JIE_35_D_01 SEQ ID NO:2861, CaF1_JIE_35_G_02 SEQ ID NO:2880, CaF1_JIE_35_G_03 SEQ ID NO:2881, CaF1_JIE_35_G_04 SEQ ID NO:2882, CaF1_JIE_35_H_01 SEQ ID NO:2886, CaF1_JIE_35_H_04 SEQ ID NO:2888, CaF1_JIE_36_B_03 SEQ ID NO:2900, CaF1_JIE_36_B_07 SEQ ID NO:2903, CaF1_JIE_36_D_05 SEQ ID NO:2916, CaF1_JIE_36_D_07 SEQ ID NO:2918, CaF1_JIE_36_D_09 SEQ ID NO:2920, CaF1_JIE_36_F_08 SEQ ID NO:2933, CaF1_JIE_36_F_11 SEQ ID NO:2935, CaF1_JIE_37_A_04 SEQ ID NO:2949, CaF1_JIE_37_A_05 SEQ ID NO:2950, CaF1_JIE_37_A_08 SEQ ID NO:2953, CaF1_JIE_37_B_02 SEQ ID NO:2954, CaF1_JIE_37_C_04 SEQ ID NO:2960, CaF1_JIE_37_D_06 SEQ ID NO:2968, CaF1_JIE_37_F_09 SEQ ID NO:2980, CaF1_JIE_37_G_02 SEQ ID NO:2981, CaF1_JIE_37_L_G_11 SEQ ID NO:2989, CaF1_JIE_37_H_11 SEQ ID NO:2997, CaF1_JIE_38_A_09 SEQ ID NO:3003, CaF1_JIE_38_B_02 SEQ ID NO:3006, CaF1_JIE_38_B_05 SEQ ID NO:3009, CaF1_JIE_38_B_10 SEQ ID NO:3014, CaF1_JIE_38_F_06 SEQ ID NO:3038, CaF1_JIE_38_F_08 SEQ ID NO:3040, CaF1_JIE_38_F_09 SEQ ID NO:3041, CaF1_JIE_39_B_04 SEQ ID NO:3063, CaF1_JIE_39_C_03 SEQ ID NO:3070, CaF1_JIE_39_C_04 SEQ ID NO:3071, CaF1_JIE_39_E_03 SEQ ID NO:3085, CaF1_JIE_39_E_08 SEQ ID NO:3088, CaF1_JIE_39_F_06 SEQ ID NO:3094, CaF1_JIE_39_F_08 SEQ ID NO:3095, CaF1_JIE_39_H_04 SEQ ID NO:3108, CaF1_JIE_39_H_07 SEQ ID NO:3110, CaF1_JIE_40_C_10 SEQ ID NO:3137, CaF1_JIE_40_F_01 SEQ ID NO:3154, CaF1_JIE_40_G_07 SEQ ID NO:3166, CaF1_JIE_40_G_10 SEQ ID NO:3169, CaF1_JIE_40_H_03 SEQ ID NO:3173, CaF1_JIE_40_H_04 SEQ ID NO:3174, CaF1_JIE_41_B_02 SEQ ID NO:3187, CaF1_JIE_41_B_07 SEQ ID NO:3191, CaF1_JIE_41_B_10 SEQ ID NO:3193, CaF1_JIE_41_B_11 SEQ ID NO:3194, CaF1_JIE_41_E_01 SEQ ID NO:3211, CaF1_JIE_41_G_04 SEQ ID NO:3231, CaF1_JIE_41_H_10 SEQ ID NO:3242, CaF1_JIE_42_A_01 SEQ ID NO:3243, CaF1_JIE_42_C_04 SEQ ID NO:3254, CaF1_JIE_42_C_05 SEQ ID NO:3255, CaF1_JIE_01_A_01 SEQ ID NO:630, CaF1_WIE_01_A_10 SEQ ID NO:638, CaF1_JIE_01_A_11 SEQ ID NO:639, CaF1_WIE_01_C_11 SEQ ID NO:654, CaF1_WIE_01_E_08 SEQ ID NO:670, CaF1_WIE_01_G_05 SEQ ID NO:684, CaF1_WIE_01_G_06 SEQ ID NO:685, CaF1_WIE_01_G_10 SEQ ID NO:689, CaF1_WIE_01_H_10 SEQ ID NO:698, CaF1_WIE_02_A_02 SEQ ID NO:700, CaF1_WIE_02_C_02 SEQ ID NO:714, CaF1_WIE_02_C_06 SEQ ID NO:718, CaF1_WIE_02_D_06 SEQ ID NO:725, CaF1_WIE_02_E_06 SEQ ID NO:733, CaF1_WIE_02_F_02 SEQ ID NO:740, CaF1_WIE_02_F_03 SEQ ID NO:741, CaF1_WIE_

02_H_06 SEQ ID NO:758, CaF1_WIE_03_A_05 SEQ ID NO:766, CaF1_WIE_03_B_08 SEQ ID NO:772, CaF1_WIE_03_C_03 SEQ ID NO:777, CaF1_WIE_03_D_04 SEQ ID NO:785, CaF1_WIE_03_E_06 SEQ ID NO:794, CaF1_WIE_03_H_03 SEQ ID NO:812, CaF1_WIE_03_H_10 SEQ ID NO:815, CaF1_WIE_04_A_02 SEQ ID NO:818, CaF1_WIE_04_A_03 SEQ ID NO:819, CaF1_WIE_04_A_09 SEQ ID NO:823, CaF1_WIE_04_A_10 SEQ ID NO:824, CaF1_WIE_04_C_04 SEQ ID NO:838, CaF1_WIE_04_C_05 SEQ ID NO:839, CaF1_WIE_04_D_03 SEQ ID NO:845, CaF1_WIE_04_D_04 SEQ ID NO:846, CaF1_WIE_04_D_05 SEQ ID NO:847, CaF1_WIE_04_D_06 SEQ ID NO:848, CaF1_WIE_04_E_10 SEQ ID NO:852, CaF1_WIE_04_E_05 SEQ ID NO:856, CaF1_WIE_04_E_10 SEQ ID NO:861, CaF1_WIE_04_F_07 SEQ ID NO:868, CaF1_WIE_04_F_10 SEQ ID NO:870, CaF1_WIE_04_G_04 SEQ ID NO:873, CaF1_WIE_04_H_05 SEQ ID NO:883, CaF1_WIE_04_H_07 SEQ ID NO:885, CaF1_WIE_05_C_05 SEQ ID NO:907, CaF1_WIE_05_D_07 SEQ ID NO:917, CaF1_WIE_05_E_10 SEQ ID NO:930, CaF1_WIE_06_A_01 SEQ ID NO:957, CaF1_WIE_06_A_07 SEQ ID NO:962, CaF1_WIE_06_B_02 SEQ ID NO:966, CaF1_WIE_06_C_02 SEQ ID NO:973, CaF1_WIE_06_D_07 SEQ ID NO:983, CaF1_WIE_06_E_02 SEQ ID NO:988, CaF1_WIE_06_F_10 SEQ ID NO:1004, CaF1_WIE_06_G_09 SEQ ID NO:1011, CaF1_WIE_06_H_07 SEQ ID NO:1020, CaF1_WIE_06_H_10 SEQ ID NO:1023, CaF1_WIE_07_A_02 SEQ ID NO:1026, CaF1_WIE_07_B_02 SEQ ID NO:1035, CaF1_WIE_07_C_07 SEQ ID NO:1050, CaF1_JIE_07_C_11 SEQ ID NO:1053, CaF1_WIE_07_D_01 SEQ ID NO:1054, CaF1_WIE_07_D_03 SEQ ID NO:1055, CaF1_WIE_07_D_04 SEQ ID NO:1056, CaF1_WIE_07_D_08 SEQ ID NO:1060, CaF1_WIE_07_G_01 SEQ ID NO:1084, CaF1_WIE_07_G_05 SEQ ID NO:1088, CaF1_WIE_08_A_05 SEQ ID NO:1105, CaF1_WIE_08_A_06 SEQ ID NO:1106, CaF1_WIE_08_A_07 SEQ ID NO:1107, CaF1_WIE_08_B_03 SEQ ID NO:1110, CaF1_WIE_08_D_04 SEQ ID NO:1132, CaF1_WIE_08_E_05 SEQ ID NO:1141, CaF1_WIE_08_G_07 SEQ ID NO:1160, CaF1_WIE_09_A_06 SEQ ID NO:1177, CaF1_WIE_09_D_03 SEQ ID NO:1193, CaF1_WIE_09_E_06 SEQ ID NO:1203, CaF1_WIE_09_F_01 SEQ ID NO:1209, CaF1_WIE_09_G_09 SEQ ID NO:1224, CaF1_WIE_09_H_01 SEQ ID NO:1226, CaF1_WIE_09_H_05 SEQ ID NO:1228, CaF1_WIE_09_H_10 SEQ ID NO:1232, CaF1_WIE_10_A_09 SEQ ID NO:1241, CaF1_WIE_10_B_03 SEQ ID NO:1245, CaF1_WIE_10_13105 SEQ ID NO:1247, CaF1_WIE_10_B_06 SEQ ID NO:1248, CaF1_WIE_10_B_11 SEQ ID NO:1251, CaF1_WIE_10_C_06 SEQ ID NO:1256, CaF1_WIE_10_D_08 SEQ ID NO:1267, CaF1_WIE_10_D_11 SEQ ID NO:1270, CaF1_WIE_10_E_08 SEQ ID NO:3278, CaF1_WIE_10_F_02 SEQ ID NO:3281, CaF1_WIE_10_F_10 SEQ ID NO:3288, CaF1_WIE_10_G_11 SEQ ID NO:3297, CaF1_WIE_11_A_01 SEQ ID NO:3308, CaF1_WIE_11_A_10 SEQ ID NO:3315, CaF1_WIE_11_A_11 SEQ ID NO:3316, CaF1_WIE_11_C_01 SEQ ID NO:3326, CaF1_WIE_11_C_08 SEQ ID NO:3332, CaF1_WIE_11_D_01 SEQ ID NO:3335, CaF1_WIE_11_E_04 SEQ ID NO:3346, CaF1_WIE_11_F_05 SEQ ID NO:3353, CaF1_WIE_11_H_04 SEQ ID NO:3363, CaF1_WIE_11_G_05 SEQ ID NO:3364, CaF1_WIE_11_H_03 SEQ ID NO:3370, CaF1_WIE_11_H_06 SEQ ID NO:3372, CaF1_WIE_12_A_02 SEQ ID NO:3378, CaF1_WIE_12_C_06 SEQ ID NO:3399, CaF1_WIE_12_D_02 SEQ ID NO:3404, CaF1_WIE_12_D_03 SEQ ID NO:3405, CaF1_WIE_12_E_04 SEQ ID NO:3414, CaF1_WIE_12_F_01 SEQ ID NO:3421, CaF1_WIE_12_F_10 SEQ ID NO:3429, CaF1_WIE_12_G_05 SEQ ID NO:3435, CaF1_WIE_12_G_07 SEQ ID NO:3437, CaF1_WIE_12_H_07 SEQ ID NO:3447, CaF1_WIE_13_A_01 SEQ ID NO:3452, CaF1_WIE_13_A_02 SEQ ID NO:3453, CaF1_WIE_13_A_09 SEQ ID NO:3458, CaF1_WIE_13_C_02 SEQ ID NO:3470, CaF1_WIE_13_C_07 SEQ ID NO:3474, CaF1_WIE_13_D_01 SEQ ID NO:3479, CaF1_WIE_13_F_04 SEQ ID NO:3500, CaF1_WIE_13_F_05 SEQ ID NO:3501, CaF1_WIE_13_F_07 SEQ ID NO:3503, CaF1_WIE_13_G_01 SEQ ID NO:3506, CaF1_WIE_13_H_09 SEQ ID NO:3521, CaF1_WIE_14_A_11 SEQ ID NO:3526, CaF1_WIE_14_C_06 SEQ ID NO:3532, CaF1_WIE_14_D_02 SEQ ID NO:3537, CaF1_WIE_14_D_10 SEQ ID NO:3541, CaF1_WIE_14_E_03 SEQ ID NO:3543, CaF1_WIE_15_A_02 SEQ ID NO:3563, CaF1_WIE_15_A_04 SEQ ID NO:3564, CaF1_WIE_15_A_06 SEQ ID NO:3566, CaF1_WIE_15_B_05 SEQ ID NO:3572, CaF1_WIE_15_C_01 SEQ ID NO:3574, CaF1_WIE_15_C_02 SEQ ID NO:3575, CaF1_WIE_15_C_06 SEQ ID NO:3577, CaF1_WIE_15_C_08 SEQ ID NO:3578, CaF1_WIE_15_D_04 SEQ ID NO:3579, CaF1_WIE_15_E_01 SEQ ID NO:3582, CaF1_WIE_15_E_09 SEQ ID NO:3586, CaF1_WIE_15_F_07 SEQ ID NO:3589, CaF1_WIE_15_H_02 SEQ ID NO:3594, CaF1_WIE_16_A_08 SEQ ID NO:3601, CaF1_WIE_16_B_03 SEQ ID NO:3604, CaF1_WIE_16_B_09 SEQ ID NO:3609, CaF1_WIE_16_B_11 SEQ ID NO:3611, CaF1_WIE_16_C_03 SEQ ID NO:3612, CaF1_WIE_16_D_03 SEQ ID NO:3617, CaF1_WIE_16_D_11 SEQ ID NO:3619, CaF1_WIE_16_F_11 SEQ ID NO:3629, CaF1_WIE_16_G_04 SEQ ID NO:3632, CaF1_WIE_16_H_01 SEQ ID NO:3637, CaF1_WIE_16_H_04 SEQ ID NO:3638, CaF1_WIE_16_H_10 SEQ ID NO:3642, CaF1_WIE_17_A_09 SEQ ID NO:3652, CaF1_WIE_17_C_06 SEQ ID NO:3669, CaF1_WIE_17_C_07 SEQ ID NO:3670, CaF1_WIE_17_C_08 SEQ ID NO:3671, CaF1_WIE_17_C_11 SEQ ID NO:3674, CaF1_WIE_17_D_01 SEQ ID NO:3675, CaF1_WIE_17_D_09 SEQ ID NO:3681, CaF1_WIE_17_E_03 SEQ ID NO:3686, CaF1_WIE_17_E_05 SEQ ID NO:3688, CaF1_WIE_17_F_01 SEQ ID NO:3695, CaF1_WIE_17_F_03 SEQ ID NO:3697, CaF1_WIE_17_G_09 SEQ ID NO:3712, CaF1_WIE_17_H_02 SEQ ID NO:3716, CaF1_WIE_18_A_11 SEQ ID NO:3732, CaF1_WIE_18_B_01 SEQ ID NO:3733, CaF1_WIE_18_B_05 SEQ ID NO:3736, CaF1_WIE_18_C_03 SEQ ID NO:3743, CaF1_WIE_18_D_07 SEQ ID NO:3755, CaF1_WIE_18_E_11 SEQ ID NO:3769, CaF1_WIE_18_F_09 SEQ ID NO:3777, CaF1_WIE_18_F_11 SEQ ID NO:3779, CaF1_WIE_19_A_05 SEQ ID NO:3800, CaF1_WIE_19_A_10 SEQ ID NO:3804, CaF1_WIE_19_A_11 SEQ ID NO:3805, CaF1_WIE_19_B_02 SEQ ID NO:3807, CaF1_WIE_19_C_10 SEQ ID NO:3821, CaF1_WIE_19_E_05 SEQ ID NO:3831, CaF1_WIE_19_E_06 SEQ ID NO:3832, CaF1_WIE_19_F_07 SEQ ID NO:3842, CaF1_WIE_19_G_01 SEQ ID NO:3847, CaF1_WIE_19_H_10 SEQ ID NO:3860, CaF1_WIE_20_B_08 SEQ ID NO:3869, CaF1_WIE_20_D_05 SEQ ID NO:3879, CaF1_WIE_20_E_04 SEQ ID NO:3886, CaF1_WIE_20_E_07 SEQ ID NO:3889, CaF1_WIE_20_F_02 SEQ ID NO:3893, CaF1_WIE_20_G_02 SEQ ID NO:3900, CaF1_WIE_20_G_05 SEQ ID NO:3902, CaF1_WIE_21_A_04 SEQ ID NO:3918, CaF1_WIE_21_B_04 SEQ ID NO:3925,

CaF1_WIE_21_B_06 SEQ ID NO:3926, CaF1_WIE_21_B_09 SEQ ID NO:3928, CaF1_WIE_21_B_11 SEQ ID NO:3930, CaF1_WIE_21_D_04 SEQ ID NO:3941, CaF1_WIE_21_D_09 SEQ ID NO:3943, CaF1_WIE_21_E_07 SEQ ID NO:3949, CaF1_WIE_21_F_02 SEQ ID NO:3953, CaF1_WIE_21_F_03 SEQ ID NO:3954, CaF1_WIE_21_F_07 SEQ ID NO:3956, CaF1_WIE_21_G_02 SEQ ID NO:3961, CaF1_WIE_21_G_03 SEQ ID NO:3962, CaF1_WIE_21_G_04 SEQ ID NO:3963, CaF1_WIE_21_G_05 SEQ ID NO:3964, CaF1_WIE_21_G_09 SEQ ID NO:3967, CaF1_WIE_21_H_01 SEQ ID NO:3970, CaF1_WIE_21_H_02 SEQ ID NO:3971, CaF1_WIE_22_A_03 SEQ ID NO:3979, CaF1_WIE_22_A_08 SEQ ID NO:3982, CaF1_WIE_22_F_01 SEQ ID NO:4008, CaF1_WIE_22_G_06 SEQ ID NO:4017, CaF1_WIE_22_H_03 SEQ ID NO:4021, CaF1_WIE_22_H_10 SEQ ID NO:4028, CaF1_WIE_23_A_04 SEQ ID NO:4031, CaF1_WIE_23_B_05 SEQ ID NO:4038, CaF1_WIE_23_B_10 SEQ ID NO:4041, CaF1_WIE_23_D_07 SEQ ID NO:4049, CaF1_WIE_23_D_10 SEQ ID NO:4052, CaF1_WIE_23_F_09 SEQ ID NO:4067, CaF1_WIE_23_G_02 SEQ ID NO:4071, CaF1_WIE_23_H_01 SEQ ID NO:4080, CaF1_WIE_23_H_04 SEQ ID NO:4082, CaF1_WIE_23_H_07 SEQ ID NO:4084, CaF1_WIE_24_E_02 SEQ ID NO:4121, CaF1_WIE_24_F_01 SEQ ID NO:4128, CaF1_WIE_24_H_01 SEQ ID NO:4149, CaF1_WIE_24_H_04 SEQ ID NO:4152, CaF1_WIE_24_H_07 SEQ ID NO:4155, CaF1_WIE_24_H_08 SEQ ID NO:4156, CaF1_WIE_25_A_09 SEQ ID NO:4165, CaF1_WIE_25_A_10 SEQ ID NO:4166, CaF1_WIE_25_C_02 SEQ ID NO:4177, CaF1_WIE_25_C_05 SEQ ID NO:4179, CaF1_WIE_25_D_05 SEQ ID NO:4189, CaF1_WIE_25_D_08 SEQ ID NO:4192, CaF1_WIE_25_F_02 SEQ ID NO:4205, CaF1_WIE_25_F_08 SEQ ID NO:4207, CaF1_WIE_25_G_11 SEQ ID NO:4216, CaF1_WIE_26_A_10 SEQ ID NO:4231, CaF1_WIE_26_C_05 SEQ ID NO:4246, CaF1_WIE_26_C_08 SEQ ID NO:4249, CaF1_WIE_26_C_09 SEQ ID NO:4250, CaF1_WIE_26_D_01 SEQ ID NO:4252, CaF1_WIE_26_D_03 SEQ ID NO:4254, CaF1_WIE_26_D_06 SEQ ID NO:4256, CaF1_WIE_26_E_01 SEQ ID NO:4262, CaF1_WIE_26_E_02 SEQ ID NO:4263, CaF1_WIE_26_F_08 SEQ ID NO:4275, CaF1_WIE_26_G_01 SEQ ID NO:4277, CaF1_WIE_26_G_02 SEQ ID NO:4278, CaF1_WIE_26_G_10 SEQ ID NO:4286, CaF1_WIE_27_D_10 SEQ ID NO:4336, CaF1_WIE_27_E_01 SEQ ID NO:4338, CaF1_WIE_27_F_11 SEQ ID NO:4358, CaF1_WIE_27_G_08 SEQ ID NO:4366, CaF1_WIE_28_A_04 SEQ ID NO:4380, CaF1_WIE_28_A_07 SEQ ID NO:4383, CaF1_WIE_28_B_04 SEQ ID NO:4388, CaF1_WIE_28_C_01 SEQ ID NO:4393, CaF1_WIE_28_D_01 SEQ ID NO:4403, CaF1_WIE_28_E_06 SEQ ID NO:4416, CaF1_WIE_28_E_07 SEQ ID NO:4417, CaF1_WIE_28_E_08 SEQ ID NO:4418, CaF1_WIE_28_E_11 SEQ ID NO:4419, CaF1_WIE_28_G_03 SEQ ID NO:4428, CaF1_WIE_28_G_04 SEQ ID NO:4429, CaF1_WIE_28_G_08 SEQ ID NO:4433, CaF1_WIE_28_G_11 SEQ ID NO:4435, CaF1_WIE_28_H_06 SEQ ID NO:4440, CaF1_WIE_28_H_07 SEQ ID NO:4441, CaF1_WIE_29_A_05 SEQ ID NO:4449, CaF1_WIE_29_C_11 SEQ ID NO:4477, CaF1_WIE_29_D_06 SEQ ID NO:4483, CaF1_WIE_29_E_04 SEQ ID NO:4491, CaF1_WIE_29_F_07 SEQ ID NO:4505, CaF1_WIE_29_F_11 SEQ ID NO:4509, CaF1_WIE_29_G_04 SEQ ID NO:4513, CaF1_WIE_29_H_01 SEQ ID NO:4521, CaF1_WIE_29_H_03 SEQ ID NO:4523, CaF1_WIE_29_H_06 SEQ ID NO:4525, CaF1_WIE_29_H_08 SEQ ID NO:4527, CaF1_WIE_30_A_03 SEQ ID NO:4533, CaF1_WIE_30_A_06 SEQ ID NO:4534, CaF1_WIE_30_A_08 SEQ ID NO:4536, CaF1_WIE_30_C_03 SEQ ID NO:4549, CaF1_WIE_30_E_04 SEQ ID NO:4568, CaF1_WIE_30_E_05 SEQ ID NO:4569, CaF1_WIE_30_F_06 SEQ ID NO:4578, CaF1_WIE_30_G_03 SEQ ID NO:4586, CaF1_WIE_30_G_07 SEQ ID NO:4590, CaF1_WIE_30_G_09 SEQ ID NO:4592, CaF1_WIE_30_H_04 SEQ ID NO:4596, CaF1_WIE_31_A_05 SEQ ID NO:4605, CaF1_WIE_31_A_06 SEQ ID NO:4606, CaF1_WIE_31_B_02 SEQ ID NO:4612, CaF1_WIE_31_C_06 SEQ ID NO:4624, CaF1_WIE_31_D_01 SEQ ID NO:4628, CaF1_WIE_31_D_04 SEQ ID NO:4629, CaF1_WIE_31_D_05 SEQ ID NO:4630, CaF1_WIE_31_F_03 SEQ ID NO:4647, CaF1_WIE_31_F_08 SEQ ID NO:4651, CaF1_WIE_31_H_03 SEQ ID NO:4665, CaF1_WIE_31_H_04 SEQ ID NO:4666, CaF1_WIE_32_A_02 SEQ ID NO:4672, CaF1_WIE_32_A_03 SEQ ID NO:4673, CaF1_WIE_32_B_06 SEQ ID NO:4686, CaF1_WIE_32_C_01 SEQ ID NO:4692, CaF1_WIE_32_C_08 SEQ ID NO:4698, CaF1_WIE_32_F_10 SEQ ID NO:4722, CaF1_WIE_32_F_11 SEQ ID NO:4723, CaF1_WIE_32_G_03 SEQ ID NO:4726, CaF1_WIE_32_G_06 SEQ ID NO:4729, CaF1_WIE_32_H_02 SEQ ID NO:4736, CaF1_WIE_32_H_04 SEQ ID NO:4738, CaF1_WIE_33_A_05 SEQ ID NO:4749, CaF1_WIE_33_B_09 SEQ ID NO:4759, CaF1_WIE_33_C_02 SEQ ID NO:4761, CaF1_WIE_33_C_03 SEQ ID NO:4762, CaF1_WIE_33_C_04 SEQ ID NO:4763, CaF1_WIE_33_C_07 SEQ ID NO:4766, CaF1_WIE_33_D_06 SEQ ID NO:4772, CaF1_WIE_33_E_10 SEQ ID NO:4783, CaF1_WIE_33_F_02 SEQ ID NO:4786, CaF1_WIE_33_F_03 SEQ ID NO:4787, CaF1_WIE_33_F_10 SEQ ID NO:4793, CaF1_WIE_33_G_03 SEQ ID NO:4796, CaF1_WIE_33_H_09 SEQ ID NO:4809, CaF1_WIE_34_B_08 SEQ ID NO:4825, CaF1_WIE_34_C_04 SEQ ID NO:4830, CaF1_WIE_34_C_09 SEQ ID NO:4833, CaF1_WIE_34_D_08 SEQ ID NO:4843, CaF1_WIE_34_E_01 SEQ ID NO:4847, CaF1_WIE_34_F_01 SEQ ID NO:4853, CaF1_WIE_34_F_02 SEQ ID NO:4854, CaF1_WIE_34_F_06 SEQ ID NO:4857, CaF1_WIE_34_G_02 SEQ ID NO:4863, CaF1_WIE_34_G_08 SEQ ID NO:4867, CaF1_WIE_34_G_09 SEQ ID NO:4868, CaF1_WIE_34_H_03 SEQ ID NO:4871, CaF1_WIE_35_A_08 SEQ ID NO:4884, CaF1_WIE_35_A_09 SEQ ID NO:4885, CaF1_WIE_35_B_01 SEQ ID NO:4887, CaF1_WIE_35_B_02 SEQ ID NO:4888, CaF1_WIE_35_C_06 SEQ ID NO:4902, CaF1_WIE_35_E_11 SEQ ID NO:4926, CaF1_WIE_35_G_07 SEQ ID NO:4942, CaF1_WIE_35_G_08 SEQ ID NO:4943, CaF1_WIE_35_G_09 SEQ ID NO:4944, CaF1_WIE_36_A_01 SEQ ID NO:4955, CaF1_WIE_36_A_03 SEQ ID NO:4957, CaF1_WIE_36_D_11 SEQ ID NO:4987, CaF1_WIE_36_E_01 SEQ ID NO:4988, CaF1_WIE_36_H_01 SEQ ID NO:5011, CaF1_WIE_36_H_03 SEQ ID NO:5013, CaF1_WIE_37_A_02 SEQ ID NO:5023, CaF1_WIE_37_B_10 SEQ ID NO:5037, CaF1_WIE_37_C_07 SEQ ID NO:5039, CaF1_WIE_37_D_01 SEQ ID NO:5043, CaF1_WIE_37_E_07 SEQ ID NO:5054, CaF1_WIE_37_F_10 SEQ ID NO:5064, CaF1_WIE_37_F_11 SEQ ID NO:5065, CaF1_WIE_38_C_03 SEQ ID NO:5102, CaF1_WIE_38_F_07 SEQ ID NO:5126, CaF1_WIE_38_G_05 SEQ ID NO:5132, CaF1_WIE_38_H_01 SEQ ID NO:5137, CaF1_WIE_39_A_03 SEQ ID NO:5146, CaF1_WIE_39_C_09 SEQ ID NO:5168, CaF1_WIE_40_B_05 SEQ ID NO:5212, CaF1_WIE_40_B_08 SEQ ID NO:5214, CaF1_WIE_40_D_02 SEQ

ID NO:5226, CaF1_WIE_40_D_06 SEQ ID NO:5230, CaF1_WIE_40_D_07 SEQ ID NO:5231, CaF1_WIE_40_D_08 SEQ ID NO:5232, CaF1_WIE_40_D_11 SEQ ID NO:5235, CaF1_WIE_40_E_10 SEQ ID NO:5242, CaF1_WIE_40_H_01 SEQ ID NO:5263, CaF1_WIE_41_C_06 SEQ ID NO:5293, CaF1_WIE_41_D_04 SEQ ID NO:5299, CaF1_WIE_41_D_09 SEQ ID NO:5303, CaF1_WIE_41_F_01 SEQ ID NO:5314, CaF1_WIE_41_F_05 SEQ ID NO:5317, CaF1_WIE_41_H_05 SEQ ID NO:5334, CaF1_WIE_42_A_02 SEQ ID NO:5341, CaF1_WIE_42_A_07 SEQ ID NO:5345, CaF1_WIE_42_C_01 SEQ ID NO:5352, CaF1_WIE_42_C_04 SEQ ID NO:5354, CaF1_WIE_42_C_11 SEQ ID NO:5360, CaF1_WIE_42_E_02 SEQ ID NO:5367, CaF1_WIE_42_E_04 SEQ ID NO:5369, CaF1_WIE_42_G_02 SEQ ID NO:5380, CaF1_WIE_43_B_01 SEQ ID NO:5397, CaF1_WIE_43_B_02 SEQ ID NO:5398, CaF1_WIE_43_B_06 SEQ ID NO:5401, CaF1_WIE_43_C_10 SEQ ID NO:5409, CaF1_WIE_43_D_05 SEQ ID NO:5413, CaF1_WIE_43_D_09 SEQ ID NO:5416, CaF1_WIE_43_E_02 SEQ ID NO:5419, CaF1_WIE_43_E_05 SEQ ID NO:5421, CaF1_WIE_43_E_10 SEQ ID NO:5423, CaF1_WIE_43_H_02 SEQ ID NO:5439, CaF1_WIE_44_C_02 SEQ ID NO:5455, CaF1_WIE_44_D_02 SEQ ID NO:5465, CaF1_WIE_44_D_05 SEQ ID NO:5468, CaF1_WIE_44_F_03 SEQ ID NO:5482, CaF1_WIE_44_G_01 SEQ ID NO:5487, CaF1_WIE_44_G_11 SEQ ID NO:5493, CaF1_WIE_45_A_09 SEQ ID NO:5509, CaF1_WIE_45_B_02 SEQ ID NO:5512, CaF1_WIE_45_C_03 SEQ ID NO:5520, CaF1_WIE_45_C_09 SEQ ID NO:5523, CaF1_WIE_45_E_02 SEQ ID NO:5530, CaF1_WIE_45_E_05 SEQ ID NO:5532, CaF1_WIE_45_E_10 SEQ ID NO:5536, CaF1_WIE_45_G_03 SEQ ID NO:5545, CaF1_WIE_45_G_05 SEQ ID NO:5547, CaF1_WIE_45_G_06 SEQ ID NO:5548, CaF1_WIE_45_H_05 SEQ ID NO:5557, CaF1_WIE_45_H_09 SEQ ID NO:5561, CaF1_WIE_46_C_10 SEQ ID NO:5589, CaF1_WIE_46_D_10 SEQ ID NO:5597, CaF1_WIE_46_D_11 SEQ ID NO:5598, CaF1_WIE_46_F_09 SEQ ID NO:5615, CaF1_WIE_46_F_11 SEQ ID NO:5616, CaF1_WIE_46_H_10 SEQ ID NO:5632, CaF1_WIE_47_A_05 SEQ ID NO:5636, CaF1_WIE_47_A_10 SEQ ID NO:5641, CaF1_WIE_47_A_11 SEQ ID NO:5642, CaF1_WIE_47_B_04 SEQ ID NO:5645, CaF1_WIE_47_B_09 SEQ ID NO:5649, CaF1_WIE_47_F_01 SEQ ID NO:5680, CaF1_WIE_47_F_10 SEQ ID NO:5688, CaF1_WIE_47_G_01 SEQ ID NO:5690, CaF1_WIE_47_G_05 SEQ ID NO:5694, CaF1_WIE_48_A_10 SEQ ID NO:5715, CaF1_WIE_48_B_03 SEQ ID NO:5717, CaF1_WIE_48_C_04 SEQ ID NO:5726, CaF1_WIE_48_D_01 SEQ ID NO:5732, CaF1_WIE_48_D_02 SEQ ID NO:5733, CaF1_WIE_48_D_04 SEQ ID NO:5735, CaF1_WIE_48_E_01 SEQ ID NO:5740, CaF1_WIE_48_E_05 SEQ ID NO:5744, CaF1_WIE_48_F_02 SEQ ID NO:5751, CaF1_WIE_48_G_10 SEQ ID NO:5764, CaF1_WIE_49_A_10 SEQ ID NO:5782, CaF1_WIE_49_B_08 SEQ ID NO:5789, CaF1_WIE_49_C_05 SEQ ID NO:5796, CaF1_WIE_49_D_11 SEQ ID NO:5806, CaF1_WIE_49_E_11 SEQ ID NO:5813, CaF1_WIE_49_F_01 SEQ ID NO:5814, CaF1_WIE_49_F_04 SEQ ID NO:5816, CaF1_WIE_49_F_08 SEQ ID NO:5818, CaF1_WIE_50_B_10 SEQ ID NO:5847, CaF1_WIE_50_C_01 SEQ ID NO:5849, CaF1_WIE_50_C_09 SEQ ID NO:5854, CaF1_WIE_50_D_03 SEQ ID NO:5857, CaF1_WIE_50_D_11 SEQ ID NO:5864, CaF1_WIE_50_E_01 SEQ ID NO:5865, CaF1_WIE_50_E_10 SEQ ID NO:5872, CaF1_WIE_50_F_11 SEQ ID NO:5881, CaF1_WIE_50_G_05 SEQ ID NO:5883, CaF1_WIE_50_H_10 SEQ ID NO:5895, CaF1_WIE_51_A_04 SEQ ID NO:5898, CaF1_WIE_51_A_08 SEQ ID NO:5902, CaF1_WIE_51_B_04 SEQ ID NO:5908, CaF1_WIE_51_B_06 SEQ ID NO:5909, CaF1_WIE_51_B_07 SEQ ID NO:5910, CaF1_WIE_51_B_08 SEQ ID NO:5911, CaF1_WIE_51_B_10 SEQ ID NO:5912, CaF1_WIE_51_F_07 SEQ ID NO:5944, CaF1_WIE_51_G_04 SEQ ID NO:5948, CaF1_WIE_51_H_11 SEQ ID NO:5956, CaF1_WIE_52_A_05 SEQ ID NO:5960, CaF1_WIE_52_B_01 SEQ ID NO:5965, CaF1_WIE_52_C_07 SEQ ID NO:5981, CaF1_WIE_52_C_11 SEQ ID NO:5983, CaF1_WIE_52_D_01 SEQ ID NO:5984, CaF1_WIE_52_D_06 SEQ ID NO:5987, CaF1_WIE_52_E_06 SEQ ID NO:5996, CaF1_WIE_52_F_11 SEQ ID NO:6007, CaF1_WIE_52_G_01 SEQ ID NO:6008, CaF1_WIE_52_G_05 SEQ ID NO:6012, CaF1_WIE_52_H_01 SEQ ID NO:6018, CaF1_WIE_52_H_04 SEQ ID NO:6020, CaF1_WIE_52_H_05 SEQ ID NO:6021, CaF1_WIE_52_H_06 SEQ ID NO:6022, CaF1_WIE_52_H_07 SEQ ID NO:6023, CaF1_WIE_53_A_01 SEQ ID NO:6027, CaF1_WIE_53_A_09 SEQ ID NO:6033, CaF1_WIE_53_C_02 SEQ ID NO:6043, CaF1_WIE_53_C_03 SEQ ID NO:6044, CaF1_WIE_53_C_10 SEQ ID NO:6050, CaF1_WIE_53_F_01 SEQ ID NO:6065, CaF1_WIE_53_H_08 SEQ ID NO:6079, CaF1_WIE_54_A_05 SEQ ID NO:6085, CaF1_WIE_54_C_10 SEQ ID NO:6107, CaF1_WIE_54_D_02 SEQ ID NO:6110, CaF1_WIE_54_E_02 SEQ ID NO:6121, CaF1_WIE_54_E_04 SEQ ID NO:6123, CaF1_WIE_54_E_05 SEQ ID NO:6124, CaF1_WIE_54_G_01 SEQ ID NO:6139, CaF1_WIE_54_G_04 SEQ ID NO:6141, CaF1_WIE_54_H_10 SEQ ID NO:6152, CaF1_WIE_55_B_01 SEQ ID NO:6158, CaF1_WIE_55_C_04 SEQ ID NO:6168, CaF1_WIE_55_F_07 SEQ ID NO:6196, CaF1_WIE_55_G_03 SEQ ID NO:6201, CaF1_WIE_55_G_08 SEQ ID NO:6206, CaF1_WIE_55_G_09 SEQ ID NO:6207, CaF1_WIE_55_H_08 SEQ ID NO:6215, CaF1_WIE_55_H_09 SEQ ID NO:6216, CaF1_WIE_55_H_10 SEQ ID NO:6217, CaF1_WIE_56_B_08 SEQ ID NO:6230, CaF1_WIE_56_D_11 SEQ ID NO:6242, CaF1_WIE_56_E_05 SEQ ID NO:6245, CaF1_WIE_56_F_05 SEQ ID NO:6253, CaF1_WIE_56_F_07 SEQ ID NO:6255, CaF1_WIE_56_F_11 SEQ ID NO:6258, CaF1_WIE_56_G_06 SEQ ID NO:6261, CaF1_WIE_56_H_03 SEQ ID NO:6265, CaF1_WIE_56_H_04 SEQ ID NO:6266 and CaF1_WIE_56_H_06 SEQ ID NO:6268.

Genes Involved in Cellular Transport and Homeostasis

Stress-induced reorganization and spatial distribution of many key metabolites in plants require efficient transport machinery. It is well known that *Arabidopsis* has diverse array of genes for multi-efflux transport and response to stress signals, and rice has more secondary transporter genes for carbohydrate and nutrient transport (Nagata et al., 2008). Various transport associated genes were identified in this study. Of these, clathrin adaptor complexes and putative polyol transporter protein 4 were expressed in the susceptible genotype while multidrug resistance protein, Sec Y protein, ABC transporter family protein, Ctr copper transporter, SKS3 copper ion binding protein showed expression only in the resistant genotype. Although few of these transport associated proteins showed genotype specificity, others like general substrate transporter, intracellular chloride channel, phosphate transporter 5, were representative of both the genotypes. ABC transporters and multidrug resistance genes are known to function in plant defense, while the role of other above mentioned genes in plant defense is yet to be discovered. The chloride channel was reported to be activated by CDPK in guard cell whereas the chloride transporter has been found to be involved in hypo-osmotic turgor regulation. Further, polyol transporter was shown to be expressed during maturation of common plantain companion cells, though its role in plant defense remains to be ambiguous. These results suggest that transport of both organic and inorganic substances may play a crucial role in immune response.

Still another embodiment of the present invention provides ESTs derived from chickpea, wherein the ESTs are related to cellular Transport/inorganic ion transport and metabolism. These ESTs are CaF1_JIE_02_D_08 SEQ ID NO:104, CaF1_JIE_08_F_11 SEQ ID NO:575, CaF1_JIE_09_H_02 SEQ ID NO:1311, CaF1_JIE_11_B_07 SEQ ID NO:1371, CaF1_JIE_11_F_07 SEQ ID NO:1406, CaF1_JIE_13_A_04 SEQ ID NO:1479, CaF1_JIE_13_A_08 SEQ ID NO:1481, CaF1_JIE_13_H_01 SEQ ID NO:1515, CaF1_JIE_14_E_09 SEQ ID NO:1557, CaF1_JIE_15_G_09 SEQ ID NO:1638, CaF1_JIE_16_A_11 SEQ ID NO:1657, CaF1_JIE_17_F_07 SEQ ID NO:1755, CaF1_JIE_19_A_02 SEQ ID NO:1838, CaF1_JIE_24_F_11 SEQ ID NO:2274, CaF1_JIE_26_A_03 SEQ ID NO:2349, CaF1_JIE_26_D_04 SEQ ID NO:2374, CaF1_JIE_26_D_09 SEQ ID NO:2378, CaF1_JIE_26_F_04 SEQ ID NO:2391, CaF1_JIE_26_G_09 SEQ ID NO:2400, CaF1_JIE_27_C_09 SEQ ID NO:2431, CaF1_JIE_27_E_08 SEQ ID NO:2445, CaF1_JIE_28_C_09 SEQ ID NO:2486, CaF1_JIE_29_A_03 SEQ ID NO:2521, CaF1_JIE_31_B_07 SEQ ID NO:2627, CaF1_JIE_35_A_03 SEQ ID NO:2840, CaF1_JIE_36_B_04 SEQ ID NO:2901, CaF1_JIE_36_B_11 SEQ ID NO:2905, CaF1_JIE_36_H_10 SEQ ID NO:2946, CaF1_JIE_37_C_10 SEQ ID NO:2964, CaF1_JIE_38_E_05 SEQ ID NO:3031, CaF1_JIE_41_H_02 SEQ ID NO:3237, CaF1_WIE_02_H_09 SEQ ID NO:760, CaF1_WIE_03_D_08 SEQ ID NO:788, CaF1_WIE_05_E_06 SEQ ID NO:926, CaF1_WIE_06_E_03 SEQ ID NO:989, CaF1_WIE_08_C_09 SEQ ID NO:1127, CaF1_WIE_09_A_05 SEQ ID NO:1176, CaF1_WIE_09_H_11 SEQ ID NO:1233, CaF1_WIE_10_D_03 SEQ ID NO:1263, CaF1_WIE_15_B_01 SEQ ID NO:3569, CaF1_WIE_17_F_07 SEQ ID NO:3700, CaF1_WIE_17_F_10 SEQ ID NO:3703, CaF1_WIE_17_F_11 SEQ ID NO:3704, CaF1_WIE_18_C_02 SEQ ID NO:3742, CaF1_WIE_18_D_05 SEQ ID NO:3753, CaF1_WIE_19_A_07 SEQ ID NO:3801, CaF1_WIE_19_B_07 SEQ ID NO:3811, CaF1_WIE_19_F_05 SEQ ID NO:3840, CaF1_WIE_21_E_01 SEQ ID NO:3946, CaF1_WIE_21_E_08 SEQ ID NO:3950, CaF1_WIE_21_G_11 SEQ ID NO:3969, CaF1_WIE_22_F_07 SEQ ID NO:4012, CaF1_WIE_22_F_08 SEQ ID NO:4013, CaF1_WIE_23_F_07 SEQ ID NO:4065, CaF1_WIE_26_A_03 SEQ ID NO:4226, CaF1_WIE_26_B_05 SEQ ID NO:4236, CaF1_WIE_26_B_06 SEQ ID NO:4237, CaF1_WIE_26_D_04 SEQ ID NO:4255, CaF1_WIE_28_C_07 SEQ ID NO:4399, CaF1_WIE_28_D_07 SEQ ID NO:4408, CaF1_WIE_29_C_04 SEQ ID NO:4470, CaF1_WIE_29_C_07 SEQ ID NO:4473, CaF1_WIE_30_G_01 SEQ ID NO:4584, CaF1_WIE_32_A_04 SEQ ID NO:4674, CaF1_WIE_32_C_02 SEQ ID NO:4693, CaF1_WIE_32_G_09 SEQ ID NO:4732, CaF1_WIE_34_E_11 SEQ ID NO:4852, CaF1_WIE_35_C_01 SEQ ID NO:4897, CaF1_WIE_35_C_07 SEQ ID NO:4903, CaF1_WIE_35_D_03 SEQ ID NO:4909, CaF1_WIE_35_H_08 SEQ ID NO:4952, CaF1_WIE_37_A_11 SEQ ID NO:5029, CaF1_WIE_37_G_02 SEQ ID NO:5067, CaF1_WIE_37_H_02 SEQ ID NO:5075, CaF1_WIE_38_F_02 SEQ ID NO:5122, CaF1_WIE_38_F_08 SEQ ID NO:5127, CaF1_WIE_39_E_03 SEQ ID NO:5177, CaF1_WIE_40_E_04 SEQ ID NO:5237, CaF1_WIE_40_G_06 SEQ ID NO:5258, CaF1_WIE_42_D_03 SEQ ID NO:5363, CaF1_WIE_43_A_11 SEQ ID NO:5396, CaF1_WIE_45_A_04 SEQ ID NO:5504, CaF1_WIE_45_A_08 SEQ ID NO:5508, CaF1_WIE_46_F_05 SEQ ID NO:5611, CaF1_WIE_47_C_04 SEQ ID NO:5654, CaF1_WIE_47_D_07 SEQ ID NO:5665, CaF1_WIE_47_F_09 SEQ ID NO:5687, CaF1_WIE_47_G_10 SEQ ID NO:5699, CaF1_WIE_48_B_10 SEQ ID NO:5722, CaF1_WIE_48_F_05 SEQ ID NO:5754, CaF1_WIE_48_G_09 SEQ ID NO:5763, CaF1_WIE_50_B_01 SEQ ID NO:5838, CaF1_WIE_50_E_05 SEQ ID NO:5869, CaF1_WIE_51_C_05 SEQ ID NO:5918, CaF1_WIE_51_C_07 SEQ ID NO:5920, CaF1_WIE_51_D_04 SEQ ID NO:5927, CaF1_WIE_51_F_04 SEQ ID NO:5943, CaF1_WIE_51_G_10 SEQ ID NO:5950, CaF1_WIE_52_G_10 SEQ ID NO:6016, CaF1_WIE_53_F_04 SEQ ID NO:6068, CaF1_WIE_54_A_02 SEQ ID NO:6082, CaF1_WIE_55_G_02 SEQ ID NO:6200, CaF1_WIE_55_G_06 SEQ ID NO:6204, CaF1_WIE_56_B_11 SEQ ID NO:6232 and CaF1_WIE_56_G_07 SEQ ID NO:6262.

Genes Involved in Hormone Responses

Salicylic acid (SA), jasmonic acid (JA) and ethylene play key roles in developmental regulation and stress responses through cross communicating signal transduction pathways. These hormones accumulate in response to pathogen infection and in turn lead to the activation of distinct sets of defense related genes. We observed presence of ethylene signaling pathway genes, for example, ethylene responsive transcoactivator and putative ethylene response protein in the susceptible genotype while ethylene receptor was present only in the resistant genotype. Coronatine-insensitive 1 and BRU1 precursor which are associated with JA and brassinosteroid pathways respectively, were specific to the resistant genotype. In addition, we found auxin signaling related proteins, of which, auxin-responsive SAUR was found in both the genotypes but auxin-regulated dual specificity cytosolic kinase was present only in the resistant genotype. Aux/IAA protein, auxin-induced protein IAA12 and auxin-induced putative aldo/keto reductase family protein were found specifically in the susceptible genotype. Our future efforts would be the investigation of their possible role in plant immunity.

Still another embodiment of the present invention provides ESTs derived from chickpea, wherein the ESTs are related to Hormone responsive. These ESTs are CaF1_JIE_02_C_08 SEQ ID NO:94, CaF1_JIE_02_C_09 SEQ ID NO:95, CaF1_JIE_02_C_10 SEQ ID NO:96, CaF1_JIE_05_D_08 SEQ ID NO:326, CaF1_JIE_05_F_08 SEQ ID NO:348, CaF1_JIE_08_A_04 SEQ ID NO:518, CaF1_JIE_08_E_07 SEQ ID NO:562, CaF1_JIE_16_A_04 SEQ ID NO:1653, CaF1_JIE_16_B_08 SEQ ID NO:1662, CaF1_JIE_16_D_05 SEQ ID NO:1679, CaF1_JIE_16_H_07 SEQ ID NO:1712, CaF1_JIE_19_E_11 SEQ ID NO:1876, CaF1_JIE_19_F_07 SEQ ID NO:1882, CaF1_JIE_20_C_08 SEQ ID NO:1931, CaF1_JIE_21_E_09 SEQ ID NO:2033, CaF1_JIE_21_F_06 SEQ ID NO:2037, CaF1_JIE_21_F_07 SEQ ID NO:2038, CaF1_JIE_23_H_10 SEQ ID NO:2218, CaF1_JIE_24_E_05 SEQ ID NO:2260, CaF1_JIE_36_D_03 SEQ ID NO:2914, CaF1_JIE_36_H_03 SEQ ID NO:2941, CaF1_JIE_40_C_09 SEQ ID NO:3136, CaF1_JIE_41_C_11 SEQ ID NO:3200, CaF1_JIE_41_D_06 SEQ ID NO:3206, CaF1_WIE_05_A_10 SEQ ID NO:894, CaF1_WIE_06_F_05 SEQ ID NO:1000, CaF1_WIE_11_C_09 SEQ ID NO:3333, CaF1_WIE_11_G_03 SEQ ID NO:3362, CaF1_WIE_12_D_08 SEQ ID NO:3409, CaF1_WIE_16_B_08 SEQ ID NO:3608, CaF1_WIE_16_H_07 SEQ ID NO:3641, CaF1_WIE_20_H_03 SEQ ID NO:3908, CaF1_WIE_20_H_04 SEQ ID NO:3909, CaF1_WIE_23_G_03 SEQ ID NO:4072, CaF1_WIE_30_C_11 SEQ ID NO:4555, CaF1_WIE_44_D_01 SEQ ID NO:5464 and CaF1_WIE_55_E_01 SEQ ID NO:6182.

Genes Involved in Cell Cycle and DNA Metabolism

Cell division and cell cycle progression in plants is often altered in response to various environmental stresses. Many cell division and cell-cycle related proteins, for example, putative kinetochore, cell division protein FtsZ and cdc2MsF identified in this study were predominant in the resistant genotype suggesting pathostress responsive alterations of cell cycle in chickpea. Genes involved in DNA replication and repair like DNA repair protein RadA, putative polyprotein and putative gag-pol polyprotein were identified from susceptible genotype while putative helicase was common in both the genotypes. These findings are interesting because very little is known about the role of such genes in plant immune responses.

Still another embodiment of the present invention provides ESTs derived from chickpea, wherein the ESTs are related to cell cycle control and cell division. These ESTs are CaF1_JIE_04_F_11 SEQ ID NO: 269, CaF1_JIE_05_B_01 SEQ ID NO:299, CaF1_JIE_07_F_11 SEQ ID NO:493, CaF1_JIE_24_H_06 SEQ ID NO:2286, CaF1_JIE_24_H_07 SEQ ID NO:2287, CaF1_JIE_25_B_10 SEQ ID NO:2303, CaF1_JIE_36_E_10 SEQ ID NO:2927, CaF1_WIE_03_E_10 SEQ ID NO:797, CaF1_WIE_06_F_09 SEQ ID NO:1003, CaF1_WIE_07_B_01 SEQ ID NO:1034, CaF1_WIE_11_B_09 SEQ ID NO:3323, CaF1_WIE_17_F_08 SEQ ID NO:3701, CaF1_WIE_17_H_01 SEQ ID NO:3715, CaF1_WIE_19_E_10 SEQ ID NO:3835, CaF1_WIE_20_E_02 SEQ ID NO:3884, CaF1_WIE_25_B_10 SEQ ID NO:4176, CaF1_WIE_26_B_02 SEQ ID NO:4234, CaF1_WIE_28_B_06 SEQ ID NO:4390, CaF1_WIE_35_C_05 SEQ ID NO:4901, CaF1_WIE_40_A_08 SEQ ID NO:5205, CaF1_WIE_40_A_09 SEQ ID NO:5206, CaF1_WIE_42_H_02 SEQ ID NO:5384, CaF1_WIE_44_C_07 SEQ ID NO:5460, CaF1_WIE_45_A_10 SEQ ID NO:5510, CaF1_WIE_46_F_08 SEQ ID NO:5614, CaF1_WIE_48_E_11 SEQ ID NO:5749, CaF1_WIE_54_D_07 SEQ ID NO:6115, CaF1_WIE_54_E_01 SEQ ID NO:6120, CaF1_WIE_55_G_05 SEQ ID NO:6203 and CaF1_WIE_56_H_07 SEQ ID NO:6269.

Still another embodiment of the present invention provides ESTs derived from chickpea, wherein the ESTs are related to DNA replication, recombination and repair. These ESTs are CaF1_JIE_08_E_02 SEQ ID NO:557, CaF1_JIE_15_A_04 SEQ ID NO:1584, CaF1_JIE_15_B_04 SEQ ID NO:1593, CaF1_JIE_16_B_07 SEQ ID NO:1661, CaF1_JIE_27_G_08 SEQ ID NO:2461, CaF1_JIE_28_E_08 SEQ ID NO:2499, CaF1_JIE_39_C_02 SEQ ID NO:3069, CaF1_JIE_39_C_10 SEQ ID NO:3076, CaF1_JIE_39_D_02 SEQ ID NO:3078, CaF1_JIE_42_G_01 SEQ ID NO:3265 and CaF1_WIE_32_E_01 SEQ ID NO:4706.

Genes Involved in Development and Cytoskeletal Organization

The genes involved in development and cytoskeletal organization account for 1.24% of the total CaUnigene set. The candidate genes involved in development were those encoding enzymes associated with fruit ripening and senescence, and several storage proteins like albumin and agglutinin. Most of the genes in this class were identified in both the susceptible and resistant genotypes, however agglutinin was specific to the resistant one. While there have been reports on association of the processes of plant defense and senescence, the involvement of ripening related proteins has never been implicated in immune responses. Seed storage proteins like germin and albumin have been shown to be involved in stress responses, however, role of agglutinin in plant immunity is not known.

Cytoskeleton is thought to contribute to the establishment of effective barriers at the cell periphery against pathogen ingression. Substantiating this phenomenon, several structural proteins were identified that include actin, microtubule bundling polypeptide, and beta tubulin, besides genes associated with cytoskeletal reorganization like actin-depolymerizing factor and putative spindle disassembly related genes. Although actin was present in the genotypes, actin-depolymerizing factor and putative spindle disassembly related genes were specific to resistant genotype.

Still another embodiment of the present invention provides ESTs derived from chickpea, wherein the ESTs are related to Cytoskeleton. These ESTs are CaF1_JIE_09_A_04 SEQ ID NO:601, CaF1_JIE_09_H_01 SEQ ID NO:1310, CaF1_JIE_20_C_03 SEQ ID NO:1926, CaF1_JIE_40_B_07 SEQ ID NO:3125, CaF1_JIE_42_G_10 SEQ ID NO:3271, CaF1_WIE_01_C_03 SEQ ID NO:647, CaF1_WIE_05_H_02 SEQ ID NO:948, CaF1_WIE_16_A_11 SEQ ID NO:3603, CaF1_WIE_18_A_10 SEQ ID NO:3731, CaF1_WIE_25_G_08 SEQ ID NO:4214, CaF1_WIE_26_B_11 SEQ ID NO:4241, CaF1_WIE_26_G_08 SEQ ID NO:4284, CaF1_WIE_37_E_06 SEQ ID NO:5053, CaF1_WIE_40_D_04 SEQ ID NO:5228, CaF1_WIE_41_B_01 SEQ ID NO:5281, CaF1_WIE_41_E_04 SEQ ID NO:5309, CaF1_WIE_42_C_07 SEQ ID NO:5357, CaF1_WIE_43_B_03 SEQ ID NO:5399, CaF1_WIE_43_C_03 SEQ ID NO:5406, CaF1_WIE_46_D_04 SEQ ID NO:5593, CaF1_WIE_48_E_08 SEQ ID NO:5746, CaF1_WIE_48_E_09 SEQ ID NO:5747, CaF1_WIE_48_G_05 SEQ ID NO:5761, CaF1_WIE_48_H_08 SEQ ID NO:5771, CaF1_WIE_52_G_03 SEQ ID NO:6010, CaF1_WIE_53_E_05 SEQ ID NO:6061 and CaF1_WIE_53_E_09 SEQ ID NO:6063

Still another embodiment of the present invention provides ESTs derived from chickpea, wherein the ESTs are related to development/storage/dormancy and senescence. These ESTs are CaF1_JIE_06_E_08 SEQ ID NO:408, CaF1_JIE_19_C_08 SEQ ID NO:1858, CaF1_JIE_19_C_09 SEQ ID NO:1859, CaF1_JIE_22_B SEQ ID NO:2077, CaF1_JIE_22_B_07 SEQ ID NO:2078, CaF1_JIE_22_F_09 SEQ ID NO:2117, CaF1_JIE_23_E_06 SEQ ID NO:2184, CaF1_JIE_25_A_02 SEQ ID NO:2291, CaF1_JIE_25_C_03 SEQ ID NO:2305, CaF1_JIE_27_G_02 SEQ ID NO:2458, CaF1_JIE_35_B_02 SEQ ID NO:2845, CaF1_JIE_40_F_02 SEQ ID NO:3155, CaF1_JIE_42_A_04 SEQ ID NO:3245, CaF1_WIE_01_E_09 SEQ ID NO:671, CaF1_WIE_02_A_05 SEQ ID NO:702, CaF1_WIE_02_C_05 SEQ ID NO:717, CaF1_WIE_03_E_09 SEQ ID NO:796, CaF1_WIE_04_B_11 SEQ ID NO:835, CaF1_WIE_04_D_09 SEQ ID NO:850, CaF1_WIE_04_H_01 SEQ ID NO:879, CaF1_WIE_06_E_08 SEQ ID NO:993, CaF1_WIE_07_B_03 SEQ ID NO:1036, CaF1_WIE_07_H_06 SEQ ID NO:1098, CaF1_WIE_07_H_09 SEQ ID NO:1100, CaF1_WIE_09_B_09 SEQ ID NO:1185, CaF1_WIE_09_B_10 SEQ ID NO:1186, CaF1_WIE_09_E_07 SEQ ID NO:1204, CaF1_WIE_09_E_10 SEQ ID NO:1207, CaF1_WIE_09_F_02 SEQ ID NO:1210, CaF1_WIE_11_B_01 SEQ ID NO:3317, CaF1_WIE_11_E_01 SEQ ID NO:3344, CaF1_WIE_12_B_02 SEQ ID NO:3385, CaF1_WIE_12_B_04 SEQ ID NO:3387, CaF1_WIE_12_F_11 SEQ ID NO:3430, CaF1_WIE_12_G_01 SEQ ID NO:3431, CaF1_WIE_12_G_11 SEQ ID NO:3441, CaF1_WIE_13_C_03 SEQ ID NO:3471, CaF1_WIE_13_C_09 SEQ ID NO:3476, CaF1_WIE_13_E_07 SEQ ID NO:3492, CaF1_WIE_13_E_09 SEQ ID NO:3494, CaF1_WIE_13_G_04 SEQ ID NO:3508, CaF1_WIE_14_G_11 SEQ ID NO:3557, CaF1_WIE_16_G_01 SEQ ID NO:3630, CaF1_WIE_17_B_04 SEQ ID NO:3658, CaF1_WIE_17_G_02 SEQ ID NO:3706, CaF1_WIE_17_G_03 SEQ ID NO:3707, CaF1_WIE_17_G_07 SEQ ID NO:3710, CaF1_WIE_17_G_11 SEQ ID NO:3714, CaF1_WIE_17_H_03 SEQ ID NO:3717, CaF1_WIE_18_A_05 SEQ ID NO:3726, CaF1_WIE_18_E_01 SEQ ID NO:3760, CaF1_WIE_18_E_06 SEQ ID NO:3764, CaF1_WIE_18_H_04 SEQ ID NO:3792, CaF1_WIE_18_H_10 SEQ ID NO:3795, CaF1_WIE_19_H_05 SEQ ID NO:3856, CaF1_WIE_19_H_06 SEQ ID NO:3857, CaF1_WIE_20_A_08 SEQ ID NO:3866, CaF1_WIE_20_C_04 SEQ ID NO:3873, CaF1_WIE_20_C_05 SEQ ID NO:3874, CaF1_WIE_20_D_03 SEQ ID NO:3877, CaF1_WIE_20_D_04 SEQ ID NO:3878, CaF1_WIE_20_E_05 SEQ ID NO:3887, CaF1_WIE_20_F_03 SEQ ID NO:3894, CaF1_WIE_21_B_03 SEQ ID NO:3924, CaF1_WIE_21_C_11 SEQ ID NO:3938, CaF1_WIE_23_A_09 SEQ ID NO:4034, CaF1_WIE_23_C_11 SEQ ID NO:4047, CaF1_WIE_23_F_04 SEQ ID NO:4063, CaF1_WIE_23_F_08 SEQ ID NO:4066, CaF1_WIE_24_A_08 SEQ ID NO:4093, CaF1_WIE_24_B_02 SEQ ID NO:4097, CaF1_WIE_24_C_03 SEQ ID NO:4106, CaF1_WIE_24_F_10 SEQ ID NO:4137, CaF1_WIE_25_A_11 SEQ ID NO:4167, CaF1_WIE_25_B_01 SEQ ID NO:4168, CaF1_WIE_25_C_03 SEQ ID NO:4178, CaF1_WIE_26_C_03 SEQ ID NO:4244, CaF1_WIE_27_A_02 SEQ ID NO:4300, CaF1_WIE_27_G_02 SEQ ID NO:4360, CaF1_WIE_28_B_05 SEQ ID NO:4389, CaF1_WIE_28_H_10 SEQ ID NO:4444, CaF1_WIE_29_A_01 SEQ ID NO:4445, CaF1_WIE_29_A_08 SEQ ID NO:4452, CaF1_WIE_29_G_03 SEQ ID NO:4512, CaF1_WIE_30_F_08 SEQ ID NO:4580, CaF1_WIE_31_B_10 SEQ ID NO:4618, CaF1_WIE_31_H_05 SEQ ID NO:4667, CaF1_WIE_32_B_08 SEQ ID NO:4688, CaF1_WIE_32_H_07 SEQ ID NO:4741, CaF1_WIE_33_C_05 SEQ ID NO:4764, CaF1_WIE_33_D_05 SEQ ID NO:4771, CaF1_WIE_33_E_11 SEQ ID NO:4784, CaF1_WIE_33_F_01 SEQ ID NO:4785, CaF1_WIE_34_A_09 SEQ ID NO:4817, CaF1_WIE_34_H_01 SEQ ID NO:4869, CaF1_WIE_35_B_09 SEQ ID NO:4895, CaF1_WIE_35_D_06 SEQ ID NO:4912, CaF1_WIE_35_E_01 SEQ ID NO:4917, CaF1_WIE_35_E_05 SEQ ID NO:4920, CaF1_WIE_35_G_03 SEQ ID NO:4938, CaF1_WIE_35_H_05 SEQ ID NO:4950, CaF1_WIE_36_D_09 SEQ ID NO:4985, CaF1_WIE_36_G_11 SEQ ID NO:5010, CaF1_WIE_37_B_04 SEQ ID NO:5032, CaF1_WIE_37_C_11 SEQ ID NO:5042, CaF1_WIE_37_D_03 SEQ ID NO:5045, CaF1_WIE_37_D_04 SEQ ID NO:5046, CaF1_WIE_38_B_04 SEQ ID NO:5095, CaF1_WIE_38_G_08 SEQ ID NO:5133, CaF1_WIE_39_C_03 SEQ ID NO:5162, CaF1_WIE_39_C_04 SEQ ID NO:5163, CaF1_WIE_39_G_11 SEQ ID NO:5190, CaF1_WIE_40_A_10 SEQ ID NO:5207, CaF1_WIE_40_C_04 SEQ ID NO:5220, CaF1_WIE_40_F_06 SEQ ID NO:5248, CaF1_WIE_41_C_09 SEQ ID NO:5296, CaF1_WIE_41_G_10 SEQ ID NO:5328, CaF1_WIE_41_G_11 SEQ ID NO:5329, CaF1_WIE_42_A_03 SEQ ID NO:5342, CaF1_WIE_42_B_03 SEQ ID NO:5348, CaF1_WIE_43_A_04 SEQ ID NO:5391, CaF1_WIE_43_D_06 SEQ ID NO:5414, CaF1_WIE_43_D_08 SEQ ID NO:5415, CaF1_WIE_44_A_07 SEQ ID NO:5446, CaF1_WIE_44_A_08 SEQ ID NO:5447, CaF1_WIE_44_D_04 SEQ ID NO:5467, CaF1_WIE_44_F_09 SEQ ID NO:5485, CaF1_WIE_45_D_03 SEQ ID NO:5525, CaF1_WIE_45_H_11 SEQ ID NO:5563, CaF1_WIE_46_G_04 SEQ ID NO:5618, CaF1_WIE_46_H_06 SEQ ID NO:5629, CaF1_WIE_47_H_08 SEQ ID NO:5707, CaF1_WIE_50_C_11 SEQ ID NO:5855, CaF1_WIE_50_F_10 SEQ ID NO:5880, CaF1_WIE_51_B_11 SEQ ID NO:5913, CaF1_WIE_51_C_03 SEQ ID NO:5916, CaF1_WIE_51_E_06 SEQ ID NO:5936, CaF1_WIE_51_E_08 SEQ ID NO:5938, CaF1_WIE_52_C_01 SEQ ID NO:5976, CaF1_WIE_52_C_02 SEQ ID NO:5977, CaF1_WIE_52_E_02 SEQ ID NO:5993, CaF1_WIE_53_B_07 SEQ ID NO:6039, CaF1_WIE_53_C_07 SEQ ID NO:6047, CaF1_WIE_53_E_03 SEQ ID NO:6060, CaF1_WIE_54_A_06 SEQ ID NO:6086, CaF1_WIE_54_D_06 SEQ ID NO:6114, CaF1_WIE_55_A_08 SEQ ID NO:6157, CaF1_WIE_55_C_09 SEQ ID NO:6173, CaF1_WIE_55_F_09 SEQ ID NO:6197 and CaF1_WIE_56_E_09 SEQ ID NO:6249.

Genes Involved in Cellular Redox and Energy Metabolism

The oxidative burst is one of the earliest cellular responses following successful pathogen recognition. Several enzymes involved in oxidative burst were identified in both susceptible and resistant genotypes that include peroxidase, superoxide dismutase, glutathione-S-transferase and quinone oxidoreductase. Apoplastic generation of superoxide or its dismutation product, hydrogen peroxide, has been shown in response to a variety of pathogens. These enzymes restrict the ROS-dependent damage and may lead to the activation of plant immune response.

Energy production has an impact on the overall metabolic state and the energy supply is the key factor for the maintenance of cell intactness under various stress conditions. We observed the presence of genes encoding different proteins involved in ATP biosynthesis like alternative NAD(P)H dehydrogenase and putative ADP, ATP carrier-like protein in susceptible genotype. However, alternative oxidase 2b and NADH dehydrogenase were identified in the resistant genotype only. Nevertheless, vacuolar H+-ATPase subunit A and ATP synthase beta subunit were common to both genotypes. While the involvement of these proteins in abiotic stress, energy conservation and maintenance of redox potential is well established, their exact role in plant immune response is yet to be elucidated.

Still another embodiment of the present invention provides ESTs derived from chickpea, wherein the ESTs are related to cellular redox state. These ESTs are CaF1_JIE_01_A_09 SEQ ID NO:7, CaF1_JIE_03_B_03 SEQ ID NO:151, CaF1_JIE_03_D_04 SEQ ID NO:167, CaF1_JIE_03_E_09 SEQ ID NO:180, CaF1_JIE_03_G_05 SEQ ID NO:196, CaF1_JIE_04_A_05 SEQ ID NO:213, CaF1_JIE_04_D_05 SEQ ID NO:244, CaF1_JIE_05_C_05 SEQ ID NO:313, CaF1_JIE_07_G_05 SEQ ID NO:498, CaF1_JIE_07_G_10 SEQ ID NO:503, CaF1_JIE_07_H_05 SEQ ID NO:509, CaF1_JIE_10_C_03 SEQ ID NO:1334, CaF1_JIE_10_G_03 SEQ ID NO:1346, CaF1_JIE_10_H_08 SEQ ID NO:1358, CaF1_JIE_11_B_10 SEQ ID NO:1374, CaF1_JIE_11_F_03 SEQ ID NO:1402, CaF1_JIE_15_A_05 SEQ ID NO:1585, CaF1_JIE_15_D_04 SEQ ID NO:1611, CaF1_JIE_15_E_10 SEQ ID NO:1624, CaF1_JIE_15_F_09 SEQ ID NO:1630, CaF1_JIE_16_B_11 SEQ ID NO:1665, CaF1_JIE_16_C_09 SEQ ID NO:1673, CaF1_JIE_16_E_10 SEQ ID NO:1690, CaF1_JIE_17_B_06 SEQ ID NO:1724, CaF1_JIE_17_D_09 SEQ ID NO:1742, CaF1_JIE_20_A_09 SEQ ID NO:1911, CaF1_JIE_20_G_05 SEQ ID NO:1969, CaF1_JIE_23_C_09 SEQ ID NO:2169, CaF1_JIE_23_H_07 SEQ ID NO:2216, CaF1_JIE_23_H_08 SEQ ID NO:2217, CaF1_JIE_24_A_09 SEQ ID NO:2228, CaF1_JIE_24_D_02 SEQ ID NO:2249, CaF1_JIE_24_F_04 SEQ ID NO:2269, CaF1_JIE_24_F_05 SEQ ID NO:2270, CaF1_JIE_25_A_06 SEQ ID NO:2294, CaF1_JIE_26_A_02 SEQ ID NO:2348, CaF1_JIE_26_B_10 SEQ ID NO:2361, CaF1_JIE_26_C_02 SEQ ID NO:2364, CaF1_JIE_26_F_06 SEQ ID NO:2392, CaF1_JIE_26_F_09 SEQ ID NO:2394, CaF1_JIE_27_H_07 SEQ ID NO:2465, CaF1_JIE_27_H_10 SEQ ID NO:2468, CaF1_JIE_28_B_04 SEQ ID NO:2476, CaF1_JIE_28_E_11 SEQ ID NO:2502, CaF1_JIE_28_H_06 SEQ ID NO:2515, CaF1_JIE_28_H_07 SEQ ID NO:2516, CaF1_JIE_28_H_10 SEQ ID NO:2519, CaF1_JIE_29_B_03 SEQ ID NO:2527, CaF1_JIE_29_C_09 SEQ ID NO:2537, CaF1_JIE_29_C_10 SEQ ID NO:2538, CaF1_JIE_31_G_02 SEQ ID NO:2659, CaF1_JIE_34_E_09 SEQ ID NO:2815, CaF1_JIE_34_E_10 SEQ ID NO:2816, CaF1_JIE_36_G_02 SEQ ID NO:2937, CaF1_JIE_36_H_06 SEQ ID NO:2943, CaF1_JIE_36_H_09 SEQ ID NO:2945, CaF1_JIE_37_C_07 SEQ ID NO:2962, CaF1_JIE_37_F_04 SEQ ID NO:2977, CaF1_JIE_37_G_07 SEQ ID NO:2985, CaF1_JIE_38_A_08 SEQ ID NO:3002, CaF1_JIE_38_B_04 SEQ ID NO:3008, CaF1_JIE_39_A_10 SEQ ID NO:3061, CaF1_JIE_40_B_05 SEQ ID NO:3124, CaF1_JIE_40_E_05 SEQ ID NO:3150, CaF1_JIE_41_A_05 SEQ ID NO:3183, CaF1_JIE_41_E_03 SEQ ID NO:3212, CaF1_WIE_01_D_05 SEQ ID NO:658, CaF1_WIE_01_D_11 SEQ ID NO:664, CaF1_WIE_01_F_05 SEQ ID NO:676, CaF1_WIE_02_A_08 SEQ ID NO:704, CaF1_WIE_02_A_09 SEQ ID NO:705, CaF1_WIE_02_F_07 SEQ ID NO:744, CaF1_WIE_02_08 SEQ ID NO:759, CaF1_WIE_03_D_09 SEQ ID NO:789, CaF1_WIE_03_F_01 SEQ ID NO:799, CaF1_WIE_04_C_09 SEQ ID NO:843, CaF1_WIE_04_E_06 SEQ ID NO:857, CaF1_WIE_04_G_05 SEQ ID NO:874, CaF1_WIE_05_B_09 SEQ ID NO:902, CaF1_WIE_05_E_09 SEQ ID NO:929, CaF1_WIE_06_D_10 SEQ ID NO:985, CaF1_WIE_06_E_10 SEQ ID NO:995, CaF1_WIE_06_H_02 SEQ ID NO:1015, CaF1_WIE_07_D_07 SEQ ID NO:1059, CaF1_WIE_08_B_02 SEQ ID NO:1109, CaF1_WIE_08_E_03 SEQ ID NO:1140, CaF1_WIE_09_E_04 SEQ ID NO:1201, CaF1_WIE_10_H_02 SEQ ID NO:3298, CaF1_WIE_11_C_02 SEQ ID NO:3327, CaF1_WIE_12_A_07 SEQ ID NO:3381, CaF1_WIE_12_F_06 SEQ ID NO:3425, CaF1_WIE_13_A_10 SEQ ID NO:3459, CaF1_WIE_13_C_01 SEQ ID NO:3469, CaF1_WIE_13_H_05 SEQ ID NO:3518, CaF1_WIE_15_A_08 SEQ ID NO:3567, CaF1_WIE_15_B_03 SEQ ID NO:3571, CaF1_WIE_15_D_05 SEQ ID NO:3580, CaF1_WIE_17_A_11 SEQ ID NO:3654, CaF1_WIE_17_B_01 SEQ ID NO:3655, CaF1_WIE_17_E_02 SEQ ID NO:3685, CaF1_WIE_17_G_04 SEQ ID NO:3708, CaF1_WIE_17_H_05 SEQ ID NO:3718, CaF1_WIE_18_B_08 SEQ ID NO:3738, CaF1_WIE_18_B_09 SEQ ID NO:3739, CaF1_WIE_18_D_06 SEQ ID NO:3754, CaF1_WIE_18_G_07 SEQ ID NO:3785, CaF1_WIE_19_E_01 SEQ ID NO:3829, CaF1_WIE_19_E_08 SEQ ID NO:3834, CaF1_WIE_21_H_10 SEQ ID NO:3976, CaF1_WIE_22_C_04 SEQ ID NO:3994, CaF1_WIE_22_H_08 SEQ ID NO:4026, CaF1_WIE_23_G_04 SEQ ID NO:4073, CaF1_WIE_24_D_04 SEQ ID NO:4115, CaF1_WIE_24_D_07 SEQ ID NO:4118, CaF1_WIE_24_E_05 SEQ ID NO:4123, CaF1_WIE_26_A_06 SEQ ID NO:4228, CaF1_WIE_26_H_11 SEQ ID NO:4298, CaF1_WIE_27_C_07 SEQ ID NO:4325, CaF1_WIE_27_C_08 SEQ ID NO:4326, CaF1_WIE_27_D_08 SEQ ID NO:4334, CaF1_WIE_28_A_10 SEQ ID NO:4386, CaF1_WIE_28_F_11 SEQ ID NO:4425, CaF1_WIE_29_A_07 SEQ ID NO:4451, CaF1_WIE_29_C_01 SEQ ID NO:4467, CaF1_WIE_30_A_02 SEQ ID NO:4532, CaF1_WIE_30_B_01 SEQ ID NO:4539, CaF1_WIE_30_B_09 SEQ ID NO:4545, CaF1_WIE_30_F_11 SEQ ID NO:4583, CaF1_WIE_31_B_04 SEQ ID NO:4613, CaF1_WIE_31_B_05 SEQ ID NO:4614, CaF1_WIE_31_G_08 SEQ ID NO:4660, CaF1_WIE_32_F_09 SEQ ID NO:4721, CaF1_WIE_32_H_05 SEQ ID NO:4739, CaF1_WIE_32_H_10 SEQ ID NO:4744, CaF1_WIE_33_A_01 SEQ ID NO:4746, CaF1_WIE_33_E_02 SEQ ID NO:4777, CaF1_WIE_33_H_06 SEQ ID NO:4808, CaF1_WIE_34_A_10 SEQ ID NO:4818, CaF1_WIE_34_B_04 SEQ ID NO:4821, CaF1_WIE_34_C_11 SEQ ID NO:4835, CaF1_WIE_34_H_05 SEQ ID NO:4873, CaF1_WIE_35_E_10 SEQ ID NO:4925, CaF1_WIE_36_H_10 SEQ ID NO:5020, CaF1_WIE_37_C_04 SEQ ID NO:5038, CaF1_WIE_37_C_09 SEQ ID NO:5040, CaF1_WIE_37_G_07 SEQ ID NO:5069, CaF1_WIE_38_A_02 SEQ ID NO:5084, CaF1_WIE_38_A_03 SEQ ID NO:5085, CaF1_WIE_38_A_04 SEQ ID NO:5086, CaF1_WIE_38_B_01 SEQ ID NO:5093, CaF1_WIE_38_B_02 SEQ ID NO:5094, CaF1_WIE_38_C_01 SEQ ID NO:5100, CaF1_WIE_38_C_02 SEQ ID NO:5101, CaF1_WIE_38_C_04 SEQ ID NO:5103, CaF1_WIE_38_D_01 SEQ ID NO:5110, CaF1_WIE_38_D_06 SEQ ID NO:5111, CaF1_WIE_38_E_01 SEQ ID NO:5116, CaF1_WIE_38_E_09 SEQ ID NO:5121, CaF1_WIE_38_F_03 SEQ ID NO:5123, CaF1_WIE_38_F_06 SEQ ID NO:5125, CaF1_WIE_38_G_09 SEQ ID NO:5134, CaF1_WIE_39_A_06 SEQ ID NO:5148, CaF1_WIE_39_A_07 SEQ ID NO:5149, CaF1_WIE_39_B_05 SEQ ID NO:5155, CaF1_WIE_39_B_06 SEQ ID NO:5156, CaF1_WIE_39_B_07 SEQ ID NO:5157, CaF1_WIE_39_C_06 SEQ ID NO:5165, CaF1_WIE_39_C_07 SEQ ID NO:5166, CaF1_WIE_39_D_04 SEQ ID NO:5171, CaF1_WIE_39_D_07 SEQ ID NO:5173, CaF1_WIE_39_E_06 SEQ ID NO:5178, CaF1_WIE_39_F_07 SEQ ID NO:5180, CaF1_WIE_41_A_10 SEQ ID NO:5279, CaF1_WIE_41_F_03 SEQ ID NO:5315, CaF1_WIE_41_G_07 SEQ ID NO:5326, CaF1_WIE_43_E_11 SEQ ID NO:5424, CaF1_WIE_43_F_04 SEQ ID NO:5428, CaF1_WIE_45_F_09 SEQ ID NO:5544, CaF1_WIE_46_D_01 SEQ ID NO:5590, CaF1_WIE_47_B_08 SEQ ID NO:5648, CaF1_WIE_47_F_11 SEQ ID NO:5689, CaF1_WIE_47_G_09 SEQ ID NO:5698, CaF1_WIE_48_B_01 SEQ ID NO:5716, CaF1_WIE_48_B_09 SEQ ID NO:5721, CaF1_WIE_48_C_02 SEQ ID NO:5725, CaF1_WIE_49_C_10 SEQ ID NO:5799, CaF1_WIE_49_E_10 SEQ ID NO:5812, CaF1_WIE_49_G_07 SEQ ID NO:5823, CaF1_WIE_50_B_08 SEQ ID NO:5845, CaF1_WIE_50_H_05 SEQ ID NO:5892, CaF1_WIE_52_A_10 SEQ ID NO:5963, CaF1_WIE_53_B_03 SEQ ID NO:6036, CaF1_WIE_54_C_05 SEQ ID NO:6103, CaF1_WIE_54_C_06 SEQ ID NO:6104, CaF1_WIE_54_E_07 SEQ ID NO:6126, CaF1_WIE_54_E_08 SEQ ID NO:6127, CaF1_WIE_54_F_01 SEQ ID NO:6130, CaF1_WIE_56_A_03 SEQ ID NO:6220, SEQ ID NO:6243 and CaF1_WIE_56_H_09 SEQ ID NO:6270.

Still another embodiment of the present invention provides ESTs derived from chickpea, wherein the ESTs are related to Energy production and conversion. These ESTs are CaF1_JIE_02_F_02 SEQ ID NO:116, CaF1_JIE_02_G_08 SEQ ID NO:130, CaF1_JIE_04_B_07 SEQ ID NO:226, CaF1_JIE_07_E_03 SEQ ID NO:477, CaF1_JIE_08_C_09 SEQ ID NO:543, CaF1_JIE_09_B_04 SEQ ID NO:611, CaF1_JIE_09_D_01 SEQ ID NO:627, CaF1_JIE_12_H_05 SEQ ID NO:1473, CaF1_JIE_13_A_05 SEQ ID NO:1480, CaF1_JIE_13_B_05 SEQ ID NO:1484, CaF1_JIE_16_G_11 SEQ ID NO:1707, CaF1_JIE_18_G_08 SEQ ID NO:1826, CaF1_JIE_18_H_04 SEQ ID NO:1832, CaF1_JIE_20_B_03 SEQ ID NO:1915, CaF1_JIE_24_D_06 SEQ ID NO:2253, CaF1_JIE_24_F_03 SEQ ID NO:2268, CaF1_JIE_26_C_09 SEQ ID NO:2369, CaF1_JIE_32_D_10 SEQ ID NO:2697, CaF1_JIE_32_H_06 SEQ ID NO:2719, CaF1_JIE_33_E_02 SEQ ID NO:2755, CaF1_JIE_33_G_04 SEQ ID NO:2768, CaF1_JIE_33_H_10 SEQ ID NO:2779, CaF1_JIE_34_A_04 SEQ ID NO:2783, CaF1_JIE_35_B_05 SEQ ID NO:2848, CaF1_JIE_36_F_03 SEQ ID NO:2930, CaF1_JIE_38_F_02 SEQ ID NO:3036, CaF1_JIE_39_D_08 SEQ ID NO:3081, CaF1_JIE_41_E_11 SEQ ID NO:3219, CaF1_WIE_01_A_04 SEQ ID NO:632, CaF1_WIE_02_C_07 SEQ ID NO:719, CaF1_WIE_02_E_01 SEQ ID NO:728, CaF1_WIE_02_E_07 SEQ ID NO:734, CaF1_WIE_03_B_07 SEQ ID NO:771, CaF1_WIE_03_D_02 SEQ ID NO:784, CaF1_WIE_05_C_06 SEQ ID NO:908, CaF1_WIE_06_G_06 SEQ ID NO:1009, CaF1_WIE_08_B_09 SEQ ID NO:1116, CaF1_WIE_08_D_02 SEQ ID NO:1130, CaF1_WIE_09_G_11 SEQ ID NO:1225, CaF1_WIE_10_A_05 SEQ ID NO:1238, CaF1_WIE_20_A_09 SEQ ID NO:3867, CaF1_WIE_20_F_09 SEQ ID NO:3898, CaF1_WIE_20_G_03 SEQ ID NO:3901, CaF1_WIE_22_C_11 SEQ ID NO:3998, CaF1_WIE_22_F_05 SEQ ID NO:4010, CaF11_WIE_23_C_04 SEQ ID NO:4043, CaF1_WIE_26_A_04 SEQ ID NO:4227, CaF1_WIE_27_A_10 SEQ ID NO:4308, CaF1_WIE_27_C_03 SEQ ID NO:4322, CaF1_WIE_27_H_05 SEQ ID NO:4373, CaF1_WIE_28_A_08 SEQ ID NO:4384, CaF1_WIE_28_D_06 SEQ ID NO:4407, CaF1_WIE_29_E_07 SEQ ID NO:4494, CaF1_WIE_30_C_10 SEQ ID NO:4554, CaF1_WIE_31_G_07 SEQ ID NO:4659, CaF1_WIE_35_F_01 SEQ ID NO:4927, CaF1_WIE_36_A_04 SEQ ID NO:4958, CaF1_WIE_36_A_10 SEQ ID NO:4963, CaF1_WIE_36_F_04 SEQ ID NO:4997, CaF1_WIE_36_G_07 SEQ ID NO:5007, CaF1_WIE_39_A_08 SEQ ID NO:5150, CaF1_WIE_43_D_03 SEQ ID NO:5412, CaF1_WIE_46_A_03 SEQ ID NO:5565, CaF1_WIE_46_E_11 SEQ ID NO:5607, CaF1_WIE_47_B_02 SEQ ID NO:5643, CaF1_WIE_47_E_03 SEQ ID NO:5672, CaF1_WIE_49_E_02 SEQ ID NO:5808, CaF1_WIE_52_B_02 SEQ ID NO:5966, CaF1_WIE_53_E_02 SEQ ID NO:6059 and CaF1_WIE_54_B_05 SEQ ID NO:6093

Genes Involved in Secondary Metabolism

Most secondary metabolites of phenyl propanoid pathway, including lignins, isoflavonoid-phytoalexins and other phenolic compounds are instrumental in plant's ability to enforce successful defenses against invading pathogens. In this study, several genes were identified that are associated with biosynthesis of secondary metabolites. The important enzymes in this category include phenyl ammonia lyase (PAL), chalcone synthase, chalcone isomerase, and chalcone-flavonone isomerase-1 which were found in both compatible and incompatible interactions. These enzymes are known to modulate plant defense response against invading pathogens and insects. Some of the secondary metabolism related genes, for example, squalene epoxidase was found to be specific to susceptible genotype whereas pterocarpan reductase and oxysterol-binding family protein were specific to the resistant one. Other members of this class are caffeic acid O-methyltransferase II, isoflavone 3'-hydroxylase, squalene monooxygenase 2, trans-cinnamate 4-monooxygenase and dihydroflavonol reductase. Earlier studies have shown that transgenic rice plants overexpressing dihydroflavonol reductase can provide tolerance to biotic and abiotic stresses. Caffeic acid O-methyltransferase catalyzes a key step in lignin biosynthesis, thereby giving protection against pathogen attack Still another embodiment of the present invention provides ESTs derived from chickpea, wherein the ESTs are related to secondary metabolism. These ESTs are CaF1_JIE_02_G_09 SEQ ID NO:131, CaF1_JIE_02_H_11 SEQ ID NO:142, CaF1_JIE_03_F_02 SEQ ID NO:184, CaF1_JIE_04_A_02 SEQ ID NO:211, CaF1_JIE_04_D_09 SEQ ID NO:247, CaF1_JIE_07_D_08 SEQ ID NO:472, CaF1_JIE_07_H_08 SEQ ID NO:512, CaF1_JIE_08_A_05 SEQ ID NO:519, CaF1_JIE_08_C_04 SEQ ID NO:538, CaF1_JIE_08_E_03 SEQ ID NO:558, CaF1_JIE_08_H_03 SEQ ID NO:589, CaF1_JIE_09_A_06 SEQ ID NO:603, CaF1_JIE_09_B_01 SEQ ID NO:608, CaF1_JIE_14_D_02 SEQ ID NO:1545, CaF1_JIE_16_E_04 SEQ ID NO:1685, CaF1_JIE_17_A_09 SEQ ID NO:1722, CaF1_JIE_18_H_07 SEQ ID NO:1833, CaF1_JIE_21_C_08 SEQ ID NO:2013, CaF1_JIE_21_E_02 SEQ ID NO:2027, CaF1_JIE_22_D_03 SEQ ID NO:2092, CaF1_JIE_22_G_07 SEQ ID NO:2126, CaF1_JIE_22_H_05 SEQ ID NO:2134, CaF1_JIE_24_C_03 SEQ ID NO:2242, CaF1_JIE_24_E_06 SEQ ID NO:2261, CaF1_JIE_27_13_02 SEQ ID NO:2419, CaF1_JIE_27_C_08 SEQ ID NO:2430, CaF1_JIE_28_C_08 SEQ ID NO:2485, CaF1_JIE_28_D_04 SEQ ID NO:2490, CaF1_JIE_30_C_11 SEQ ID NO:2585, CaF1_JIE_32_B_08 SEQ ID NO:2683, CaF1_JIE_32_G_04 SEQ ID NO:2711, CaF1_JIE_34_A_01 SEQ ID NO:2781, CaF1_JIE_34_C_09 SEQ ID NO:2800, CaF1_JIE_35_A_02 SEQ ID NO:2839, CaF1_JIE_35_D_11 SEQ ID NO:2869, CaF1_JIE_37_E_02 SEQ ID NO:2971, CaF1_JIE_37_E_07 SEQ ID NO:2974, CaF1_JIE_37_F_08 SEQ ID NO:2979, CaF1_JIE_37_G_08 SEQ ID NO:2986, CaF1_JIE_37_H_04 SEQ ID NO:2991, CaF1_JIE_37_H_09 SEQ ID NO:2996, CaF1_JIE_38_C_11 SEQ ID NO:3019, CaF1_JIE_39_B_02 SEQ ID NO:3062, CaF1_JIE_39_B_06 SEQ ID NO:3065, CaF1_JIE_39_C_05 SEQ ID NO:3072, CaF1_JIE_39_E_02 SEQ ID NO:3084, CaF1_JIE_42_B_01 SEQ ID NO:3249, CaF1_JIE_42_G_06 SEQ ID NO:3268, CaF1_JIE_42_G_07 SEQ ID NO:3269, CaF1_JIE_42_G_09 SEQ ID NO:3270, CaF1_WIE_01_D_10 SEQ ID NO:663, CaF1_WIE_01_G_11 SEQ ID NO:690, CaF1_WIE_01_H_05 SEQ ID NO:694, CaF1_WIE_01_H_11 SEQ ID NO:699, CaF1_WIE_02_G_06 SEQ ID NO:749, CaF1_WIE_03_B_01 SEQ ID NO:770, CaF1_WIE_05_A_02 SEQ ID NO:888, CaF1_WIE_05_C_08 SEQ ID NO:910, CaF1_WIE_05_E_08 SEQ ID NO:928, CaF1_WIE_06_C_11 SEQ ID NO:979, CaF1_WIE_06_D_03 SEQ ID NO:981, CaF1_WIE_06_E_01 SEQ ID NO:987, CaF1_WIE_07_G_08 SEQ ID NO:1090, CaF1_WIE_08_C_02 SEQ ID NO:1120, CaF1_WIE_08_C_04 SEQ ID NO:1122, CaF1_WIE_08_D_01 SEQ ID NO:1129, CaF1_WIE_08_G_09 SEQ ID NO:1162, CaF1_WIE_09_B_02 SEQ ID NO:1183, CaF1_WIE_10_B_09 SEQ ID NO:1250, CaF1_WIE_10_E_03 SEQ ID NO:3273, CaF1_WIE_12_A_01 SEQ ID NO:3377, CaF1_WIE_13_F_01 SEQ ID NO:3497, CaF1_WIE_13_G_06 SEQ ID NO:3510, CaF1_WIE_14_F_06 SEQ ID NO:3548, CaF1_WIE_15_E_06 SEQ ID NO:3584, CaF1_WIE_15_E_07 SEQ ID NO:3585, CaF1_WIE_17_C_04 SEQ ID NO:3667, CaF1_WIE_17_C_05 SEQ ID NO:3668, CaF1_WIE_19_D_02 SEQ ID NO:3824, CaF1_WIE_23_E_04 SEQ ID NO:4056, CaF1_WIE_24_A_03 SEQ ID NO:4088, CaF1_WIE_24_C_05 SEQ ID NO:4108, CaF1_WIE_24_C_10 SEQ ID NO:4111, CaF1_WIE_24_G_11 SEQ ID NO:4148, CaF1_WIE_27_B_04 SEQ ID NO:4312, CaF1_WIE_27_C_04 SEQ ID NO:4323, CaF1_WIE_27_D_09 SEQ ID NO:4335, CaF1_WIE_28_D_04 SEQ ID NO:4405, CaF1_WIE_28_F_03 SEQ ID NO:4421, CaF1_WIE_28_G_06 SEQ ID NO:4431, CaF1_WIE_29_A_06 SEQ ID NO:4450, CaF1_WIE_29_B_10 SEQ ID NO:4465, CaF1_WIE_30_B_11 SEQ ID NO:4547, CaF1_WIE_30_E_01 SEQ ID NO:4566, CaF1_WIE_31_E_04 SEQ ID NO:4639, CaF1_WIE_31_F_07 SEQ ID NO:4650, CaF1_WIE_32_A_06 SEQ ID NO:4676, CaF1_WIE_33_A_10 SEQ ID NO:4752, CaF1_WIE_34_F_07 SEQ ID NO:4858, CaF1_WIE_35_E_09 SEQ ID NO:4924, CaF1_WIE_37_A_07 SEQ ID NO:5025, CaF1_WIE_37_E_03 SEQ ID NO:5050, CaF1_WIE_40_A_11 SEQ ID NO:5208, CaF1_WIE_40_F_05 SEQ ID NO:5247, CaF1_WIE_42_H_03 SEQ ID NO:5385, CaF1_WIE_43_D_11 SEQ ID NO:5418, CaF1_WIE_47_A_09 SEQ ID NO:5640, CaF1_WIE_48_B_07 SEQ ID NO:5720, CaF1_WIE_50_A_10 SEQ ID NO:5837, CaF1_WIE_51_D_05 SEQ ID NO:5928, CaF1_WIE_51_E_01 SEQ ID NO:5933, CaF1_WIE_51_G_01 SEQ ID NO:5947, CaF1_WIE_52_D_05 SEQ ID NO:5986, CaF1_WIE_52_E_09 SEQ ID NO:5998, CaF1_WIE_53_B_09 SEQ ID NO:6041, CaF1_WIE_53_C_04 SEQ ID NO:6045, CaF1_WIE_53_C_08 SEQ ID NO:6048 and CaF1_WIE_54_H_05 SEQ ID NO:6149.

Defense and Stress Responsive Genes

Pathogen attack is often accompanied by the accumulation of elevated levels of transcripts of disease related proteins, the PR genes. The ESTs encoding proteins implicated in stress and defense responses account for 3.18% of the total unigene set. Most dominant candidates among the defense responsive genes were disease resistance response protein DRRG49C and PR10. Other genes identified include those encoding chitinase, non-specific lipid transfer proteins, thaumatin and pathogenesis-related protein. The involvement of these proteins in plant defense responses is well known. One of the important observations was that DRRG49C, thaumatin and pathogenesis-related protein were expressed only during incompatible interaction which may lead to increased tolerance to pathogen attack. Also, we found the presence of ESTs encoding proteins like dirigent and harpin-induced 1 in the resistant genotype, implying their role in pathostress response. Dirigent protein has recently been shown to be involved in lignification and hence imparting disease resistance. Many other stress induced proteins, for example, extension, universal stress proteins, aquaporin, annexin, cold acclimation responsive protein BudCAR4 and metallothionien were also identified as more abundant in the resistant genotype implicating their involvement in pathostress response besides their key role in abiotic and other stresses.

Still another embodiment of the present invention provides ESTs derived from chickpea, wherein the ESTs are related to defense mechanism. These ESTs are CaF1_JIE_04_E_08 SEQ ID NO:255, CaF1_JIE_04_H_01 SEQ ID NO:280, CaF1_JIE_07_G_06 SEQ ID NO:499, CaF1_JIE_08_B_06 SEQ ID NO:530, CaF1_JIE_08_E_06 SEQ ID NO:561, CaF1_JIE_10_B_06 SEQ ID NO:1328, CaF1_JIE_11_A_03 SEQ ID NO:1362, CaF1_JIE_11_F_04 SEQ ID NO:1403, CaF1_JIE_13_F_10 SEQ ID NO:1507, CaF1_JIE_13_G_07 SEQ ID NO:1511, CaF1_JIE_13_G_08 SEQ ID NO:1512, CaF1_JIE_14_B_03 SEQ ID NO:1529, CaF1_JIE_14_F_01 SEQ ID NO:1559, CaF1_JIE_15_D_02 SEQ ID NO:1609, CaF1_JIE_20_A_02 SEQ ID NO:1905, CaF1_JIE_21_A_06 SEQ ID NO:1991, CaF1_JIE_21_D_04 SEQ ID NO:2020, CaF1_JIE_22_A_08 SEQ ID NO:2068, CaF1_JIE_22_B_09 SEQ ID NO:2080, CaF1_JIE_22_C_05 SEQ ID NO:2084, CaF1_JIE_24_E_09 SEQ ID NO:2264, CaF1_JIE_25_A_11 SEQ ID NO:2296, CaF1_JIE_25_13_07 SEQ ID NO:2302, CaF1_JIE_25_D_06 SEQ ID NO:2313, CaF1_JIE_25_D_07 SEQ ID NO:2314, CaF1_JIE_27_A_06 SEQ ID NO:2415, CaF1_JIE_27_B_11 SEQ ID NO:2424, CaF1_JIE_27_C_01 SEQ ID NO:2425, CaF1_JIE_35_C_10 SEQ ID NO:2859, CaF1_JIE_38_B_11 SEQ ID NO:3015, CaF1_JIE_42_A_11 SEQ ID NO:3248, CaF1_JIE_42_G_02 SEQ ID NO:3266, CaF1_WIE_01_A_02 SEQ ID NO:631, CaF1_WIE_C_08 SEQ ID NO:652, CaF1_WIE_01_F_11 SEQ ID NO:680, CaF1_WIE_02_B_07 SEQ ID NO:711, CaF1_WIE_02_F_09 SEQ ID NO:746, CaF1_WIE_04_B_01 SEQ ID NO:826, CaF1_WIE_04_B_10 SEQ ID NO:834, CaF1_WIE_04_D_02 SEQ ID NO:844, CaF1_WIE_04_D_08 SEQ ID NO:849, CaF1_WIE_04_H_02 SEQ ID NO:880, CaF1_WIE_05_D_03 SEQ ID NO:914, CaF1_WIE_05_D_09 SEQ ID NO:919, CaF1_WIE_05_E_07 SEQ ID NO:927, CaF1_WIE_05_F_03 SEQ ID NO:933, CaF1_WIE_05_G_08 SEQ ID NO:945, CaF1_WIE_05_G_09 SEQ ID NO:946, CaF1_WIE_05_H_11 SEQ ID NO:956, CaF1_WIE_06_C_03 SEQ ID NO:974, CaF1_WIE_06_C_09 SEQ ID NO:978, CaF1_WIE_06_D_08 SEQ ID NO:984, CaF1_WIE_06_F_02 SEQ ID NO:998, CaF1_WIE_08_D_09 SEQ ID NO:1137, CaF1_WIE_08_G_06 SEQ ID NO:1159, CaF1_WIE_09_D_09 SEQ ID NO:1196, CaF1_WIE_09_F_05 SEQ ID NO:1213, CaF1_WIE_10_A_10 SEQ ID NO:1242, CaF1_WIE_10_B_04 SEQ ID NO:1246, CaF1_WIE_10_E_07 SEQ ID NO:3277, CaF1_WIE_10_F_09 SEQ ID NO:3287, CaF1_WIE_10_G_07 SEQ ID NO:3294, CaF1_WIE_11_B_04 SEQ ID NO:3319, CaF1_WIE_11_D_02 SEQ ID NO:3336, CaF1_WIE_11_D_03 SEQ ID NO:3337, CaF1_WIE_11_G_08 SEQ ID NO:3365, CaF1_WIE_13_E_03 SEQ ID NO:3489, CaF1_WIE_14_D_07 SEQ ID NO:3538, CaF1_WIE_14_D_08 SEQ ID NO:3539, CaF1_WIE_14_H_01 SEQ ID NO:3558, CaF1_WIE_15_E_05 SEQ ID NO:3583, CaF1_WIE_17_E_10 SEQ ID NO:3693, CaF1_WIE_17_G_01 SEQ ID NO:3705, CaF1_WIE_18_A_03 SEQ ID NO:3724, CaF1_WIE_18_C_11 SEQ ID NO:3750, CaF1_WIE_18_E_04 SEQ ID NO:3762, CaF1_WIE_18_G_11 SEQ ID NO:3788, CaF1_WIE_19_A_09 SEQ ID NO:3803, CaF1_WIE_19_C_05 SEQ ID NO:3817, CaF1_WIE_19_C_06 SEQ ID NO:3818, CaF1_WIE_19_C_07 SEQ ID NO:3819, CaF1_WIE_19_F_06 SEQ ID NO:3841, CaF1_WIE_21_G_10 SEQ ID NO:3968, CaF1_WIE_22_B_02 SEQ ID NO:3985, CaF1_WIE_22_B_06 SEQ ID NO:3986, CaF1_WIE_22_C_01 SEQ ID NO:3991, CaF1_WIE_22_C_05 SEQ ID NO:3995, CaF1_WIE_22_E_10 SEQ ID NO:4007, CaF1_WIE_23_C_05 SEQ ID NO:4044, CaF1_WIE_23_E_02 SEQ ID NO:4054, CaF1_WIE_23_E_10 SEQ ID NO:4060, CaF1_WIE_24_11_03 SEQ ID NO:4098, CaF1_WIE_24_B_11 SEQ ID NO:4104, CaF1_WIE_24_C_01 SEQ ID NO:4105, CaF1_WIE_24_E_03 SEQ ID NO:4122, CaF1_WIE_25_B_09 SEQ ID NO:4175, CaF1_WIE_26_D_07 SEQ ID NO:4257, CaF1_WIE_26_D_08 SEQ ID NO:4258, CaF1_WIE_27_A_08 SEQ ID NO:4306, CaF1_WIE_27_A_09 SEQ ID NO:4307, CaF1_WIE_27_B_02 SEQ ID NO:4310, CaF1_WIE_27_D_11 SEQ ID NO:4337, CaF1_WIE_27_F_03 SEQ ID NO:4350, CaF1_WIE_27_H_08 SEQ ID NO:4376, CaF1_WIE_28_D_08 SEQ ID NO:4409, CaF1_WIE_28_E_05 SEQ ID NO:4415, CaF1_WIE_28_G_02 SEQ ID NO:4427, CaF1_WIE_29_B_01 SEQ ID NO:4456, CaF1_WIE_29_C_06 SEQ ID NO:4472, CaF1_WIE_29_D_02 SEQ ID NO:4479, CaF1_WIE_29_E_11 SEQ ID NO:4498, CaF1_WIE_30_A_09 SEQ ID NO:4537, CaF1_WIE_30_B_06 SEQ ID NO:4542, CaF1_WIE_30_C_01 SEQ ID NO:4548, CaF1_WIE_30_D_01 SEQ ID NO:4556, CaF1_WIE_30_F_01 SEQ ID NO:4575, CaF1_WIE_30_H_10 SEQ ID NO:4600, CaF1_WIE_31_A_10 SEQ ID NO:4609, CaF1_WIE_31_B_08 SEQ ID NO:4616, CaF1_WIE_31_D_09 SEQ ID NO:4633, CaF1_WIE_32_A_05 SEQ ID NO:4675, CaF1_WIE_32_C_11 SEQ ID NO:4700, CaF1_WIE_32_D_09 SEQ ID NO:4705, CaF1_WIE_32_F_06 SEQ ID NO:4718, CaF1_WIE_32_G_11 SEQ ID NO:4734, CaF1_WIE_33_F_04 SEQ ID NO:4788, CaF1_WIE_33_F_11 SEQ ID NO:4794, CaF1_WIE_33_G_05 SEQ ID NO:4798, CaF1_WIE_34_H_10 SEQ ID NO:4875, CaF1_WIE_36_A_11 SEQ ID NO:4964, CaF1_WIE_36_B_08 SEQ ID NO:4968, CaF1_WIE_36_C_10 SEQ ID NO:4977, CaF1_WIE_36_D_04 SEQ ID NO:4981, CaF1_WIE_37_E_02 SEQ ID NO:5049, CaF1_WIE_38_A_06 SEQ ID NO:5088, CaF1_WIE_38_A_09 SEQ ID NO:5091, CaF1_WIE_38_F_05 SEQ ID NO:5124, CaF1_WIE_39_A_05 SEQ ID NO:5147, CaF1_WIE_40_B_06 SEQ ID NO:5213, CaF1_WIE_40_E_11 SEQ ID NO:5243, CaF1_WIE_41_E_01 SEQ ID NO:5306, CaF1_WIE_42_F_06 SEQ ID NO:5375, CaF1_WIE_42_F_07 SEQ ID NO:5376, CaF1_WIE_43_A_10 SEQ ID NO:5395, CaF1_WIE_43_B_08 SEQ ID NO:5403, CaF1_WIE_43_B_11 SEQ ID NO:5405, CaF1_WIE_43_F_01 SEQ ID NO:5425, CaF1_WIE_43_G_11 SEQ ID NO:5438, CaF1_WIE_44_B_11 SEQ ID NO:5453, CaF1_WIE_45_B_04 SEQ ID NO:5514, CaF1_WIE_45_C_04 SEQ ID NO:5521, CaF1_WIE_45_D_07 SEQ ID NO:5527, CaF1_WIE_46_B_11 SEQ ID NO:5580, CaF1_WIE_46_E_06 SEQ ID NO:5602, CaF1_WIE_47_A_04 SEQ ID NO:5635, CaF1_WIE_47_C_07 SEQ ID NO:5655, CaF1_WIE_48_F_10 SEQ ID NO:5757, CaF1_WIE_48_F_11 SEQ ID NO:5758, CaF1_WIE_48_H_03 SEQ ID NO:5768, CaF1_WIE_48_H_09 SEQ ID NO:5772, CaF1_WIE_49_A_04 SEQ ID NO:5777, CaF1_WIE_49_A_05 SEQ ID NO:5778, CaF1_WIE_49_C_01 SEQ ID NO:5793, CaF1_WIE_49_H_09 SEQ ID NO:5832, CaF1_WIE_50_B_02 SEQ ID NO:5839, CaF1_WIE_50_B_06 SEQ ID NO:5843, CaF1_WIE_51_C_01 SEQ ID NO:5914, CaF1_WIE_51_C_08 SEQ ID NO:5921, CaF1_WIE_51_E_05 SEQ ID NO:5935, CaF1_WIE_52_B_08 SEQ ID NO:5972, CaF1_WIE_52_D_09 SEQ ID NO:5989, CaF1_WIE_53_B_05 SEQ ID NO:6038, CaF1_WIE_53_B_08 SEQ ID NO:6040, CaF1_WIE_53_D_02 SEQ ID NO:6051, CaF1_WIE_53_D_09 SEQ ID NO:6056, CaF1_WIE_54_F_09 SEQ ID NO:6136, CaF1_WIE_55_G_04 SEQ ID NO:6202, CaF1_WIE_56_A_08 SEQ ID NO:6224, CaF1_WIE_56_G_10 SEQ ID NO:6263

Still another embodiment of the present invention provides ESTs derived from chickpea, wherein the ESTs are related to stress. These are CaF1_JIE_01_D_10 SEQ ID NO:40, CaF1_JIE_02_C_06 SEQ ID NO:93, CaF1_JIE_02_F_01 SEQ ID NO:115, CaF1_JIE_02_F_06 SEQ ID NO:120, CaF1_JIE_02_G_06 SEQ ID NO:128, CaF1_JIE_07_A_08 SEQ ID NO:441, CaF1_JIE_07_C_10 SEQ ID NO:463, CaF1_JIE_07_H_06 SEQ ID NO:510, CaF1_JIE_08_A_01 SEQ ID NO:516, CaF1_JIE_08_G_05 SEQ ID NO:580, CaF1_JIE_08_H_11 SEQ ID NO:597, CaF1_JIE_14_F_05 SEQ ID NO:1563, CaF1_JIE_15_B_01 SEQ ID NO:1591, CaF1_JIE_18_D_08 SEQ ID NO:1798, CaF1_JIE_25_B_02 SEQ ID NO:2298, CaF1_JIE_25_G_06 SEQ ID NO:2336, CaF1_JIE_27_B_08 SEQ ID NO:2422, CaF1_JIE_29_G_09 SEQ ID NO:2559, CaF1_JIE_29_G_10 SEQ ID NO:2560, CaF1_JIE_31_A_03 SEQ ID NO:2617, CaF1_JIE_31_F_10 SEQ ID NO:2656, CaF1_JIE_31_G_07 SEQ ID NO:2663, CaF1_JIE_31_H_10 SEQ ID NO:2675, CaF1_JIE_32_C_02 SEQ ID NO:2686, CaF1_JIE_32_C_11 SEQ ID NO:2690, CaF1_JIE_32_F_05 SEQ ID NO:2706, CaF1_JIE_36_F_10 SEQ ID NO:2934, CaF1_JIE_36_G_10 SEQ ID NO:2938, CaF1_JIE_39_B_10 SEQ ID NO:3066, CaF1_JIE_39_D_10 SEQ ID NO:3082, CaF1_JIE_39_F_11 SEQ ID NO:3096, CaF1_JIE_41_B_05 SEQ ID NO:3189, CaF1_JIE_41_D_05 SEQ ID NO:3205, CaF1_JIE_41_F_06 SEQ ID NO:3223, CaF1_WIE_01_E_01 SEQ ID NO:665, CaF1_WIE_01_E_03 SEQ ID NO:666, CaF1_WIE_02_A_11 SEQ ID NO:706, CaF1_WIE_02_D_10 SEQ ID NO:727, CaF1_WIE_02_F_08 SEQ ID NO:745, CaF1_WIE_02_H_03 SEQ ID NO:756, CaF1_WIE_02_H_05 SEQ ID NO:757, CaF1_WIE_03_A_01 SEQ ID NO:763, CaF1_WIE_03_C_11 SEQ ID NO:782, CaF1_WIE_04_A_05 SEQ ID NO:821, CaF1_WIE_04_A_11 SEQ ID NO:825, CaF1_WIE_04_E_04 SEQ ID NO:855, CaF1_WIE_04_E_08 SEQ ID NO:859, CaF1_WIE_05_D_08 SEQ ID NO:918, CaF1_WIE_06_A_08 SEQ ID NO:963, CaF1_WIE_06_E_09 SEQ ID NO:994, CaF1_WIE_06_F_04 SEQ ID NO:999, CaF1_WIE_07_A_09 SEQ ID NO:1032, CaF1_WIE_07_C_10 SEQ ID NO:1052, CaF1_WIE_07_H_11 SEQ ID NO:1102, CaF1_WIE_08_B_08 SEQ ID NO:1115, CaF1_WIE_09_A_09 SEQ ID NO:1180, CaF1_WIE_09_C_06 SEQ ID NO:1188, CaF1_WIE_09_E_05 SEQ ID NO:1202, CaF1_WIE_10_C_09 SEQ ID NO:1259, CaF1_WIE_11_B_06 SEQ ID NO:3321, CaF1_WIE_11_H_07 SEQ ID NO:3373, CaF1_WIE_12_B_05 SEQ ID NO:3388, CaF1_WIE_14_C_08 SEQ ID NO:3533, CaF1_WIE_15_D_06 SEQ ID NO:3581, CaF1_WIE_16_E_09 SEQ ID NO:3624, CaF1_WIE_16_F_10 SEQ ID NO:3628, CaF1_WIE_17_B_06 SEQ ID NO:3660, CaF1_WIE_17_C_10 SEQ ID NO:3673, CaF1_WIE_19_A_03 SEQ ID NO:3798, CaF1_WIE_19_D_04 SEQ ID NO:3826, CaF1_WIE_19_F_08 SEQ ID NO:3843, CaF1_WIE_19_G_10 SEQ ID NO:3851, CaF1_WIE_20_D_11 SEQ ID NO:3883, CaF1_WIE_20_E_11 SEQ ID NO:3892, CaF1_WIE_20_G_07 SEQ ID NO:3904, CaF1_WIE_20_G_09 SEQ ID NO:3905, CaF1_WIE_21_C_04 SEQ ID NO:3934, CaF1_WIE_22_A_01 SEQ ID NO:3978, CaF1_WIE_22_B_07 SEQ ID NO:3987, CaF1_WIE_22_C_08 SEQ ID NO:3997, CaF1_WIE_22_H_06 SEQ ID NO:4024, CaF1_WIE_23_A_02 SEQ ID NO:4029, CaF1_WIE_25_B_02 SEQ ID NO:4169, CaF1_WIE_25_H_09 SEQ ID NO:4221, CaF1_WIE_26_E_09 SEQ ID NO:4270, CaF1_WIE_27_A_07 SEQ ID NO:4305, CaF1_WIE_27_B_07 SEQ ID NO:4315, CaF1_WIE_27_H_06 SEQ ID NO:4374, CaF1_WIE_28_B_09 SEQ ID NO:4392, CaF1_WIE_28_E_01 SEQ ID NO:4412, CaF1_WIE_28_H_09 SEQ ID NO:4443, CaF1_WIE_

29_H_05 SEQ ID NO:4524, CaF1_WIE_30_D_04 SEQ ID NO:4559, CaF1_WIE_31_F_02 SEQ ID NO:4646, CaF1_WIE_31_G_06 SEQ ID NO:4658, CaF1_WIE_33_B_05 SEQ ID NO:4756, CaF1_WIE_34_E_09 SEQ ID NO:4850, CaF1_WIE_35_B_08 SEQ ID NO:4894, CaF1_WIE_35_B_11 SEQ ID NO:4896, CaF1_WIE_35_F_02 SEQ ID NO:4928, CaF1_WIE_36_H_06 SEQ ID NO:5016, CaF1_WIE_37_D_07 SEQ ID NO:5047, CaF1_WIE_37_G_08 SEQ ID NO:5070, CaF1_WIE_37_H_09 SEQ ID NO:5081, CaF1_WIE_40_A_03 SEQ ID NO:5200, CaF1_WIE_40_A_06 SEQ ID NO:5203, CaF1_WIE_40_B_09 SEQ ID NO:5215, CaF1_WIE_40_E_09 SEQ ID NO:5241, CaF1_WIE_40_H_06 SEQ ID NO:5267, CaF1_WIE_41_H_03 SEQ ID NO:5332, CaF1_WIE_42_D_01 SEQ ID NO:5361, CaF1_WIE_42_D_02 SEQ ID NO:5362, CaF1_WIE_42_G_01 SEQ ID NO:5379, CaF1_WIE_45_F_02 SEQ ID NO:5538, CaF1_WIE_46_B_05 SEQ ID NO:5575, CaF1_WIE_46_B_10 SEQ ID NO:5579, CaF1_WIE_46_C_06 SEQ ID NO:5585, CaF1_WIE_47_C_08 SEQ ID NO:5656, CaF1_WIE_47_D_03 SEQ ID NO:5662, CaF1_WIE_47_H_04 SEQ ID NO:5704, CaF1_WIE_48_B_05 SEQ ID NO:5719, CaF1_WIE_48_F_09 SEQ ID NO:5756, CaF1_WIE_50_B_09 SEQ ID NO:5846, CaF1_WIE_50_D_09 SEQ ID NO:5863, CaF1_WIE_51_D_06 SEQ ID NO:5929, CaF1_WIE_51_D_10 SEQ ID NO:5931, CaF1_WIE_52_B_07 SEQ ID NO:5971, CaF1_WIE_52_D_11 SEQ ID NO:5991, CaF1_WIE_52_H_08 SEQ ID NO:6024, CaF1_WIE_54_A_08 SEQ ID NO:6087, CaF1_WIE_54_C_01 SEQ ID NO:6099, CaF1_WIE_54_H_08 SEQ ID NO:6151, CaF1_WIE_54_H_11 SEQ ID NO:6153, CaF1_WIE_55_B_05 SEQ ID NO:6161, CaF1_WIE_55_B_06 SEQ ID NO:6162 and CaF1_WIE_56_D_03 SEQ ID NO:6239.

In another embodiment the present invention provides ESTs derived from chickpea, wherein the ESTs are related to Photosynthesis These ESTs are CaF1_JIE_01_C_10 SEQ ID NO:30, CaF1_JIE_02_B_10 SEQ ID NO:86, CaF1_JIE_02_D_10 SEQ ID NO:106, CaF1_JIE_06_B_08_SEQ ID NO:385, CaF1_JIE_07_D_10 SEQ ID NO:474, CaF1_JIE_09_C_05 SEQ ID NO:622, CaF1_JIE_09_F_03 SEQ ID NO:1294, CaF1_JIE_10_H_02 SEQ ID NO:1353, CaF1_JIE_14_A_09 SEQ ID NO:1526, CaF1_JIE_14_H_04 SEQ ID NO:1576, CaF1_JIE_15_H_10 SEQ ID NO:1648, CaF1_JIE_18_F_07 SEQ ID NO:1816, CaF1_JIE_20_D_11 SEQ ID NO:1944, CaF1_JIE_20_E_06 SEQ ID NO:1950, CaF1_JIE_22_A_01 SEQ ID NO:2061, CaF1_JIE_22_B_01 SEQ ID NO:2072, CaF1_JIE_22_G_05 SEQ ID NO:2124, CaF1_JIE_23_C_02 SEQ ID NO:2163, CaF1_JIE_23_C_04 SEQ ID NO:2165, CaF1_JIE_23_C_05 SEQ ID NO:2166, CaF1_JIE_26_C_03 SEQ ID NO:2365, CaF1_JIE_29_E_03 SEQ ID NO:2547, CaF1_JIE_33_D_02 SEQ ID NO:2750, CaF1_JIE_34_G_06 SEQ ID NO:2824, CaF1_JIE_34_G_07 SEQ ID NO:2825, CaF1_JIE_34_G_08 SEQ ID NO:2826, CaF1_JIE_34_H_09 SEQ ID NO:2835, CaF1_JIE_34_H_10 SEQ ID NO:2836, CaF1_JIE_35_B_11 SEQ ID NO:2853, CaF1_JIE_36_B_01 SEQ ID NO:2898, CaF1_JIE_36_E_11 SEQ ID NO:2928, CaF1_JIE_37_D_09 SEQ ID NO:2970, CaF1_JIE_37_G_10 SEQ ID NO:2988, CaF1_JIE_39_A_03 SEQ ID NO:3057, CaF1_JIE_40_G_09 SEQ ID NO:3168, CaF1_WIE_01_H_03 SEQ ID NO:692, CaF1_WIE_05_B_07 SEQ ID NO:900, CaF1_WIE_05_F_02 SEQ ID NO:932, CaF1_WIE_22_H_02 SEQ ID NO:4020, CaF1_WIE_25_B_08 SEQ ID NO:4174, CaF1_WIE_26_B_08 SEQ ID NO:4238, CaF1_WIE_32_E_08 SEQ ID NO:4713, CaF1_WIE_33_G_08 SEQ ID NO:4801, CaF1_WIE_37_A_01 SEQ ID NO:5022, CaF1_WIE_41_E_02 SEQ ID NO:5307, CaF1_WIE_44_B_03 SEQ ID NO:5448, CaF1_WIE_44_C_03 SEQ ID NO:5456, CaF1_WIE_47_B_03 SEQ ID NO:5644, CaF1_WIE_47_G_07 SEQ ID NO:5696, CaF1_WIE_47_H_05 SEQ ID NO:5705, CaF1_WIE_49_A_09 SEQ ID NO:5781, CaF1_WIE_49_E_07 SEQ ID NO:5810, CaF1_WIE_51_D_11 SEQ ID NO:5932, CaF1_WIE_51_F_02 SEQ ID NO:5942, CaF1_WIE_52_A_02 SEQ ID NO:5957, CaF1_WIE_52_H_11 SEQ ID NO:6026, CaF1_WIE_53_A_08 SEQ ID NO:6032 and CaF1_WIE_54_B_02 SEQ ID NO:6090.

Comparison with Other Legume Genome and EST Databases

To investigate how many of the chickpea ESTs from this study are highly orthologous to other legume ESTs, we performed a comparative analysis of our CaEST dataset to publicly available dataset comprising ESTs from *Arachis hypogea, Cajanus cajan, Pisum sativum, Robinia pseudoacacia, Lotus japonicus, Medicago trunculata, Glycine max* and *Phaseolus vulgaris*. Except *Phaseolus* and *Robinia*, these databases were inclusive of root ESTs. The highest number of common orthologous ESTs was found to be present in *Pisum sativum*, although, *Cajanus cajan* and *Arachis hypogea* also showed higher similarity with CaUnigenes. The percentage of chickpea ESTs that matched to *Pisum sativum* was 88.8% and 79.43% at DNA sequence identity of ≥80% and 90%, respectively. A total of 87.6% and 83% Cajanus cajan ESTs and 85.89% and 55.54% of *Arachis* ESTS were common with CaUnigenes. Chickpea and *Pisum* show close phylogenetic affliations, both being representatives of galegoid, a group of cool season legumes and is reflected in their sequence similarities. However, high sequence similarity with *Arachis* and *Cajanus* came as a surprise since these legumes are phylogenetically distant relatives of *Cicer* and belong to tropical season legumes (phaseoloid). The comparative analysis of chickpea ESTs with that of *Glycine max* showed homology of 80.32% and 31.54%. Interestingly, *Medicago* and *Lotus* showed more divergent trend with only 58.02% and 30.50% and 43.31% and 14.25% ESTs respectively, having counterpart in CaUnigene set. A recent phylogenetic study based on penalized likelihood analysis indicated that *Medicago, Lotus* and *Cicer* are closer and fall in the same galegoid clade, however, the divergence/difference in the pattern of ESTs may be attributed to the fact that gene expression is shaped by cellular environment besides ecological niche of the corresponding organism. Chickpea ESTs showed lesser homology with *Robinia pseudoacacia* and was about 12% and 3.92% at DNA sequence identity of 80% and 90%, respectively. This can be due to the fact that *Robinia* is a perennial tree while chickpea is an annual herb. Detailed comparative analysis of ESTs is shown in Table 3. Thus the current study documents substantial conservation as well as genome divergence amongst legume crops and in future can facilitate cross species analysis of gene function.

Identification of Chickpea Specific Transcripts and Enrichment of CaEST

In an attempt to identify the genotype-specific transcript signatures in chickpea, we performed a blast analysis of CaUnigene. Of the total 2013 CaUnigenes, about 18.22% sequences that belong to NSH group represented potential chickpea specific sequences. To verify whether these sequences were indeed chickpea specific, TBLASTX was used for comparing them to the EST_others database. Nearly 64% of the NSH class of CaEST dataset did not show any significant match thereby confirming that these ESTs represent unique chickpea sequences. Thus this dataset represents 234 novel chickpea specific ESTs, which were never reported earlier. Further, we compared our CaUnigenes with the earlier reported ESTs of chickpea. TBLASTX with e-value cutoff of $10^{-10}$ showed that 532 unigenes from the CaUnigene set of 2013 had a significant match, while the remaining 1483 did not have any counterpart. Thus, 73.67% of our CaUnigenes represent new chickpea genes yet unidentified. Full length sequencing of these unigenes and their expression analyses may provide further insight into the species-specific functions of these genes.

Figure 1:
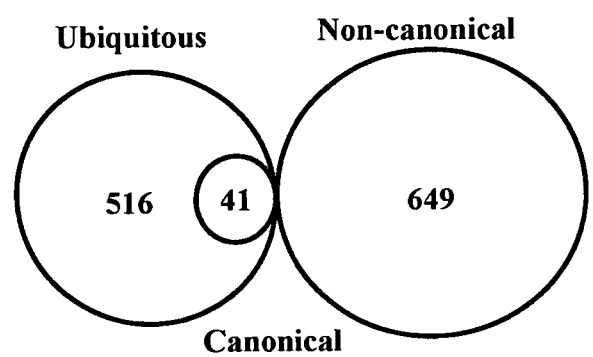
FIG. 1 shows comparative analysis of chickpea stress responsive genes with earlier known stress related genes. Venn represents the overlap between ubiquitous, canonical and non canonical genes and the numbers signify unique and common stress responsive genes.

Comparative Stress Responsive Transcriptome Reveals Canonical and Non-Canonical Genes Although a number of studies have catalogued stress-responsive genes against different environmental conditions into various functional classes but comparative genomics of stress-responsive transcriptome is still lacking. To investigate the comparative biology of stress-responsive transcriptome at organismal level with the currently available data, we compared the CaUnigenes with previously reported stress-responsive genes from other organisms. We classified genes known to be involved in multi-stress responses as ubiquitous, while those found to be specific to *Fusarium* infection were categorized as canonical. All other genes, which have never been implicated in any stress, were designated as noncanonical (FIG. 1). We found that around 516 genes are ubiquitous, suggesting broad similarities in stress responses across most of the organisms and confirming cross communicating pathways playing role in different kinds of stresses. However, only 41 genes were found to be canonical all of which showed an overlap with ubiquitous class. A significantly large number of genes (649) were found to be noncanonical. This difference in the pattern of immune-responsive root transcriptome may be attributed to the fact that the gene expression in an organism is shaped by the cellular environment and the epigenetic factors. Metabolism was one of the most abundant functional class in all the three groups, suggesting that any stress response results in the alteration of the metabolic pathways of an organism. A few of the metabolic enzymes found to be expressed in response to multiple stresses represented in the ubiquitous category included S-adenosylmethionine decarboxylase, glyceraldehyde 3-phosphate dehydrogenase, methionine sulfoxide reductase, and copper amine oxidase. Cell signaling related genes also formed an important class that included leucine-rich repeat receptor-like kinase and multiple bridging factor among others. As expected, many canonical genes belonged to functional class of cellular redox, defense and signaling included Cationic peroxidase 2, chitinase and 14-3-3 protein. Our data on immune responsive transcriptome and comparative analysis thereof provide evidence for molecular diversity vs commanality in gene expression profile at organismal level. The comparative analysis revealed few canonical genes, several ubiquitous genes across different stresses while most of the genes were found to be non-cannonical. An interesting observation was that apart from metabolism, most of the noncanonical genes belonged to the functional classes of translation, posttranslational modifications, transcription, and signaling suggesting the occurrence of new, yet undiscovered immune response pathways. This study thus provides a comprehensive catalogue of non-canonical immune responsive genes or might suggest their species specificity with new insight into their identity and function.

Identification of Gene Families

To assign CaUnigenes from this study to putative gene families, we used single linkage clustering. The individual contigs and singletons were combined into a single dataset which was then compared to itself using TBLASTX with an e-value cutoff of 1E-15. Sequences with overlapping BLAST reports were assigned to a putative gene family. Altogether, we identified 209 gene families ranging in size from 2 to 29 members. This analysis gives insights into following three areas: firstly, it identifies the genes that are likely to cross hybridize during the microarray hybridizations. Secondly, it helps in assigning possible function to genes that had no significant homology to known proteins or belonged to class of UF but clustered with proteins of known function. For example, gene family 23 had two members of which one showed homology to CAP protein while the other showed homology to hypothetical protein. Similarly, one of the members of gene family 32 showed homology to cinnamoyl-CoA reductase, while the other two belonged to NSH class. Also, one member of gene family 124 showed homology with phosphoesterase but the other did not have any significant match. Therefore, on the basis of the family to which such genes either of NSH or UF belong, possible function can be assigned to them and further verified by comparing sequence alignment of these sequences with representative members of the known gene family. Thirdly, the identification of gene families provides a base for uncovering and understanding the biological rationale of functional novelty and partitioning following gene duplications. Towards this, it was interesting to note that in several cases the distribution of different members of the same gene family varied between the genotypes. For example, histone deacetylase HDT1 (contig212) was found to be specific to susceptible genotype while the other member of the same gene family represented by contig713 was present only in the resistant genotype. This was also the case with methionine sulfoxide reductase A, where contig152 and contig555 were specific to susceptible and resistant genotypes respectively. Putative esterase family protein (CaF1_JIE_28_D_10, CaF1_WIE_32_H_04) and putative desaturase (contig454, CaF1_JIE_22_A_09) also showed the same trend. This opens up a new area for finding out whether presence of different gene family members leads to genotype specific response to a particular kind of stress.

Analysis of Genotype-Specific SNPs of Chickpea

SNPs between genotypes/haplotypes once discovered are extensively used for many applications for instance generation of very dense genetic maps, to construct the specific genotypes required for quantitative genetic studies, to enhance understanding of genome organization and function and address fundamental questions relating to evolution. SNPs can also be used for genome-wide linkage disequilibrium and association studies that assign genes to specific functions or traits. Furthermore, transcript-associated SNPs can be used to develop allele-specific assays for the examination of cis regulatory variation within a species. In the present study, SNPs were identified between JG-62, a susceptible and WR-315, a resistant genotype of chickpea to vascular wilt. A total of 279 contigs (28.67% of the total) contained at least one sequence from both the genotypes and were mined for potential SNPs. We identified 262 SNPs which were further classified into high and low quality SNPs depending upon the number of sequences from each genotype showing the same base change. High-quality SNPs were confirmed by two or more sequences from each genotype showing the same base change, while low-quality SNPs were confirmed by one sequence from one genotype and at least two from the other. Thus, we identified 136 high-quality and 126 low-quality SNPs. In the present analysis only base pair mutations were taken into consideration and among these transitions (73.3%) were more common than transversions (26.7%). Within the transitions, occurrence of both adenine to guanine and cytosine to thymidine base changes were found to be almost equal. The maximum numbers of SNPs were present in contigs that comprised of highly abundant ESTs, for example, contig 722 represents the most abundant contig and maximum numbers of SNPs were present in this contig. Similarly, contig 680 and 575 also had high percentage of SNPs and were also very abundant as far as total number of ESTs in these contigs is concerned.

Figure 2:
FIG. 2 shows heat map and functional categories of up-regulated genes during Ca-*Fusarium* (A) compatible and (B) incompatible interactions. Tree view represents the kinetic expression patterns of genes displaying significant regulation response to *Fusarium* infection at different post-pathogen inoculation time points.
Figure 3:
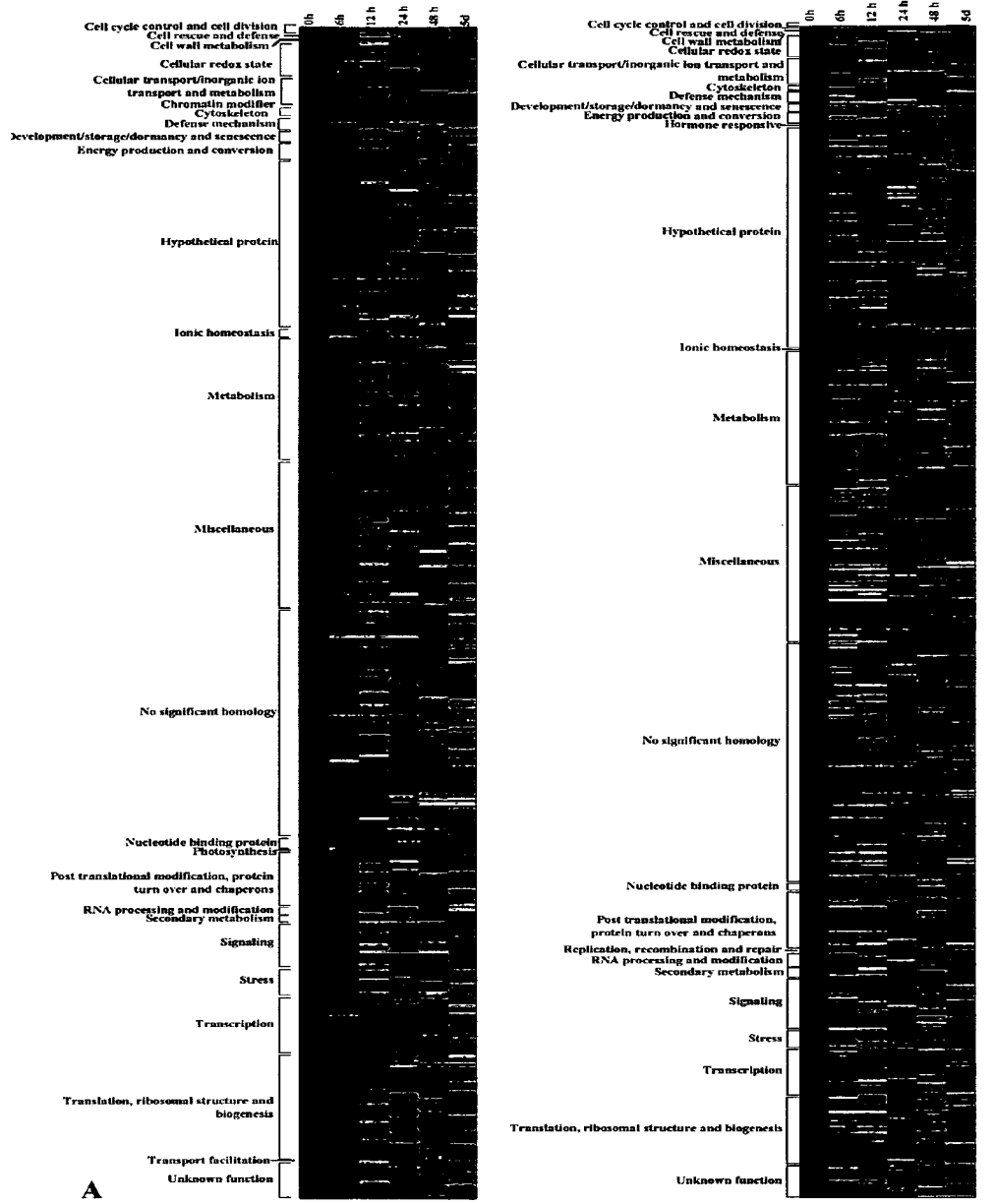
FIG. 3 shows heat map and functional categories of down-regulated genes during Ca-*Fusarium* (A) compatible and (B) incompatible interactions. Tree view represents the kinetic expression patterns of genes displaying significant regulation response to *Fusarium* infection at different post-pathogen inoculation time points.

Immune Responsive Gene Networks in Root Transcriptome of Chickpea by Microarray Analysis To study the transcriptional remodeling in immune response during vascular wilt, we have developed cDNA microarray using CaEST clones of the subtracted cDNA libraries from susceptible and resistant genotypes. Root tissue sample from WR-315 (resistant genotype) and JG62 (susceptible) harvested at five time points post *Fusarium* infection was used to evaluate the expression profile during early phase of incompatible interaction. We used indirect labeling of cDNAs following TSA protocol that incorporates flourscein and biotin labeled dUTP into the nascent cDNA from the target RNA instead of Cy3 and Cy5 modified nucleotides since it is known to negate any dye bias during the microarray experiment. The transcript level for each cDNA was calculated as the average intensity of four data points from duplicate spots of two replicate slides. We used a fold cut off of 2.5 and Students t-test with P≤0.05 ranking with false discovery rate (FDR) multiple testing corrections to identify differentially expressed genes. A total of 1276 differentially expressed unigenes were found to be associated with the early signaling pathway, of which 459 were induced and 565 repressed during compatible interaction while 375 were induced and 464 repressed during incompatible interaction. Further, to identify co-expression kinetics amongst the differentially expressed genes, we clustered the transcriptome data set that grouped the genes in four clusters based on their positive and negative fold change during compatible and incompatible interractions. Cluster 1 represents upregulated genes (FIG. 2A-B) while Cluster 2 comprised of genes repressed (FIG. 3A-B) at various time points post *Fusarium* infection in both compatible and incompatible interactions, respectively. In total 22 functional classes are represented in these two clusters but differed in the type of the representative genes and their relative abundance.

Amongst the total differential genes 413 fell exclusively under compatible while 221 were present solely under the incompatible interaction and 642 were differential to both (FIG. 4A). In case of the induced gene profiles 168 belonged exclusively to the compatible interaction and 84 to the incompatible interaction while 291 were upregulated and represented in both (FIG. 4B). The downregulated or repressed expression patterns had 295 mapped exclusively under compatible interaction and 194 exclusively under incompatible interaction whereas 270 genes showed downregulation in both (FIG. 4C). Moreover, the transcriptional response to immune sensitivity of genes involved in major biological processes and molecular functions showed different dynamics within repressed vs. induced gene clusters. The repressed gene clusters are enriched for genes affecting translation, ribosome structure and biogenesis and protein fate, while the induced cluster is dominated by genes encoding hypothetical proteins, metabolism and miscellaneous groups. Genes involved in metabolism GO category are over-represented in all the clusters but the magnitude of over-representation is higher for cluster 1 than cluster 2. UF, NSH and Miscellaneous categories notably formed a major group of overrepresented genes.

Genes involved in translation, ribosome structure and biogenesis form the largest functional category in cluster 1 for both compatible and incompatible interactions that includes genes for ribosomal proteins, translation initiation and elongation factors. Several genes encoding proteins involved in post translational modifications and protein turnover, for example, protein disufide isomerase-like protein and ubiquitin were also grouped. Many of these genes have previously been implicated in specific stresses in different organisms (Gray 2002). In the repressed set of genes other major functional classes included metabolism, hypothetical proteins, cellular redox state and transcription. These include genes encoding cytochrome P450, thioredoxin, superoxide dismutase and glutathione-5-transferase that are known to play critical role in plant stress. Many carbohydrate metabolism genes like GAPDH, triosephosphate isomerase and malate dehydrogenase precursor were downregulated. Earlier reports showed altered expression of GAPDH during plant stress, however the specific function of this enzyme during stress is not known. Moreover GAPDH has also been known to act as an essential component of transcriptional activator complex regulating histone expression. We also observed defense related genes like chitinase 1 and PR10, and secondary metabolism genes like chalcone synthase and isoflavone 3'-hydroxylase to be repressed during *Fusarium* infection. These genes are known to be associated with pathogen stress.

In contrary, genes encoding hypothetical proteins, metabolism and miscellaneous groups form the dominant functional class in repressed clusters. The induced set of metabolic genes include some carbohydrate metabolism genes like FBF, aldolase and pfkB-type carbohydrate kinase family protein of carbohydrate metabolism and oleate desaturase involved in lipid metabolism. The role of these enzymes in plant immunity has not yet been defined and hence will be of great interest in future. Post-translational modification and protein turnover related genes like cystatin, Sec61 beta and ubiquitin extension protein were also induced consistent with the notion that damaged or partially denatured proteins need to be degraded to prevent the accumulation of protein aggregates. Many such genes are involved in regulating protein metabolism in response to stress. Other cell stress induced genes include classical phenylpropanoid pathway genes like chalcone reductase and chalcone—flavonone isomerase 1. Role played by these genes during cell defense is a well known phenomenon. Many signaling related genes like serine/threonine protein kinase showed induction during the incompatible interaction while repression in the compatible one. Leucine-rich repeat trans-membrane protein kinase to name a few was induced in both cases attesting their role in plant defense.

We found that around 315 differentially expressed genes are ubiquitous, suggesting broad similarities in stress responses across most of the organisms and confirming cross communicating pathways playing role in different kinds of stresses. However, only 25 differentially expressed genes were found to be canonical all of which showed an overlap with ubiquitous class. A significantly large number of differentially expressed genes (382) were found to be noncanonical (FIG. 5). Interestingly, more than thirty five percent of the repressed and induced gene clusters represented NSH and hypothetical proteins in the compatible interaction while in case of the incompatible interaction around thirty eight percent of the induced cluster belonged to the above mentioned classes while the repressed cluster paved the way for about thirty percent of the hypothetical and NSH proteins. These proteins do not have known cellular roles and thus can now be annotated as being involved in immune response pathway.

Expression Analysis of Selected ESTs by RNA Blot Analysis

To confirm the differential expression of immune-responsive genes, four highly abundant genes in our CaEST dataset showing induced gene expression were selected for RNA blot analysis. The results showed that all four ESTs had a strong induction in root tissue at 24 h post infection and the level of gene expression corroborated to that of microarray analyses. The genes encoding alcohol dehydrogenase and pfkB-type kinase, showed a very high expression suggesting that the carbohydrate metabolic pathways are altered in response to vascular wilt. A disease resistance response gene for defense signaling also showed upregulation indicating its role in immune response. The expression level of a fungal gene FOXY, found to be highly abundant both in susceptible and resistant genotypes was consistent with that of microarray data. This gene encodes a transposable element and its induction during plant-pathogen interaction is of interest for the study of such elements and their involvement in immunity vs. disease.

Our study is directed towards creating a gene resource (CaEST database) of chickpea for the systematic analysis of genotype-dependent organ-specific stimuli-responsive gene signatures that would provide an initial platform for gene discovery and functional genomics of this third most important but understudied food legume. This approach may be used in future to dissect diverse and overlapping biochemical pathways encompassed by the identified transcripts at individual level. This will also be important in long-term efforts to develop faithful, quantitative models for plant processes. The efficiency of subtracted genotype specific immune responsive EST sequencing is especially reflected in the number of new genes identified in this study, which is still moderate in size. A total of 2013 unigenes are reported that characterize the immune responsive transcripts of this important legume, of which approximately twelve percent represent new chickpea genes hitherto undiscovered. Our discovery of a large number of SNPs in expressed sequences should allow the genetic mapping of many genes underlying agricultural characteristics in chickpea. Although WR315 and JG62 may be presumably quite similar to one another at the nucleotide sequence level, we find they are equally different to each other in their transcript profile. In addition, the use of this approach in our present study led to the identification of 807 genes of unknown function now assigned to the immune response pathway with an organ specific localization, opens up a new area of investigation wherein the combining of our CaUnigene dataset with other databases could be used to draw relationships at system level. The results identified a set of 649 non-cannonical stress responsive genes which has never been associated with immune response. Further, homology search of the derived amino acid sequence data from the present study provides a firm indication of a number of components of the root to which function is still to be ascribed. The ESTs identified in this study represent the major attempt so far to define chickpea transcriptome. The microarray analysis of immune-responsive transcriptome uncovers new regulators of host-pathogen interaction. Assigning a functional role to each of these new immune regulators will be challenging and quite valuable in order to know the physiological significance of plant immunity. Nevertheless, the sequence information of chickpea is unavailable and the number of functionally annotated ESTs is low at this time, as this number increases, the transcriptome data will be proven even more useful. The recent identification of immune responsive genes from other organisms would eventually lead to develop a comparative species-specific immune responsive transcriptome in which this report becomes one of the first attempts. This is an initial attempt in the direction that will be expanded upon during future transcriptomic studies of plant processes. Our future efforts will focus onto enriching CaUnigene database and increasing the number of analyzed genes thereof, with an aim to draw a complete functional map of organ specific stimuli responsive transcriptome at individual level. Further, we will focus onto identifying the dynamics associated with the organ specific transcriptome towards cells metabolic and regulatory pathways at different physiological conditions shaping the phenome diversity.

Molecular Cloning of IRF817 Polynucleotide (SEQ ID NO: 6273) Encoding a bHLH Protein (SEQ ID NO: 6274)

In our study, we developed a differential transcriptome of chickpea under pathostress. Several transcripts were identified and cloned. We chose one of these transcripts, designated as IRF817 (Immune responsive factor 817), that was represented as a singleton, for this study. Full-length cloning of IRF817 using 3' and 5' RACE based on CaEST (CaF1_WIE_34_F_11 SEQ ID NO:4861) yielded 0.750 kb cDNA clone. Sequence analysis revealed that the actual transcript size of IRF817 is 750 bp with a coding region of 687 bp, 24 bp of 5'- and 39 bp of 3'-UTRs, respectively. The cDNA encodes for a protein consisting of 228 amino acids with approximate molecular weight of 25.193 kDa having isoelectric point of 6.63. It codes for a protein with a basic helix loop helix (bHLH) DNA binding domain (amino acid 70 to 119) and a caspase domain (amino acids 94 to 169). In silico analysis with ExPASy ProtParam tool revealed the presence of approximately 14% basic, 14% acidic and 76% neutral amino acids. The homology search against GenBank database showed that CaGene1 had maximum homology with an unnamed protein of *Vitis vinifera* and bHLH transcription factor of *Nicotiana*. It also showed homology to an unknown protein of *Medicago* and IAA-Leu resistant DNA binding protein of *Arabidopsis*. This gene stands out to be a novel candidate to study immune response as it does not get any close functionally characterized homologue in a BLAST-P search. This bHLH transcription factor sequence was also observed to be having a caspase domain which makes it unique. Further its expression can be utilized to generate a new variety of crop which can self stimulate itself to raise the bar against a combination of environmental stress responses.

IRF817 is a Low Copy Gene in Chickpea

To find out the genomic organization of IRF817, genomic PCR was performed using gene specific primers and chickpea genomic DNA as template that showed amplification of a 687 bp amplicon exactly matching the size of the cDNA (FIG. 6A) indicating that IRF817 is an intron-less gene in chickpea. Earlier reports on presence and distribution of introns in bHLH family proteins has shown that 80% of the members of this family in *Arabidopsis* and rice contain introns and the intron position is conserved even though the number varies (Toledo-Ortiz et al., 2003; Li et al., 2006). However, in this study the absence of intron suggests that this gene family might differ in genomic organization in legumes. Further, we performed the genomic southern in order to find out the copy number of IRF817. Genomic DNA extracted from chickpea was digested with different restriction enzymes. The blot was hybridized with 32P-labeled ORF of IRF817 fragment. EcoRV and NcoI, having single site in the probe region, produced three bands, whereas HindIII and NotI having no restriction sites produced double and single band respectively (FIG. 6B). This result indicates that the gene encoding IRF817 is present in more than one but as low copies in chickpea.

IRF 817, a Genotype-Independent Early Transcription Regulator

Further, we investigated the expression of IRF817 in both compatible and incompatible interactions by northern blot analyses using total RNA extracted from JG-62 and WR-315, respectively. The results showed that IRF817 gene had some basal expression in both the genotypes indicating its requirement in normal developmental processes. However, it was found to be highly regulated under patho-stress upon *Fusarium* infection. Expression of IRF817 reached maximal level within 6 h of post-infection remained up to 48 h and diminished by 5 day. However, the expression did not show any major difference between the susceptible and resistant genotypes (FIG. 7A-B). Altogether these data suggest IRF817 has a crucial and universal role to play in early phase of immunity.

IRF718, a Multiple Hormone Inducible Gene and Express Organ-Specifically

To examine the organ specificity of IRF817 transcript, we initially compared transcript abundance in different organs (roots, stems, and leaflets) by Northern analysis (FIG. 8). The results showed that the gene was expressed in all the three tissue types, however, the expression was maximum in root followed by stem and leaf. Thus, IRF817 plays regulatory role against vascular wilt in multiple organs. Root being the first organ to come in contact with the pathogen showed highest expression, again suggesting the early regulation of immune pathway by IRF817 in order to check the pathogen at the very early onset of the disease.

Next, we investigated whether IRF817 expression is affected by any hormones or other molecule, such as NO by quantitative real time PCR (FIG. 9). IRF817 was induced in response to SA by 1 h, quickly reaching its maxima at 6 hours after treatment. The transcript level remained to be at the same level of increase up to 6 h but increased a little at 12 h in case of JA treatment. IRF817 expression also increased during progressive time points after ACC treatment with maximum level at 12 hours. Brassinosteroid and NO also induced its expression. In case of NO, there was an initial down-regulation of IRF817 followed by upregulation at 3 and 6 hours and down-regulation at 12 hours, indicating a rhythmic pattern of expression. Further, the gene was found to be down-regulated in response to ABA except a slight increase at 12 h. These results suggest that IRF817 expresses in response to almost all the hormones which are known to play role in plant stress response and developmental pathways, thereby further confirming its role in plant immunity and development.

Regulation of IRF817 by Sub-Cellular Localization

It is thought that a distinct functional role of a protein may be conferred by its subcellular localization. In silico analysis identified a clear N-terminal localized nuclear targeting sequence in IRF817. To further confirm, a co-localization experiment was carried out wherein, the IRF817-GFP was found to be accumulated predominantly in the nucleus while GFP alone was accumulated throughout the cell (FIG. 10). The nuclear localization of IRF817 was in confirmation with earlier studies showing that the bHLH proteins are present in nucleus where they bind to DNA and perform their regulatory functions.

Over-Expression of IRF817 Polynucleotide (SEQ ID NO: 6273) Encoding a bHLH Protein (SEQ ID NO: 6274) Exhibits Immunity in Plants To investigate the functional role of IRF817 in plant, we constitutively expressed a functional IRF817 polynucleotide (SEQ ID NO: 6273) encoding a bHLH protein (SEQ ID NO: 6274 in a susceptible variety (JG-62) of chickpea. Since chickpea is highly recalcitrant to in vitro regeneration and genetic transformation, we established a transformation using *Agrobacterium rhizogenes* to determine the in planta gene function. The IRF817 over-expressed transgenic chickpea seedlings were grown alongside the susceptible non-transgenic control chickpea seedlings under identical conditions. Surprisingly, the transgenic seedlings overexpressing the IRF817 polynucleotide (SEQ ID NO: 6273) displayed an increased tolerance up to 99% to fungal pathogen *Fusarium* in terms of wilting of seedlings as compared to susceptible non-transgenic control seedlings. Unexpectedly, it was observed that the transgenic chickpea seedlings show improved immunity to the fungal pathogen over the non transgenic resistant chickpea seedlings. We then microscopically observed the development, penetration and colonization of the fungal pathogen in transgenic and the control chickpea root. Confocal microscopy revealed a gradual increase of fungal colonization and proliferation leading to extensive hyphal network on and inside the control roots (FIG. 11A), while invasive inter- and intracellular growth of the pathogen was significantly reduced in transgenic roots (FIG. 11C) in comparison to the control, indicating IRF817 mediated fungal resistance in plants. The fungus was found to enter through the collar region into the root vascular bundles by killing of the cells in the root epidermis. It is known that dead tissue is characterized by the absence of intact plant nuclei. To confirm that fungal colonization associates with dead cells, we double-stained root segments from the fungal challenged plants with DAPI for intact plant nuclei and wheat germ agglutinin-Texas Red (WGA-Texas Red) for fungal chitin. We found a close spatial association of strong fungal colonization (FIG. 11A) and DAPI-negative cells (FIG. 11B) in the control roots, further suggesting that massive development of the fungus in the root leads to the death of the host cells in the control. In contrary, the IRF817 transgenic roots showed DAPI positive cells (FIG. 11D) associated with very few hyphae (FIG. 11C), showing thereby immunity to the fungal pathogen. Corroborating with cell viability study, TUNEL assay revealed that although at the early onset of disease, apoptotic cells were found both in control and IRF817 root surface but as disease progressed IRF817 transgenic roots did not show any apoptotic cells while control roots showed continuous increase in TUNEL positive nuclei. Altogether our data suggest IRF817 expression leads to increased immunity against patho-stress in plants.

Bacteria and Yeast Expressed IRF817 was Functionally Active

To further investigate whether IRF817 specifically interact with DNA and has the transactivation capability; we cloned it into *E. coli* and yeast vectors, designated as GST-IRF817 and Gal4-IRF817 (FIG. 12-13). Over-expressed fusion proteins of IRF817 were found to be functionally active.

Another embodiment of the present invention provides polynucleotide having nucleotide sequence as set forth in SEQ ID NO: 6273 encoding protein having amino acid sequence as set forth in SEQ ID NO: 6274, wherein the polynucleotide is responsible for conferring immunity in plant against fungal pathogen.

One embodiment of the present invention provides the polynucleotides that include DNA molecules specifically EST DNA molecules or a fragment thereof. The fragments may comprise smaller oligonucleotides having from about 15 to about 250 nucleotide residues, and more preferably, about 15 to about 30 nucleotide residues.

Another embodiment of the present invention provides the polynucleotides that include DNA molecules specifically EST DNA molecules or a fragment thereof that are marker molecules.

Yet another embodiment of the present invention provides polynucleotides that include nucleic acid molecules that encode a protein or fragment thereof.

Yet another embodiment of the resent invention provides polynucleotides that are Expressed sequence tag (EST) molecules.

Still another embodiment of the present invention provides Expressed sequence tag derived from chickpea.

Still yet another embodiment of the present invention provides ESTs derived from chickpea. The ESTs disclosed in the present invention are classified into various functional classes such as cell cycle control and cell division; cellular redox state; cellular transport/inorganic ion transport and metabolism; cytoskeleton; defense mechanism; development/storage/dormancy and senescence; energy production and conversion; hormone responsive; translation, ribosomal structure and biogenesis; transcription; stress; signaling; secondary metabolism; RNA processing and modification; DNA replication, recombination and repair; post translational modification; protein turn over and chaperons; photosynthesis; nucleotide binding proteins and metabolism.

One embodiment of the present invention provides polynucleotide of Expressed sequence tag having nucleotide sequence selected from a group consisting of SEQ ID NO: 1 to SEQ ID NO: 6272.

Another embodiment of the present invention provides an isolated nucleotide sequence as set forth in SEQ ID NO: 6273 encoding the protein having amino acid sequence as set forth in SEQ ID NO: 6274.

Another embodiment of the present invention provides a recombinant vector comprising the nucleotide sequence as set forth in SEQ ID NO: 6273 encoding the protein having amino acid sequence as set forth in SEQ ID NO: 6274, wherein the nucleotide sequence is operably linked to a promoter.

Yet another embodiment of the present invention provides a recombinant host cell comprising the nucleotide sequence as set forth in SEQ ID NO: 6273 encoding the protein having amino acid sequence as set forth in SEQ ID NO: 6274, wherein the host cell is *E. coli, Agrobacterium* or yeast.

Still another embodiment of the present invention provides a method of improving immunity against fungal pathogen in plants, said method comprises transforming a plant cell with a polynucleotide having the nucleotide sequence as set forth in SEQ ID NO: 6273 encoding protein having amino acid sequence as set forth in SEQ ID NO: 6274, selecting the transformed plant cell and regenerating the transformed plant cell into transgenic plant showing improved immunity to the fungal pathogen.

Further embodiment of the present invention provides a Still another embodiment of the present invention provides a method of improving immunity against *Fusarium* in plants, said method comprises transforming a plant cell with a polynucleotide having the nucleotide sequence as set forth in SEQ ID NO: 6273 encoding protein having amino acid sequence as set forth in SEQ ID NO: 6274, selecting the transformed plant cell and regenerating the transformed plant cell into transgenic plant showing improved immunity to *Fusarium*.

Yet another embodiment of the present invention provides the method of improving immunity against fungal pathogen in plants, said method comprises transforming a plant cell with a polynucleotide having the nucleotide sequence as set forth in SEQ ID NO: 6273 encoding protein having amino acid sequence as set forth in SEQ ID NO: 6274, selecting the transformed plant cell and regenerating the transformed plant cell into transgenic plant showing improved immunity to the fungal pathogen, wherein the plant is monocot or dicot.

Yet another embodiment of the present invention provides the method of improving immunity against fungal pathogen in plants, said method comprises transforming a plant cell with a polynucleotide having the nucleotide sequence as set forth in SEQ ID NO: 6273 encoding protein having amino acid sequence as set forth in SEQ ID NO: 6274, selecting the transformed plant cell and regenerating the transformed plant cell into transgenic plant showing improved immunity to the fungal pathogen, wherein the plant is selected from a group consisting of tobacco, potato, sweet potato, cassava, sugarbeet, *Arabidopsis, brassica* species, tomato, Brinjal, *capsicum*, chili, banana, mango, *vitis*, papaya, sunflower, cotton, groundnut, pea, soybean, chickpea, pigeon pea, *medicago*, lotus, rice, maize, wheat, rye, barley, oats, sorghum, nuts, avocado, turmeric; saffron, ginger, garlic, onion, and nutmeg.

In one embodiment of the present invention there is provided a transgenic plant having improved immunity against a fungal pathogen, wherein the transgenic plant over-expresses a polynucleotide having the nucleotide sequence as set forth in SEQ ID NO: 6273.

In another embodiment of the present invention there is provided a transgenic seed obtained from the transgenic plant over-expressing a polynucleotide having the nucleotide sequence as set forth in SEQ ID NO: 6273, wherein the seed over-expresses a polynucleotide having the nucleotide sequence as set forth in SEQ ID NO: 6273.

In another embodiment of the present invention there is provided a transgenic progeny obtained from the transgenic seed over-expressing a polynucleotide having the nucleotide sequence as set forth in SEQ ID NO: 6273, wherein the progeny over-expresses a polynucleotide having the nucleotide sequence as set forth in SEQ ID NO: 6273.

EXAMPLES

It should be understood that the following examples described herein are for illustrative purposes only and that various modifications or changes in light will be suggested to persons skilled in the art and are to be included within the spirit and purview of this application and the scope of the appended claims.

Example 1

Plant Material and in-Planta Infection

The chickpea (*Cicer arietinum. L*) seeds maintained in the laboratory were sterilized with 70% ethanol and 0.1% $HgCl_2$ followed by repetitive washing in autoclaved water. The seedlings were grown in sterile conditions in glass tubes containing MS basal medium solidified with 0.6% agar in an environmentally controlled growth room and maintained at 25±2° C., 50±5% relative humidity under 16 h photoperiod (270 μmol m-2 s-1 light intensity). *Fusarium oxysporum* ciceri race 1 was grown in potato dextrose broth (PDB) at 28° C. The 3-week old seedlings were inoculated with *Fusarium* spore suspension at a concentration of $1\times10^6$/ml while the control plants were treated with water. The control samples refer to the RNA prepared from the unstressed seedlings harvested from different time period during the course of the experiment. Root and collar (root and shoot junction) tissue was sampled as experimental material, harvested at 6, 12, 24, 48 h and 5 days after inoculation and stored at −80° C. after quick-freezing in liquid nitrogen.

Example 2

Construction of cDNA Libraries

Two suppression subtracted cDNA libraries were constructed, one from a susceptible (JG-62) and the other from a resistant (WR-315) genotype using PCR select cDNA subtraction kit (Clontech, Calif.). Total RNA was isolated by GITC method from uninfected seedlings (used as driver) and *Fusarium* infected seedlings (used as tester) collected at different time points as mentioned above and subsequently combined. The poly (A)$^+$ RNA from the pooled total RNA was purified by using Dyna beads oligo (dT) (Dynal biotech, USA). The cDNAs were cloned into pGEMT vector (Promega, Wis.) and transformed into *E. coli* cells (DH56). The individual clones were picked up and grown in deep well plates in 2× YT media containing ampicillin (75 µg/ml) at 3TC for 16-18 hours under shaking at 250 rpm. All individual clones were stored in 96 well U bottom plates by mixing 220 µl of grown culture and 30 µl of 80% glycerol for long term storage.

Example 3

Sequencing, Processing and Assembly of ESTs into Contigs

Plasmid DNAs from both the subtracted cDNA libraries were isolated and purified by Perfectprep Plasmid 96 Vac Direct bind kit according to the manufacturer's instructions (Eppendorf, Germany). The quality of the plasmid DNAs was analyzed by 0.8% agarose gel electrophoresis and the good quality plasmids having appropriate DNA concentration and free from any mix up were selected for sequencing. The individual plasmids were sequenced using the BigDye terminator cycle sequencing kit (Perkin Elmer, Applied Biosystems) with M13 forward and reverse primers for 5' and 3' single pass sequencing respectively, in ABI PRISM 3700 Sequencer (Applied Biosystems, CA). Sequence base calls were made using Phred with a quality cutoff of 15. Vector filtering was performed using the cross match program (P. Green, http://bozeman.mbt.Washington.edu/phrap.docs/phrap.html) followed by trimming of low quality sequences. The sequences were individually inspected for chimeras, short reads, *E. coli* and mitochondrial sequences which were subsequently removed. The processed ESTs with 100 bases or longer were assembled into contigs by CAP3 programme using standard parameters. The final assembly of contigs and singletons constituted the chickpea gene index.

Blast Analysis, Annotation and Comparison

The EST contig and singleton sequences were annotated for homology using BLASTX and BLASTN algorithms against non redundant protein and nucleotide databases respectively. For BLASTX, an e-value cut-off of $10^{-15}$ was used and the sequences with e-value below this cutoff were then subjected to BLASTN analysis with e-value cutoff of $10^{-20}$. In addition, BLASTN was used to compare the chickpea sequences from this study to a database of legume sequences. This database included sequences of *Lotus japonicus* (gene index release 3.0); *Medicago truncatula* (gene index release 8.0); *Glycine max* (gene index release 12.0) and *Phaseolus vulgaris* (gene index release 1.0) from The Institute for genomic Research (TIGR; Quackenbush et al, 2001) and *Arachis hypogea, Cajanus cajan, Pisum sativum* and *Robinia pseudoacacia* available from NCBI taxonomy browser (http://www.ncbi.nlm.nih.gov/Taxonomy/taxonomyhome.html). The following criteria were used in stand-alone BLASTN comparison: (1) exact match bp=11; (2) e-value≤$10^{-5}$ and (3) DNA identity≥80% and 90%. Further, TBLASTX (with e-value cutoff of 1015) was used for comparing chickpea sequences to GenBank's EST_others database for the identification of chickpea specific sequences. Sequences were additionally functionally characterized in the context with the Gene Ontology (GO), Metacyc and COG. Cross species comparison of stress responsive transcriptome was carried out by searching each gene of unigene set against all classes of the stress responsive gene entries in the GO database (http://www.geneontology.org). Genes which had a match in more than one group of stress responsive genes were categorized as ubiquitous and those which were earlier known to be involved in *Fusarium* stress as found from the fungal responsive group in the GO database were categorised as canonical. Remaining of the genes which did not show any match in any of the stress responsive gene groups in the GO database were classified as non canonical.

Identification of Gene Families Using Single-Linkage Clustering

In order to identify gene families, the chickpea contigs and singletons were combined into a single dataset. TBLASTX with e-value cutoff of $10^{-15}$ was used to compare the dataset against itself. Sequences with at least one sequence in common in their BLAST reports were combined into a putative gene family.

Identification of SNPs

For the identification of SNPs, the ace file output of CAP3 programme was used as input to the PolyBayes SNP detection program along with the base values assigned by Phred for each of the contigged sequences. Perl scripts were used to parse the PolyBayes output file. The cutoff value for the probability of SNP was put at 0.99. Only base change mutations were considered in order to avoid any discrepancy in the results due to any error in the alignment. The SNPs were further divided into high-quality if minimum of two sequences from each genotype showed the same base change and low-quality if minimum of two sequences from one genotype and one from the other showed the same base change.

Example 4

Construction of cDNA Microarray

The cDNA microarray setup consisted of 6072 probes corresponding to 1749 unigenes. The cDNA clones from both susceptible and resistant libraries were amplified by performing colony PCR (1×PCR buffer, 1.5 mM $MgCl_2$, 5 units Taq DNA polymerase (Applied biosystems, USA), 0.5 mM dNTPs (Fermentas, Canada), 0.2 µM M13 primer (Sigma), 20 ng of template DNA) in 96 well format. The PCR amplified products were purified using Perfectprep PCR clean up kit as per manufacturer's instructions (Eppendorf, Germany). The quality of the PCR products was checked on 1.0% agarose gels. Five microliters of the PCR products were reorganized on the 384-well printing plates with 5 µl of 100% DMSO and printed in duplicates on the poly-L-lysine coated slides (Sigma) using a high throughput arrayer (Arrayer ESI, SDDC2) followed by UV cross linking. The spiking and other controls such as DMSO, SSC, water and previously cloned chickpea genes like 18S rRNA and actin were also printed at different locations in the chickpea microarray which were used as negative and positive controls.

Sample Preparation, Labeling and Microarray Hybridization

In order to find out the differential gene expression during host-pathogen compatible and incompatible interactions, root tissue sample were collected from *Fusarium* infected JG62 and WR 315 seedlings, respectively after different post-infection time points. Water treated JG62 and WR 315 plants were taken as control. Two biological replicates were done. Total RNA was isolated using Trizol reagent (Invitrogen, CA). 6 µg of the total RNA was used for cDNA synthesis using indirect TSA labeling and detection kit Micromax (PerkinElmer, Boston, Mass.). The RNA isolated from uninfected and infected tissue was labeled with flourscein and biotin, respectively. The labeled cDNA was purified using microcon YM 100 columns (Millipore, Bedford, Mass.). The purified flourscein and biotin labeled cDNAs were mixed and hybridized to the microarray slides in hybridization chambers (Corning, USA) at 65° C. water bath for 16 hours. The slides were washed for 10 minutes in 0.5×SSC and 0.01% SDS, 10 minutes in 0.06×SSC and 0.01% SDS and for 5 minutes in 0.06×SSC. The slides were subsequently processed for replacement of flourscein with Cy3 and biotin with Cy5 as per manufacturer's instructions. The experiment was carried out in duplicate.

Scanning and Data Analysis

Micraoarrays were scanned using Scan array 5000 scanner (PerkinElmer, Mass.) to produce two separate tiff images. Spot finding and quantification of the spots were done by using Scan array express software (PerkinElmer, Mass.). Spots appearing bad due to poor morphology, high local background and bubbles were flagged off and were excluded from further analysis. Spots with both channel intensities less than 500 were also filtered out. Spots were quantified using an adaptive method. Avadis software (PerkinElmer, Mass.) was used for further data transformation which consisted of background correction and normalization. For background correction, local background intensity of each spot was subtracted from its foreground intensity value. Due to non linearity of the data, intensity dependent Lowess normalization was applied. Cy5/Cy3 signal ratio was also calculated. Although, indirect TSA labeling was performed to generate the fluorescent labeled probe that obviates the need for control dye swap experiments, initially dye swap experiment was performed for checking the reciprocity of the gene signals that showed high correlation between the original and dye swap slides. Cross slide one class t-test with Benjamini and Horchberg FDR multiple correction was performed on the four replicate data points for each clone. P value of 0.05 and fold induction of 2.5 was used as a limit for statistically significant differences in the expression. The resulting differentially expressed gene list was uploaded for hierarchical clustering using MEV software (TIGR). Using the differential expression profile and the sequence metadata of the corresponding CaESTs immune responsive gene regulatory network models were developed.

Example 5

RNA Gel Blots and Real Time PCR

Validation of the microarray results was done by northern analysis of few transcripts. For this, total RNA was extracted from root tissue of water treated and *Fusarium* challenged plants collected after treatment using trizol reagent (Invitrogen). 20 µg of RNA was denatured in 50% formamide, 17% formaldehyde, and 10% MOPS buffer (200 mM MOPS, pH7.0, 50 mM sodium acetate and 1 mM EDTA) at 65° C. for 5 min and was separated on 1.2% agarose gel containing 22 M formaldehyde in MOPS buffer, transferred to GenScreen plus membrane (Hybond-N, Amersham Biosciences) by downward capillary blotting in 20×SSC. The DNA probes were prepared by random primer labeling and purified by passing through Sephadex G-50 column as described in Sambrook et al., 2001. After 2 hrs of prehybridization in 0.3 M Nacl, 5% formamide, 10% dextran sulfate and 1% SDS, at 42° C., the radiolabeled probe was added and hybridization was carried out at the same temperature for 16-18 h. After stringent washing, the blot was exposed to X ray film (Kodak, Rochester, N.Y.). Further, the microarray result was validated by performing quantitative real time PCR. Total RNA samples from all time points of each genotype were quantified using a spectrophotometer (Nanodrop Technologies). 5 µg of total RNA was used for preparation of cDNA using Reverse transcriptase kit (Applied Biosystems). The cDNA was diluted 10 times and qRT-PCR was performed for each clone of interest in triplicates using Sybr Green Mastermix (Applied biosystems) and ABI 7500 sequence detection system according to the manufacturer's protocol (Applied Biosystems). The relative quantification method (ΔΔ-CT) was used to evaluate quantitative variation between the replicates examined. The amplification of 18S RNA was used as an endogenous control to normalize the datasets.

Example 6

Cloning of Full Length IRF817

Full length cDNA clone of IRF817 having nucleotide sequence as set forth in SEQ ID NO: 6273 was obtained by performing 3' and 5' RACE using gene specific primers and RACE kits (Invitrogen). The gene specific primers were designed from the sequence of EST clone (CaF1_WIE_34_F11). 3'RACE was performed using gene specific primer (IRF817-3'F, 5'-AAGAAGAGGGGTAGATCGGATTCAT-3' SEQ ID NO: 6283) and UAP primer provided with the 3'RACE kit. 5'RACE was performed by using two gene specific primers (IRF817-5'R1, 5'-ATTAGGCTCAATCTTG-GAGCCTGGA-3' SEQ ID NO: 6284) and IRF817-5'R2, 5'-GTTGGTGTTGAAATTGATGGCTCTCTGGGG-3 SEQ ID NO: 6285') and AP from the kit. The amplified products were run on 1% agarose gel, purified with gel extraction kit (Qiagen) and the purified products were then cloned into pGEM-T Easy (Promega) vector. The 3' and 5' RACE products cloned in pGEM-T were named as p3'IRF817 and p5'IRF817 respectively. The clones were sequenced using standard procedure of sequencing. For the amplification of the full length cDNA, gene specific primers were designed from the nucleotide sequences as obtained from the alignment of the p3'IRF817, p5'IRF817 and CaF1_WIE_34_F11 clones. The full length cDNA was amplified by PCR using cDNA as template and the gene specific primer pair IRF817-F1 (5'-ATGGTTTCCCCGGAAAACACCAATTG-GCTTTT-3' SEQ ID NO: 6286) and IRF817-R1 (5'-TTAG-GCAACTGGTGGGCGGA-3' SEQ ID NO: 6287). The PCR product was run on 1% agarose gel, gel purified using gel extraction kit (Qiagen) and subsequently cloned into the pGEM-T Easy vector to yield pIRF817. The complete cDNA sequence was determined by automated DNA sequencer (ABI Prism 3700).

Example 7

Amplification of IRF817 from Genomic DNA and Genomic Southern

Genomic DNA was extracted using DNeasy Plant Mini Kit (Qiagen). The genomic clone of IRF817 was made by using genomic DNA as template and gene specific primer pair IRF817-F1 (5'-ATGGTTTCCCCGGAAAACACCAATTG-GCTTIT-3' SEQ ID NO: 6286) and IRF817-R1 (5'-TTAG-GCAACTGGTGGGCGGA-3' SEQ ID NO: 6287) by amplifying the genomic ORF. Genomic southern was performed in order to find out the copy number of IRF817 in chickpea. Aliquots of 10 µg of genomic DNA were digested with different restriction enzymes HindIII, Nod, NcoI and EcoRV.

The digested samples were resolved on 0.8% agarose gel, denatured and blotted onto Genescreenplus membrane (Amersham Biosciences). Immobilised nucleic acids were hybridized with $^{32}$P-labelled amplicon of IRF817 obtained using IRF817-F1 (SEQ ID NO: 6286) and IRF817-R1 (SEQ ID NO: 6287) primer pair.

Example 8

Northern Blotting

Northern-blot analysis was performed to determine the expression pattern of IRF817 in response to vascular wilt and its organ-specific expression. For this, 20 μg of RNA samples were separated on a 1.5% formaldehyde-agarose gel and then blotted onto Genescreenplus membrane (Amersham). IRF817 was amplified from its EST clone using M13 forward (5'-GTTTTCCCAGTCACGACGTTG-3' SEQ ID NO: 6288) and reverse primers (5'-TGAGCGGATAACAATTTCACA-CAG-3' SEQ ID NO: 6289). The amplicon was run on 1% gel, gel purified and the purified product was used for preparing $^{32}$P-dCTP labelled probe by random labelling using random labelling kit (NEB).

Example 9

Various Treatments and Quantitative Real Time PCR Analyses of IRF718

Different hormones were applied on two weeks old chickpea seedlings. The treatment of SA, JA, ACC, BR, 2,4-D, ABA and NO were given by spraying 1 mM, 100 μM, 500 μM, 50 μM, 50 μM, 100 μM and 1 mM respectively. For control the seedlings were sprayed with the respective buffers. The tissues were harvested at different time-points upto 12 h after the treatment. The harvested tissues were instantly frozen in liquid nitrogen and stored at −80° C. For quantitative RT-PCR, total RNA was extracted using TRIzol reagent and used for cDNA synthesis by High-Capacity cDNA Reverse Transcription kit (Applied Biosystems). The cDNA was diluted 10 times and qRT-PCR was performed in triplicates in ABI 7500 sequence detection system using SYBR Green Master Mix (Applied Biosystems) and gene specific primers IRF718RT-F and IRF817RT-R. The relative quantification method (ΔΔ-CT) was used to evaluate quantitative variation between the replicates examined. The amplification of 18S RNA was used as an endogenous control to normalize the dataset.

Example 10

Bacterial Over-Expression of IRF817

For the bacterial over-expression IRF817 was PCR amplified from T-vector clone using primers: FP (5'-GGATC-CATGGTTTCCCCGGAAAACACC-3' SEQ ID NO: 6275) and RP (5'-GCGGCCGCTTAGGCAACTGGTGGGCGGA-3' SEQ ID NO: 6276). The PCR products were digested and cloned at the BamHI and NoI sites of pGEX-4T2 (Amersham Biosciences) in order to produce the recombinant GST-IRF817 (FIG. 12). Recombinants were screened and transformed into E. coli BL21 strain for over-expression of fusion protein using 0.6 mM-1 mM isopropylthio-β-galactoside.

Example 11

Yeast Over-Expression of IRF817

For the yeast over-expression IRF817 was amplified using primers: FP (5'-CCGGAATTCATGGTTTCCCCGGAAAA-CAC-3' SEQ ID NO: 6277) and RP (5'-CGCGGATCCT-TAGGCAACTGGTGGGCGGA-3' SEQ ID NO: 6278). The PCR product was digested and cloned at EcoRI and BamHI site of pGBKT7 vector (Clontech) to express IRF817 protein fused to GAL4 DNA-BD ((FIG. 13). The construct was transformed into yeast strain AH109 (Clontech) for over-expression in yeast cells.

Example 12

Subcellular Localization of IRF817

The subcellular localization of IRF817-GFP fusion protein was studied by performing transient expression assay using onion epidermal cells. The coding region of IRF817 was amplified by PCR using gene specific FP (5'-GAAGATC-TATGGTTTCCCCGGAAAACACCAATTGGCT-3' SEQ ID NO: 6279) and RP (5'-GGACTAGTGGCAACTG-GTGGGCGGACTTCAT-3' SEQ ID NO: 6280), respectively having BglII and SpeI overhang. The PCR products were digested and cloned in frame with GFP at Bgl II and SpeI sites of pCAMBIA1302 (CAMBIA) vector to yield IRF817-GFP (FIG. 14). The empty GFP plasmid was used as a control. Plasmids were introduced in onion peel by particle bombardment (PDS-1000/He; Bio-Rad, Calif., USA) using 1 μm gold particles and further analyzed by confocal laser scanning microscope (Leica Microsystems, Germany), for subcellular localization. The cells were imaged using the 488-nm line of an argon laser.

Example 13

Plant Transformation

In order to generate transgenic lines for plant over-expression of IRF817, ORF of IRF817 was PCR amplified using gene specific primers: FP (5'CGCGGATCCATGGTTTC-CCCGGAAAACAC-3' SEQ ID NO: 6281); RP (5'-CCCGAGCTCTTAGGCAACTGGTGGGCGGA-3' SEQ ID NO: 6282). The PCR product was digested and cloned into the BamHI and SacI sites of the binary vector pBI121 (Clontech) under the control of CaMV 35S promoter. The resultant construct (FIG. 15) was further mobilized into *Agrobacterium tumefaciens* strain EHA105.

Example 14

Generation and Analyses of Transgenic Chickpea Roots

For in planta constitutive over-expression and tagging expression, IRF817-GFP and the empty vector (GFP) were introduced into *Agrobacterium rhizogenes* strain K599 by electroporation and used to inoculate 5-7 old *C. arientinum* (cv. JG-62) seedlings at the cut end of radical near the point of attachment to the cotyledon. The transformed plantlets having hairy roots were maintained on MS agar media containing 15 mg/l hygromycin under fluorescent light with a 16-h photoperiod. The plantlets with 7-10 days old transformed roots and the wild type roots were infected with $10^6$ spores/ml of *Fusarium oxysporum* ciceri race I. For mock reactions transgenic roots and wild type roots were treated with water. The resultant plants were screened by GFP expression using a Leica SP2 LCM confocal microscope.

For monitoring the fungal invasion, root segments were fixed with 4% parafolmaldehyde made in 1 μM PBS. Fixed root segments were transferred to an enzyme solution containing 10 mg/ml driselase and 1 mg/ml BSA (Sigma, St. Louis, Mo.) dissolved in 25_mM phosphate buffer at room temperature for 15 mM. After rinsing in PBS, roots were further treated with 0.5% Triton X-100 in PB for 10 min. Hyphae in root segments were stained with the chitin-specific dye WGA-Texsas Red (Molecular Probes, Germany) in PBS (10 µg/ml) followed by destaining in PBS (pH 7.4) prior to imaging.

A TUNEL assay was performed using an in situ cell death detection kit (Fluorescein; Roche Applied Science, Germany) according to the instruction manual. In addition to root fixation, root segments were dehydrated and dewaxed by passage for 15 min through series of increasing concentrations of ethanol in water (from 10% to 100% in 10% increments) and back from 100% to 0% in 10% increments). Subsequently, segments were incubated in 50 µl of TUNEL reaction mixture. Grade 1_DNase I-treated roots were used as positive controls. Solutions were vacuum-infiltrated thrice and incubated for 60 min at 37° C. in humidified atmosphere in the dark. Destaining of the segments was done with PBS (pH 7.4).

Plant nuclei were stained with 5 µg/ml DAPI for 30 min following TUNEL assay and WGA staining. During incubation in DAPI, segments were vacuum infiltrated once for 1 min at 25 mmHg (1 mm Hg=133 Pa) and then rinsed with PBS.

Confocal fluorescence imaging was done with a multichannel Leica SP2 (Bensheim, Germany) confocal microscope with a 488-nm laser excitation and 505-540 nm emission for GFP and fluorescin; 543-nm excitation and 560-630 nm emission for WGA-Texas red; and 595-nm excitation and 615-nm emission for DAPI.

TABLE 1

Chickpea library and EST characterization

| | Genotype | | |
|---|---|---|---|
| | Total | WR | JG |
| Sequence reads | 6955 | 4047 | 2908 |
| Failed base calling QC | 8 | 6 | 2 |
| Low quality sequence | 214 | 121 | 93 |
| Short insert sequence | 422 | 246 | 176 |
| No insert | 30 | 30 | 0 |
| E. coli | 0 | 0 | 0 |
| Mitochondrial | 9 | 1 | 8 |
| Total high quality | 6272 | 3643 | 2629 |

TABLE 2

Sequencing and contigging statistics of chickpea ESTs, Sequencing success was determined by removing low quality, short insert, no insert and mitochondrial ESTs from the total number of ESTs sequenced

| Genotype | Total No. of ESTs sequenced | Sequencing success percentage[a] | Good-quality ESTs used for contigging[b] | ESTs in contigs | EST singletons |
|---|---|---|---|---|---|
| JG-62 | 2908 | 90.4 | 2629 | 2316 | 313 |
| WR-315 | 4047 | 90.0 | 3643 | 2916 | 727 |
| Total ESTs | 6955 | 90.2 | 6272 | 5232 | 1040 |

TABLE 3

Comparative matching of the chickpea to the ESTs of other legume databases, the chickpea ESTs isolated in this study were compared to other legume databases like Arachis hypogea, Cajanus cajan, Pisum sativua, Robinia psedoacacia, Lotus japonicus, Medicago trunculata, Glycine max and Phaseolus vulgaris collected from NCBI and TIGR gene indices. The criteria for stand alone BLASTn were (1) exact match = 11; (2) E-value cutoff 1E5; and (3) identity >80% and 90% at DNA sequence level.

| Gene indices | Identity > 80% | Identity > 90% |
|---|---|---|
| Arachis hypogea | 1686 (83.75) | 1118 (55.54) |
| Cajanus cajan | 1764 (87.6) | 1729 (85.89) |
| Pisum sativum | 1788 (88.8) | 1599 (79.43) |
| Robinia pseudoacacia | 245 (12.17) | 79 (3.92) |
| Lotus japonicus | 872 (43.31) | 287 (14.25) |
| Medicago trunculata | 1168 (58.02) | 614 (30.50) |
| Glycine max | 1617 (80.32) | 635 (31.54) |
| phaseolus vulgaris | 928 (46.10) | 234 (11.62) |

REFERENCES

Ewing R M, Kahla A B, Poirot O, Lopez F, Audic S, Clayerie J M: Large-scale statistical analyses of rice ESTs reveal correlated patterns of gene expression. Genome Res 1999, 9: 950-959.

Gray W M: Plant defense: A New Weapon In The Arsenal. Currt Biol, 2002:12:352-354.

Jantasuriyarat C, Gowda M, Haller K, Hatfield J, Lu G, Stahlberg E, Zhou B, Li H, Kim H, Yu Y, Dean R A, Wing R A, Soderlund C, Wang G L: Large-scale identification of expressed sequence tags involved in rice and rice blast fungus interaction. Plant Physiol 2005, 138: 105-115.

Jones S: An overview of the basic helix-loop-helix proteins. Genome Biol 2004, 5: 226.

Katagiri F: A global view of defense gene expression regulation—a highly interconnected signaling network. Curr Opin Plant Biol 2004, 7: 506-511.

Koornneef A, Pieterse C M J: Cross Talk in Defense Signaling. Plant Physiol 2008, 146: 839-844.

LeBlanc J C, Gonsalves E R, Mohn W W: Global response to desiccation stress in the soil actinomycete Rhodococcus jostii RHA1. Appl Environ Microbiol 2008, 74: 2627-2636.

Li X, Duan X, Jiang H, Sun Y, Tang Y, Yuan Z, Guo J, Liang W, Chen L, Yin J, Ma H, Wang Zhang D: Genome-Wide Analysis of Basic/Helix-Loop-Helix Transcription Factor Family in Rice and Arabidopsisl. Plant Physiology 2006, 141: 1167-1184.

Melamed D, Pnueli L, Arava Y: Yeast translational response to high salinity: global analysis reveals regulation at multiple levels. RNA 2008, 14: 1337-1351.

Murre C, McCaw P S, Baltimore D: A new DNA binding and dimerization motif in immunoglobulin enhancer binding, daughterless, MyoD, and myc proteins. Cell 1989, 56: 777-783.

Nagata T, Iizumi S, Satoh K, Kikuchi S: Comparative molecular biological analysis of membrane transport genes in organisms. Plant Mol Biol 2008, 66: 565-585.

Nucci M, Anaissie E: Fusarium infections in immunocompromised patients. Clin Microbiol Rev 2007, 20:695-704.

Ramírez M, Graham M A, Blanco-López L, Silvente S, Medrano-Soto A, Blair M W, Hernández G, Vance C P, Lara M: Sequencing and analysis of common bean ESTs. Building a foundation for functional genomics. Plant Physiol 2005, 137: 1211-1227.

Sander A, Beyer U, Amberg R: Systemic Fusarium oxysporum infection in an immunocompetent patient with an adult respiratory distress syndrome (ARDS) and extracorporal membrane oxygenation (ECMO). *Mycoses* 1998, 41:109-11

Satoh K, Doi K, Nagata T, Kishimoto N, Suzuki K, Otomo Y, Kawai J, Nakamura M, Hirozane-Kishikawa T, Kanagawa S, et al: Gene organization in rice revealed by full-length cDNA mapping and gene expression analysis through microarray. *PLoS ONE* 2007, 2: e1235.

Takabatake T, Ishihara H, Ohmachi Y, Tanaka I, Nakamura M M, Fujikawa K, Hirouchi T, Kakinuma S, Shimada Y, Oghiso Y, Tanaka K: Microarray-based global mapping of integration sites for the retrotransposon, intracisternal A-particle, in the mouse genome. *Nucleic Acids Res* 2008, 36: e59.

Toledo-Ortiz G, Huq E, Quail P H: The *Arabidopsis* basic/helix-loop helix transcription factor family. Plant Cell 2003, 15: 1749-1770.

Udall J A, Swanson J M, Haller K, Rapp R A, Sparks M E, Hatfield J, Yu Y, Wu Y, Dowd C, Arpat A B, et al: A global assembly of cotton ESTs. *Genome Res* 2006, 16: 441-450.

Wellmer F, Alves-Ferreira M, Dubois A, Riechmann J L, Meyerowitz E M: Genome-wide analysis of gene expression during early *Arabidopsis* flower development. *PLoS Genetics* 2006, 2: 1012-1024.

White J A, Todd J, Newman T, Focks N, Girke T, de Ilarduya M, Jaworski J G, Ohlrogge J B, Benning C: A new set of *Arabidopsis* expressed sequence tags from developing seeds. The metabolic pathway from carbohydrates to seed oil. *Plant Physiol* 2000, 124: 1582-1594.

SEQUENCE LISTING (6289 sequences)

SEQ ID NO: 1 - DNA, 293 bp, Cicer arietinum
acattagctaaatgaccgaaagctaaggcatctttggaatatataattgatgaaagctccatctttgacttatggctccacaaaagtttcctcttgggcttcaaaagacttgataaactcttcaagctgtgcttcaatagaaaaatcatcaccaacatcaaaatcaaatgcatcatgcaacaaatcaacaacatcatcttcatgataaaagccttcatcatcatgttgctggctaagccaaaagacatgataccatgtcagtgttgtcaccagctgccaccattcaggagaaa

SEQ ID NO: 2 - DNA, 265 bp, Cicer arietinum
acagtcaatctcatcctcgctggaaaatgattcagcataggacataaatacccccttccaaaaattaattttagaaagttgccccaaataattgataaaaattatgataaggaaagaatgagtatatcgtttgaattaacttctgcacgtcttaagcttctttgatgcttgatcagacttgtcagagctagtgactctagagcgcatcttcctttgattcttagaaggatcctcatcatccttaggaacgcgcattgacattggt

SEQ ID NO: 3 - DNA, 168 bp, Cicer arietinum
acatactcgctggctccgtcagtgtagcgcgcgtgcggcccagaacatctaagggcatcacagacctgttattgcctcaaacttccatcggcttgagccgatagtccctctaagaagccagcatactgccaaagcaatacgggctatttagcaggttaaggtctcgaa

SEQ ID NO: 4 - DNA, 234 bp, Cicer arietinum
acaacggcgtcaattatcaacaacttctcaattccatgctcactactggatttcaagcttcaaaccttgctgatgccattaacgtcgttaatcaaatgctagattggaggctggttgatgaacctgtgactgaggattgtgctgacgaagagagagatttggattacagaaaatctgttaagtgtaaagtgtttttgggtttcacttctaatctcatttcatctgaatcgaatt

SEQ ID NO: 5 - DNA, 309 bp, Cicer arietinum
caaaaaagtcggtccccaatcttaatttcttcattcatcttgtcttctcatatcactttttttctgagattgatttatatattcgatcgaaatcgcttcttaattctgattccgattctcaattcttcttcttcttattctattttgacagttaaggttgaaagtaaagggtttgacttcatctgaggcggagagacatggctaacaatgcagctgcctgtgctgagagagcaaccagtgacatgctcattggtccagattgggcaatcaatatagaattgtgtgatatcattaatatggatcctaggc

SEQ ID NO: 6 - DNA, 330 bp, Cicer arietinum
acgataaatgagagaactacggttagttcaggtcatagatttcctgttccagttaatccaatgcatccaccacctcttcctggattacatggaagacaacattgtaggagctcttcagatgatgacactccatcaccttagctatatcacccatgtaagtcacttattggctttccaaaaaaaaaacctggaaccagttgattttgacatggtctggccataattgttcttttcagaatgtacaagatttctgtttatgtagattatatagagaaaaagagagagtaggagattttctttggagaaatatatactatgagtaggatatgt

SEQ ID NO: 7 - DNA, 337 bp, Cicer arietinum
acattcttcaacccactttcccctgttgtggaccccacaatggacaaaactttagcaaaaaaccttaaatcgacttgtcctaatgcaaattcaggtaatgttgcgaatttagacattagaacaccgacagtgtttgataacaaatattatcttgatttgatgaataaacaaggtttgtttacatctgatcaagatttgattaatgataagaggacaaaagggttggttaatgactttgctgttaatcagaatttgttctttgagaagtttgttgatgcttttttaaaggttagtcagttggatgttttgactggaaatcaaggtgaaattcgtgcta

SEQ ID NO: 8 - DNA, 366 bp, Cicer arietinum
gtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagcaaatgcgcctttgtgccgatgatatgctggatgaactagatgggagacgctgctggagggaagctctgctaagatcagctgtattgatgtccaatgggacgtgcttcaccgacaactactgtagggcgagctacc

SEQ ID NO: 9 - DNA, 245 bp, Cicer arietinum
ccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgta

SEQ ID NO: 10 - DNA, 436 bp, Cicer arietinum
ctaataaaccttttgaagatggatcttgaagagtgggaatcaatttctgatgatggctattttgatttcaatgaagatggtgagaaaaaaaaattcttagcaaaagggtcagaaaatattttagacatggaggattatttgtatccatcatcaccaccaagaaaacacaaccaacttgtccctttacaaattccattggaaataaaaattggtaacacttcaaatgatgttgttttgttgaaagacatgacaaagaatcaatcttttgaggttgatcaagaagaaagtgtgtcacaagtttttttaagattaaggaaaatgaatttgttgacatgaaaattgaatcaccaaagtcaaatagtggaaaagaggttactagttcaccaagaatgattattgagaaagatgtgtttggtgaaaaagaagaggaatcaag

SEQ ID NO: 11 - DNA, 384 bp, Cicer arietinum
ctttgtcggatctaacggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatccctgt

SEQ ID NO: 12 - DNA, 224 bp, Cicer arietinum
acatctctattgggaagtaaaccgttaatggccaaaaggacagtgaaccaatcaggcccagaaagtcgttgaagaatggaaatagcatagctatcaaagcagtgactacaacatatgttgttctccacactaccctgaagaagttgacatagtaggttccacatagaggaatggttacagcgtgctctccatttacaaattgactattggaccatttttcctta

SEQ ID NO: 13 - DNA, 241 bp, Cicer arietinum
acatctctattgggaagtaaaccgttaatggccaaaaggacagtgaaccaatcaggcccagaaagtcgttgaagaatggaaatagcatagctatcaaagcagtgactacaacatatgttgttctccacactaccctgaagaagttgacatagtaggttccacatagaggaatggttacagcgtgctctccatttacaaattgactattggaccatttttccttactcttactctcgacacc

SEQ ID NO: 14 - DNA, 408 bp, Cicer arietinum
actgatctattgccatggccattcttggtattatgtgacatgtacggattctgtgtgagcacctgtcgtttcctaagctcctgatccctcatcttcatcttcatgccatccgggggagacccgtagaccaggtgattacgatcaaatggagcctccaacatcaggccctcgagcgtttccacgcgagagacagccacgtagcttaaaccggtctgaaagtcctggcaggagagatccgtaacgatcatatcttctgtgatgctttgtgacttgtgcacggtaatggcgtagcatacgatcaggggaaactgcgtgcgagcgcagaaagtggctccgatgaggaagtccctctcaactgggagaatcgggacaatcttcttgccatcgggggtggtcaggaacaccggt

SEQ ID NO: 15 - DNA, 388 bp, Cicer arietinum
acaaaaagagcccccagctgtattttgggatttttactgcccagacgcttcttaagtatctttaatgcatcctttgcttgcctaggatccatattaatgatatcacacaattctatattgattgcccaatctggaccaatgagcatgtcactggttgctctctcagcacaggcagctgcattgttagccatgtctctccgcctcagatgaagtcaaaccctttactttcaaccttaactgtcaaaatagaataagaagaagaagaattgagaatcggaatcagaattaagaagcgatttcgatcgaatatataaatcaatctcagaaaaaaagtgatatgagaagacaagatgaatgaagaaattaagattggggaccgacttttttg

SEQ ID NO: 16 - DNA, 457 bp, Cicer arietinum
gatttcggagcgggccgcccgggcaggtctcacttgtctgtttcaatcatcatccatgtcgactactgctggtcaagtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaagggtcagactcctatgtttcctcgtatatttggtcatgaagctggagggattgtggagagcgtaggggagggtgtgactaatctgaaaccaggggatcatgctctgcctgtattcactggggagtgtggggaatgtccacattgtaagtctgaggaaagcaacatgtgtgatcttcttaggatcaacacagataggggtgtcatgatcaatgataaccagtcaagattc

SEQ ID NO: 17 - DNA, 336 bp, Cicer arietinum
acagggtaccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccga

SEQ ID NO: 18 - DNA, 278 bp, Cicer arietinum
ttcttctactcaatcattcatcatgggtcgtatgcacagtcgcggtaagggtatttcaagttcagctcttccttataagaggactcctccaagttggctcaagatctctactcaagatgttgaggagaccatctgcaagtttgcaaagaaaggtctaactccatctcaaattggtgttattcttcgtgactctcacggaattgctcaggtcaagagtatcaccggaagcaagattttgcgcatattgaaggctcatggtcttgctcctgaaattcccg

SEQ ID NO: 19 - DNA, 429 bp, Cicer arietinum
accacagattttggaatgagctttccaatcagattgaacagcatatttcttagaacacttatcacatttccacttcttctcaccgtgctttctacaaaagtgctttttaatgccagtaagatcaccaagggctcttgctggattgtgatgaacacatgaaggctcagggcaaacataaaccctctttcgtatttctgttgtagttctctgtttaagcttccaaggcaaattgtgacctcttcgatgcagttgaaggttttgatctctttgaaaccctttgttgcatatttcacatacgaacctgtttgttgccattagtgttgttggtgatagagctatcacttcagcacttggatctggatttcctggtaggttccttttcttcttaagaggtggttgtaaaattgtgttggaaccgttgctattatt

SEQ ID NO: 20 - DNA, 237 bp, Cicer arietinum
gaaagggcaatgatctattgaattgagcggcgaggggaagagaggagaggtggtttgaagtttgaattgaaatttgaaagcaaagcagaaaagagatttggcgacgtaatgagcaacgaatacgattacctatttaaggttcttataatcggagactcctccgttggaaagtcttgcttgcttctcagattcgccgatgactcctatgtcgatacctacattagtacctgcccgggc

SEQ ID NO: 21 - DNA, 216 bp, Cicer arietinum
ggaaatcagcctcagagaagggaacaaagatggttcagaggcttacctaccgcaggcgtcatagctatgccaccaaatccaaccaacatagggttgtcaaaacccccggtggaaagcttgtttaccagacaactaagaagagggccagtggaccaaaatgccctgttactggaaagggggttcaagggattccacatttacgacccacagagtacc

SEQ ID NO: 22 - DNA, 328 bp, Cicer arietinum
  misc_feature (285)..(285): n is a, c, g, or t
acaaggagcgaatgaccaagccaggcctacaatgctatttcatgctaagaaacttcccaacaccgatccatgcaatgctaaagtcgtaaagatgagtcattaccgatcttgacttgtcgtgaaatctgagagctggataataaggtcgtcaagattccgggttgtggtgtgttgtcgcgtttactcgacgttgatgcggcgagactcgtgtttcttggccttgggaacaacaatgctcaggataccgtccttaaacttggcagagacgttgtcctggtcgacacnagtggggaagttgaagctgcgagagaactcgccgaaggtgcgc

SEQ ID NO: 23 - DNA, 433 bp, Cicer arietinum
gggagtcgttcttctactcaatcattcatcatgggtcgtatgcgcagtcgcggtaagggtatttcaagttcagctcttccttataagaggactcctccaagttggctcaagatctctactcaagatgttgaggagaccatctgcaagtttgcaaagaaaggtctaactccatctcaaattggtgttattcttcgtgactctcacggaattgctcaggtcaagagtatcaccggaagcaagattttgcgcatattgaaggctcatggtcttgctcctgaaattcccgaagatctttatcacctgatcaagaaggcagtgtcaattaggaagcatttggagaggaataggaaggacaaggattctaagttcaggttaattttggttgagagcaggatccaccgtcttgcgcgctactataagaagacaaagaagc

SEQ ID NO: 24 - DNA, 188 bp, Cicer arietinum
cgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgt

SEQ ID NO: 25 - DNA, 159 bp, Cicer arietinum
accttattaagacatctataggaaaaaattgttccaccaaatctaacaacaaaagttataaaataagataaaacaaaacaaaacttacaaaggaaatacgcacggcattttcttctttttctctctaactcatgtctataacttgaatcattttctcta

SEQ ID NO: 26 - DNA, 355 bp, Cicer arietinum
acttgcaaatcctccctcatggaccaaataccccgacgcaaactcctctgaggtgcccaaaattcatcaccatacacagctttcacagtagcttttttagaagtctttcgaatttccacagattttctcaatttcccggagagaaaagagttggaggagagagaaagaatgtgagagtgagaagaagaaggagagggggagctgaatgtaagagaggaagagggagtgagaaaacaagtatgagacattgttaattggtgtgtgactgaagaagaagaagatgaagatgagaatggagtgttaatgcgaaagttgttgacagggaactaatacaaagcaacaaatttgatttcgg

SEQ ID NO: 27 - DNA, 285 bp, Cicer arietinum
acatacaacatcttgatctttgacttcagatacctctagccatacagaagtagtttcacttcctgtgaacaagtattgaccaataaaaatagtgtctcccttcttcactgcctgtgccagtccattgaagtttattggcaatatctccgaagaagcttcttgatcctggtcaggagttagcacaacctgaccatctgccttaagggagatagctgtctcacttttgttaacaacctgcatctctgcaccaactgtgtccagcataatagcacatagcttcttagt

SEQ ID NO: 28 - DNA, 217 bp, Cicer arietinum
gtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 29 - DNA, 343 bp, Cicer arietinum
accagcacccacggtcgttatccatggagcaacattggaaagactgtatgcactgggacccgcattcccagcggagcaagaaactaaaatccctttctccattgccgcaaaagcaccgatagctacactatctctataataatcagacataccaccaccgagtgaaagcgacaaaacattaacattgtccgaaatagccttatcaatagcagctaaaatatcggagctaaaacaaccgcctttccaacaaactttataaacagcaactctagcgcgcgtcgccatcccacgcgccgtccctgaagcataaccgaacaagctagctccggtaaccaccgaacct

SEQ ID NO: 30 - DNA, 434 bp, Cicer arietinum
acttgactggagagttcccaggtggctatggttgggacactgctgggctttctgctgacccagagacatttgcgaaaaaccgtgaactggaggtaatccacagcaggtgggctatgttgggagcattgggatgtgtgttcccagagcttttgtcccgaaatggtgttaaattcggtgaagctgtatggttcaaggctggatcacaaatctttagtgagggtggacttggctacttgggtaacccaagtttggtccatgctcaaagtatccttgctatatgggctacccaagttgttttgatgggtgctgttgaaggttaccgtattgctggtgggcctcttggtgaggtcactgacccactctaccctggtggtagctttgacccattgggcttagctgacgaccctgaagcttttgcagaattgaaggtcaaa

SEQ ID NO: 31 - DNA, 296 bp, Cicer arietinum
actcgtgctttgcacgctcggccttttgcaaggcagtaatcgctcgctggtgggtgaaaccgtaaaagatacccaggccaagggcggaccaccgcaaaacgttcactccggtcgaagccattgggaattagagtcgcaaaaaagggcgaacgggacgaagagcgaaaggatcggtattgacgatagtcggcggtcgacaatggcttgtcaatggacccagtcggagtggctcgaggggattagatgcgtcggcttgaggtgaagaattgaaaagtcgtcgggaaaagtcgcacctg

SEQ ID NO: 32 - DNA, 248 bp, Cicer arietinum
actgccgcccccgatcagaaggtgctcggcgccatggagcgagtgctcaatgtcaagttgcgaggcagcgacattggcgctcccaagttccccaacaagaagaaatgagcaattgcgtccaatgcttagacaaaagaaattgtaagagggcttcagagccgagtcgagcgttagcgaatgatgatgacatcttggttgggaaattcgggagtttcgtgtgggccgtcatgatgctttatgacatgggt

SEQ ID NO: 33 - DNA, 437 bp, Cicer arietinum
acattgtatgacccgtcagaatacactcccattgaaacaaaggtgccctcaggagttccaagaacccaatcgcgaatgtggtcacaagcagcactagcagcagatagtgcacttgacaattttctagccttgataattgcagcaccacgttgttgaacagttgttatgaattccccattcaaccaggcatcatcagaaacaagttcacggacaggcttctccccagctggagttttaacagttgcatgggtgacatcgggatactgagttgatgaatgattaccccagattatgacattctttacttcagaaacttgaatactcaatctttcagaaatttggcccaacgccctattgtgatccaatctagtcaaacaagaaatgtttttctctggaatagatggagcaaattccttcaagatcaatgcattggtatt

SEQ ID NO: 34 - DNA, 188 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacactctccagtaaccaatttgtagctcg

SEQ ID NO: 35 - DNA, 393 bp, Cicer arietinum
ttttgaggcagtaaggcattagcagctgtatcagcaatggcacccaaacagagaaccgctagggtaagcagaaaccccgatttgatcaggggcaatcggaaaatactcaaaatctgccatgtaccacaagagaggtctctgggccatcaaggccaaacacggcggcgctttccctaaacatgatcccaaacctaagcctgaagctcccgctgagaaggctcctaaattctaccccgccgatgatgtcaagaagccacttcgcaacaagcacaaacctaagcctactaagctcagggctaacattactccagggacagtgttgattcttcttgccggtagattcaagggaaagagggttgtgtttttgaaacagcttccttctggccttcttct

SEQ ID NO: 36 - DNA, 128 bp, Cicer arietinum
acaaaaatcctgtgccaccctctttccacacacgccacatgacagcacgatgctgagtgcctcgcattccaagatgccaatttggatgaggatctgatggtcccatacagacatatgtccaccattcc

SEQ ID NO: 37 - DNA, 285 bp, Cicer arietinum
actaagaagctatgtgctattatgctggacacagttggtgcagagatgcaggttgttaacaaaagtgagacagctatctcccttaaggcagatggtcaggttgtgctaactcctgaccaggatcaagaagcttcttcggagatattgccaataaacttcaatggactggcacaggcagtgaagaagggagacactatttttattggtcaatacttgttcacaggaagtgaaactacttctgtatggctagaggtatctgaagtcaaagatcaagatgttgtatgt

SEQ ID NO: 38 - DNA, 125 bp, Cicer arietinum
acaggaaaccccgcttccttcaccatccagcataccaatggcacaaaaggtgctgtatttctcaagcccgtcacccgtcagcgggttcgggggcaatctattgtcgaactttttccaccgaccac

SEQ ID NO: 39 - DNA, 333 bp, Cicer arietinum
  misc_feature (285)..(285): n is a, c, g, or t
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacnagtggggaagttgaagctgcgagagaactcgccgaaggtgcgctcggt

SEQ ID NO: 40 - DNA, 423 bp, Cicer arietinum
ttgcgtggtcccggccgaggtatactggaagccatacaagtatccttcaccaccacctccaccagtttatacttcacctccttacattccacacccagtttatcactcacctccacgaccagatcatacttctcccccatacattccacatccagtttaccactctccaccaccaactccaaccaagaagacttacctctattcctcacctcctcctccttaccactattagatagtaaacaataatagtggtttattaccatagctctctatgaaagattatgaagaatatatgaaaataaagaaagtgatggaaggaagatacatcgaaagagaaaaaagggaagcgaagtttccgcgttttgtcttcaggaaagaaaaggcgttaatttttctattatatggtgataagattgttattgt

SEQ ID NO: 41 - DNA, 328 bp, Cicer arietinum
  misc_feature (285)..(285): n is a, c, g, or t
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgaccgnagtggggaagttgaagctgcgagagaactcgccgaaggtgcgc

SEQ ID NO: 42 - DNA, 280 bp, Cicer arietinum
gacgttttatatgtgtttcccaaagattatcgatcaaagctcggtgccaagtcatttaggattaaagctgaaccttttattgaaaaagctaagggcgccggagaatacttgataagagtttcttttgggacagcacttattgcatccattgttattgtttacactgcaataattgctcttgtaactagcagcagaagtgacgaggacaatcgtggcagacgtggaagtagatcatatgattcaggatttactttcttctttaatccggctgatttattct

SEQ ID NO: 43 - DNA, 364 bp, Cicer arietinum
ctctcctatcaacaatttttgtttcccgaaataccctcccaaatacgtcaaattcccttcgctgccactttctgcacttccgcgttcttcacctgctccgatggaagctcctcccgaaggttaccgcaggaacgttggaatctgtctcatcaataatcacaaaaagattttcgcagcttcaaggctagacattcccaatgcttggcaaatgcctcagggtggtattgatgaaggtgaggatccgagaaatgctgctattagggaactaagagaagaaacaggtgttagttcagcagaagtgattgcagaggcaccttactggttaacttacgacttcccaccaaaagtcagggagaaattaaac

SEQ ID NO: 44 - DNA, 162 bp, Cicer arietinum
gattagagaaaatgattcaagttatagacatgagttagagagaaaaagaagaaaatgccgtgcgtatttcctttgtaagttttgttttgttttatcttattttataacttttgttgttagatttggtggaacaattttttcctatagatgtcttaataaggt

SEQ ID NO: 45 - DNA, 296 bp, Cicer arietinum
acctctcaccagaagcaacagtgcaatgacagacacaggaaattgtccctaaaggttcgggagtcagattctactgatacttttgtgattccagcttcattgaaagttgaccatgatgactgcaaatacccaggagatccatctattttcagttcctcggtcgtgccatctttaactaacatggttatgtgtaggtgactccatgttgttttctatagaatggtgtctacttttcgggttatctagttttttcattccatttagcacaaacactatttatatttaatctttaaacc

SEQ ID NO: 46 - DNA, 328 bp, Cicer arietinum
accaatggcccaaactggctcataggccaaaacaacattatcccaatttgatactttagctgcaattgcctttgtttgctcagcaacaacagcgattgtagttccagcttcacgctcctcaagagtctcaccgatgcaagcaataactttcctccctagtgaaagtgcatacgcaactttatctccgacaaactcatttgattcatttagaagctgccttcgttcagagtgaccaagaataacccagggaatatccaaattaacaagcatttcagcactaatctctccggtataagcaccacctttgcgaacccaacagttttgagca

SEQ ID NO: 47 - DNA, 352 bp, Cicer arietinum
acgagaatttggaggcggagaagatgcgccgaagtcagctccaggagcccgagtaggcgactaatgttttttttaaacctctttgagttttgcttttctcgtgttccttgcgacttgcagaggtcagttctggcaaggtgagctgggacacgtccagatctgacttgccgcgaggcttgtattttcattttcggacgataccagacgacagcgtcacgagcggccaatccacttgtccaaccatttggccccttccacagaaaaacgaaaccttttatcatcagtcatcgtcatcaaattcgttttcctttcatgattcttccccctctcgttaccattggtacctgcccgg

SEQ ID NO: 48 - DNA, 327 bp, Cicer arietinum
  misc_feature (285)..(285): n is a, c, g, or t
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgaccgnagtggggaagttgaagctgcgagagaactcgccgaaggtgcg

SEQ ID NO: 49 - DNA, 279 bp, Cicer arietinum
agagaattcgattcccagagttcgacattgtttccaacgctagttttcgcaccaactgccggaaaaccacttgctaaggctatcaatgacaggtctggcattgttgagggtttgatgaccaccgtccattccatcactgccactcagaagactgttgatgggccatcagccacagactggagaggtggaagagctgcctcatttaacatcattcctagcagtaccggagctgctaaggttgttggcaaagtgtttcctgttttgaatggaaaattgacc

SEQ ID NO: 50 - DNA, 415 bp, Cicer arietinum
acagagcttacctggagaccgtggaacgaggcgactacctcgtccacagagcagcgttctagccgccttgggtttttccctgcgaggggtttccccaaggatgtatggtcctaggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctacgagtagagaggtgcctcttgggggtaatgagc

SEQ ID NO: 51 - DNA, 390 bp, Cicer arietinum
actaccactcagggaaagtctcctgttaaaaccattgtgaatctgaagagtgatcctgatcatcttcttgtccttgtccatggtatctggtctagcccaagtgactggagttatacggaggctgagttaaaaacgcaccttggaaaaagctttttaatatatgcaagttcatcaaacgcctacactaagacatttactgggattgatgaagctggaaagcgattagctgatgaagtcatgcaagttgtaaagaagacaaagagcctgaagcgaatttcctttgttgcccattctcttggaggcctctttgctagatatgcaatttctgttctttattcacctgatacctataatagcggccaacttggtgattcaatgaactgcatgatg

SEQ ID NO: 52 - DNA, 208 bp, Cicer arietinum
actcttcaaccatcttgcttgtcatataaatgtgccttgtattaattccagtgaacagattgtcaaagacatgtcctccacatttcagggccatcacaacctcttccaacgaggcatttccagccctttcaccaatcccattaattgtgacttccagctgcctagcaccagcgcgtgcaccctctatggtgttagcagtagataaacc

SEQ ID NO: 53 - DNA, 304 bp, Cicer arietinum
tgactcgctaatcgatcttcgtcgaacccaaaaaaaaaaaaaaacaattcaagatcgctgaaagtcagctttattttcttcactataagatctagttgaatcttaacctcaaactttcgattcgaagctcaaatcactgaaatcgaaccttcttcagatctggtggatttgttttcgattttcattttgtcgttcgtgaaatgtcggtttcatcgaaaggagattcggttcaaattagagaggtttggaacgataatctcgatgaagaatttgcattgatccgtgaaatcgttgaccaattcaa

SEQ ID NO: 54 - DNA, 208 bp, Cicer arietinum; identical to SEQ ID NO: 52

SEQ ID NO: 55 - DNA, 280 bp, Cicer arietinum
gaaaaatgtcggacgaggaacaccatttcgagtccaaggctgatgctggagcatcaaagacatatccacaacaagctggcaccattcgcaaaaatggtcacattgttatcaaaaacagaccctgcaaggtagtggaagtttcaacttcaaaaactgggaagcatggtcatgcaaagtgtcactttgttggtattgacatcttcactggcaaaaaacttgaagatattgttccttcttctcataactgtgatgttcctcacgtcaatcgcactgactacca

SEQ ID NO: 56 - DNA, 192 bp, Cicer arietinum
cgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgtacct

SEQ ID NO: 57 - DNA, 206 bp, Cicer arietinum
caacgccaaccgcaatagtcggctctcaatattgtgctccatatccacttgatcttgcgttggttaaaaaagttgggaccttttcacatggaaacttcgccgtcactgatgttaacggcaacatcgttctcaaagttaaaggttccattctaacccatgattaccgtgtcttctttgatgccgccggtaaccccatcctcacccta

SEQ ID NO: 58 - DNA, 305 bp, Cicer arietinum
cacaaaacgagcggctactcccacagcctctgcaaaattcccaacctcactccaccatggctgaacagactgagaaggcttttctgaagcaacctaaagtgtttctgtgctctaagaaatctgggaagggaaagaggcctggaaaaggtggaaaccgcttctggaaatctattggtcttgggtttaagactcccagagaagctaccgaaggaacctacattgacaagaagtgtccattcactggaaatgtttccatccgaggtcgtatcttagctggcacttgtcatagtgctaaaatgaatcgt

SEQ ID NO: 59 - DNA, 435 bp, Cicer arietinum
acatcgatgttgccagcttcaatttcctctcgtatgtggtgttcgactaaagggatatgctttgttcgttgatgtagctcgggatttctgcagagtttcagagaaccctgattatcgccattcaaaaggatcggaatgtctagtgatagttgtagttctgagaacagattccgaatccatgttaattctctggcgcattgtgatagagcagtatactcggcctcggtagttgagagtgctactgtttcatgtcgtttcgctctccatgagaccgtagattcttcaagctgaacgagccatccaaacgtcgatcttcctgtgaaattgtcgcctttccaatcagagtcggcccaggccgtgacgctccaagcgtctttgggatctttcctaacgcccccaagcactaggccgtggtgtttcgtctgttgtaaatag

SEQ ID NO: 60 - DNA, 326 bp, Cicer arietinum
accaccactctcagtcagcagactcacaaatccatcctctgagatatcaataagctggtagtcagtgcgattgacgtgaggaacatcacagttatgagaagaaggaacaatatcttcaagttttttgccagtgaagatgtcaataccaacaaagtgacactttgcatgaccatgcttcccagtttttgaagttgaaacttccactaccttgcagggtctgtttttgataacaatgtgaccatttttgcgaatggtgccagcttgctgtggatatgcctttgatgctccagcatcagccttggactcgaaatggcgttcctcgtccg

SEQ ID NO: 61 - DNA, 208 bp, Cicer arietinum
ggtttatctactgctaacaccatagagggtgcacgcgctggtgctaggcagctggaagtcacaattaatgggattggtgaaagggctggaaatgcctcgttggaagaggttgtgatggccctgaaatgtggaggacatgtctttgacaatctgttcactggaattaatacaaggcacatttatatgacaagcaagatggttgaagagt

SEQ ID NO: 62 - DNA, 310 bp, Cicer arietinum
actcatccccccaagaggcacctctctactcgtagccagctctacagtagttgtcggtgaagcacgtcccattggacatcaatacagttgatcctcgcagagcttccctccagcagcgtctcccatctagttcatccagtatatcatcgacacaaaggcgcatttactttcaagaggtcatcccgtcagcgggatctattcctctccagcctagaattctcttgcacggatagatcaagtagctttccataccctgaggcaggaagtccatgatcccctaagatcgccagtagctgcaacctaggaccgt

SEQ ID NO: 63 - DNA, 384 bp, Cicer arietinum
accgacgaaatggtgtatgggctgtcccttgatagagaatcttgactggttatcattgatcatgacacccctatctgtgttgatcctaagaagatcacacatgttgctttcctcagacttacaatgtggacattccccacactccccagtgaatacaggcagagcatgatcccctggtttcagattagtcacaccctcccctacgctctccacaatccctccagcttcatgaccaaatatacgaggaaacataggagtctgacccttagcttcccagaagtaaacatcagtgtgacaaagggaggtgaagagtatcttaagacggacttcaccggcttgtggtggcgccacctccacttcttctatcaccagcggcttccccgc

SEQ ID NO: 64 - DNA, 459 bp, Cicer arietinum
gattcccagagttcgacattgtttccaacgctagttgtaccaccaactgccttgccccacttgctaaggttatcaatgacaggtttggcattgttgagggtttgatgaccaccgtccattccatcactgccactcagaagactgttgatgggccatcagccaaagactggagaggtggaagagctgcctcatttaacatcattcctagcagtaccggagctgctaaggctgttggcaaagtgcttcctgttttgaatggaaaattgaccggaatggcattccgtgtcccaactgttgatgtctcagttgttgaccttacagtgaagcttgagaaggccgctacctacgacgaaatcaaggctgctatcaaggaggagtctgagggcaagttgaaaggcattctcggatacactgaagatgatgtggtctccaccgacttcattggtgatactaggtcaa

SEQ ID NO: 65 - DNA, 179 bp, Cicer arietinum
gattactggagattgtggactgcgtcagcagatgtagtgatgcgcgagagaattctggtcggtggaaaaagttcgacaatagattgcccccgaacccgctgacgggtgacgggcttgagaaatacagcaccttttgtgccattggtatgctggatggtgaaggaagcggggtttcctgt

SEQ ID NO: 66 - DNA, 280 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttccccttt

SEQ ID NO: 67 - DNA, 342 bp, Cicer arietinum
accaatggtaacgagagggggaagaatcatgaaaggaaaacgaatttgatgacgatgactgatgataaaaggtttcgtttttgggtggaaggggccaaatggttggacaagtggattggccgctcgtgacgctgtcgtctggtatcgtccgaaaatgaaaatacaagcctcgcggcaagtcagatctggacgtgtcccagctcaccttgccagaactgacctctgcaagtcgcaaggaacacgagaaaagcaaaactcaaagaggtttaaaaaaaacattagtcgcctactcgggctcctggagctgacttcggcgcatcttctccgcctccaaattctcgt

SEQ ID NO: 68 - DNA, 355 bp, Cicer arietinum; identical to SEQ ID NO: 26

SEQ ID NO: 69 - DNA, 335 bp, Cicer arietinum
accaccactctcagtcagcagactcacaaatccatcctctgagatatcaataagctggtagtcagtgcgattgacgtgaggaacatcacagttatgagaagaaggaacaatatcttcaagttttttgccagtgaagatgtcaataccaacaaagtgacactttgcatgaccatgcttcccagtttttgaagttgaaacttccactaccttgcagggtctgtttttgataacaatgtgaccatttttgcgaatggtgccagcttgttgtggatatgtctttgatgctccagcatcagccttggactcgaaatggtgttcctcgtccgacatttttc

SEQ ID NO: 70 - DNA, 179 bp, Cicer arietinum
gattactggagattgtggactgcgtcagcagatgtaccgatgcgcgagagaattctggtcggtggaaaaagttcgacaatagattgcccccgaacccgctgacgggtgacgggcttgagaaatacagcaccttttgtgccattggtatgctggatggtgaaggaagcggggtttcctgt

SEQ ID NO: 71 - DNA, 342 bp, Cicer arietinum
accaatgttaaccagagggggaagaatcatgaaaggaaaacgaatttgatgacgatgactgatgataaaaggtttcgtttttgggtggaaggggccaaatggttggacaagtggattggccgctcgtgacgctgtcgtctggtatcgtccgaaaatgaaaatacaagcctcgcggcaagtcagatctggacgtgtcccagctcaccttgccagaactgacctctgcaagtcgcaaggaacacgagaaaagcaaaactcaaagaggtttaaaaaaaacattagtcgcctactcgggctcctggagctgacttcggcgcatcttctccgcctccaaattctcgt

SEQ ID NO: 72 - DNA, 188 bp, Cicer arietinum; identical to SEQ ID NO: 24

SEQ ID NO: 73 - DNA, 170 bp, Cicer arietinum
tcacaccaatccaatactctaatttgtgtttgcatcttcacatcatcaaaaaaacagaaagatgaacaacagtgatgatgacaagggtttgttgtggaagcttccggttgtgaagtctaacaacttcggtaaagtgggccccgcattcggttttggtgctggttgcggtt

SEQ ID NO: 74 - DNA, 157 bp, Cicer arietinum
acagagcttacctgtagaccgtggaatgaggcgactacctcgtccacagagcagcgttctggccgctttggggttttctcctgcaagggttttccccaaggatgcacggtcctaggttgcagctactggcgatcttaggggatcatggacttcctgc

SEQ ID NO: 75 - DNA, 438 bp, Cicer arietinum
aaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgaca

SEQ ID NO: 76 - DNA, 302 bp, Cicer arietinum
accgcaatcactaacaaccgacgagcagatcatgctgaaggatgtaagtaacagaattcgtgttagagggatcagtaaaagcttggacttcgacaatgtgaagatggggttgacagataacaaaagaatgatcaaaagtagcagttactcatcagctagtagaaacaaggaattatcttttaacagaatttgctctaagcttcctgtgattgattttggtatcgacaaaaatagagcactggatgtgattgacagagtggctgtggccagataatttgcgcagactattcttaagcgccttt

SEQ ID NO: 77 - DNA, 176 bp, Cicer arietinum
actggcaacgtggccggctgctttcgccgtttgctttgtcgttcttgagagtcaggacggaccagtgatcgactaaatgctaatcggcgctcaatatagtccaaggcactattgctctcagatgctgaaacggcattgcaggccacctcatgagccatgtccttgtacttctcttc

SEQ ID NO: 78 - DNA, 320 bp, Cicer arietinum
ttaaaatggaaaaatctctcatactgaaatattaacctagcaactacgagatccaaaagttacccaattctgaagtagacgacataatcaaaatatagaaacattcaaacaccaaggaagtctgaccctaccaactgcacttagataataaaatccttcaatgactttgacaagaccattcattcacattgaccaaatcacggaatattatcaagacagcagcaacgggtgcactagtcaaggtgtctctggaatacttctgaaaaatcacttattcatcgccatttgaatttcggggagatgggcttcgggaagcttta

SEQ ID NO: 79 - DNA, 296 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgtcgtggcggcagggaaaaacctcgggaagggatcagaggccggcggtgcggcttgccttcaaaggagaaaaacccatcgcaatcggcgtcgttgatcgg

SEQ ID NO: 80 - DNA, 472 bp, Cicer arietinum
gggagtcgttcttctactcaatcattcatcatgggtcgtatgcacagtcgcggtaagggtatttcaagttcagctcttccttataagaggactcctccaagttggctcaagatctctactcaagatgttgaggagaccatctgcaagtttgcaaagaaaggtctaactccatctcaaattggtgttattcttcgtgactctcacggaattgctcaggtcaagagtatcaccggaagcaagattttgcgcatattgaaggctcatggtcttgctcctgaaattcccgaagatctttatcacctgatcaagaaggcagtgtcaattaggaagcatttggagaggaataggaaggacaaggattctaagttcaggttaattttggttgagagcaggatccaccgtcttgcgcgctactataagaagacaaagaagcttccacctgtttggaaatatgaatcaacaactgccagca

SEQ ID NO: 81 - DNA, 393 bp, Cicer arietinum
actctgacagcacaactatatcactgatcatcttcttaagccacaagagtgctggcagttgttgattcatatttccaaacaggtggaagcttctttgtcttcttatagtagcgcgcaagacggtggatcctgctctcaaccaaaattaacctgaacttagaatccttgtccttcctattcctctccaaatgcttcctaattgacactgccttcttgatcaggtgataaagatcttcgggaatttcaggagcaagaccatgagccttcaatatgcgcaaaatcttgcttccggtgatactcttgacctgagcaattccgtgagagtcacgaagaataacaccaatttgagatggagttagacctttctttgcaaacttgcagatggtctcctca

SEQ ID NO: 82 - DNA, 382 bp, Cicer arietinum
acttaaactaagacacggatcttatgatataagattaaggtccttaaatttgattagtgaaaattgagatctaaattgaagagaaaaaggttttgttttgttttgttttgtttttgtttcacttaaatggagagttttggtatcttaagcaacgccaattagcacaattctttaaacagctactatacaaccatttatctccattaactcccatgtgtctacctttcttttttctcaacacttgttcttttcccttttcttcacccatcaaacaattccaacacaacaacaaagtgaccaattaatatgtatgtttttttgacaacactgttttggtctcttattattcttctacatcattacactttcaaattttataggt

SEQ ID NO: 83 - DNA, 435 bp, Cicer arietinum
acttaaactaagacacggatcttatgatataagattaaggtccttaaatttgattagtgaaaattgagatctaaattgaagagaaaaaggttttgttttgttttgttttgtttttgtttcacttaaatggagagttttggtatcttaagcaacgccaattagcacaattctttaaacagctactatacaaccatttatctccattaactcccatgtgtctacctttcttttttctcaacacttgttcttttcccttttcttcacccatcaaacaattccaacacaacaacaaagtgaccaattaatatgtatgtttttttgacaacactgttttggtctcttattattcttctacatcattacactttcaaattttataggttgttgagaagaaaacaaagaaagatgagtgggagattggaaatgaagaaagaa

SEQ ID NO: 84 - DNA, 434 bp, Cicer arietinum
acttaaactaagacacggatcttatgatataagattaaggtccttaaatttgattagtgaaaattgagatctaaattgaagagaaaaaggttttgttttgttttgttttgtttttgtttcacttaaatggagagttttggtatcttaagcaacgccaattagcacaattctttaaacagctactatacaaccatttatctccattaactcccatgtgtctacctttcttttttctcaacacttgttcttttcccttttcttcacccatcaaacaattccaacacaacaacaaagtgaccaattaatatgtatgtttttttgacaacactgttttggtctcttattattcttctacatcattacactttcaaattttataggttgttgagaagaaaacaaagaaagatgagtgggagattggaaatgaagaaaga

SEQ ID NO: 85 - DNA, 271 bp, Cicer arietinum
acttcctccaccaaaagtccacttgctggaagtcctgataatcgtagccaggatggaaggtctcttacccctcgcagtgtctcaccgcaaggtcgccctaaagcttcccgaagcccatctccccgaaattcaaatggcgatgaataagtgatttttcagaagtattccagagacaccttgactagtgcacccgttgctgctgtcttgataatattccgtgatttggtcaatgtgaatgaatggtcttgtcaaagtcattgaaggattttat

SEQ ID NO: 86 - DNA, 461 bp, Cicer arietinum
gagacatttgcgaaaaaccgtgaactggaggtaatccacagcaggtgggctatgttgggagcattgggatgtgtgttcccagagcttttgtcccgaaatggtgttaaattcggtgaagctgtatggttcaaggctggatcacaaatctttagtgagggtggacttgactacttgggtaacccaagtttggtccatgctcaaagtatccttgctatatgggctacccaagttgttttgatgggtgctgttgaaggttaccgtattgctggtgggcctcttggtgaggtcactgacccactctaccctggtggtagctttgacccattgggcttagctgacgaccctgaagcttttgcagaattgaaggtcaaagaacttaagaacggtagattagccatgttctctatgtttggattctttgttcaagctattgtcactggaaagggtcctttggagaacct

SEQ ID NO: 87 - DNA, 461 bp, Cicer arietinum
accaagatgaagttaccaagatatgataaatctgcatttggtgggagaggtgatcgggctgatccatcgacatggcctgaaattgaagggcccctaacagttgtgttgtttgaaggctggatgcttggtttcaaaccccttccagttgatgctgtaacgtccgttgatccccagctagaaacagtaaataaaagccttgaagcttattatgatgcatgggacaaatatatagattcatggatagtcattaagattaaggacccaaattgcgtctttcagtggcgcttgcaggctgagattgcaatgagggaagcaggcaatcctggaatgtctgatgatgaggtgagagattttgtttctcgctacctgccagcatacaatgcataccttcctacactttattcgcagggtccgaatggatcagatcctcaacatctactatccatcgaaatagacgaaaa

SEQ ID NO: 88 - DNA, 127 bp, Cicer arietinum
gaataatataatgccaacacttggctggagttcgcgatgtgccaggaaaccagaacagccttgagatcgatagtctcgcccgctatgctgttgaggaacacaacaaaaaacagaattctcttctgga

SEQ ID NO: 89 - DNA, 299 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggt

SEQ ID NO: 90 - DNA, 338 bp, Cicer arietinum
cgccaagagaacagaatctagtagaatgggctagaccagtgttaaacgatccacgaaaacttagtagaataatggatccaaggcttgaaggacagtattcagagatgggggcaagaaaagcagctgcattagcctatcaatgcttaagtcacaggccaaggaatagacctacaatgtctaatgtggttaacactcttgagcctctacaagattttgatgatattccaattggaccctttgtttacacggttccaaatgatgttaacaatgaagttcaaaaagagtgtgttattgagacaccaaaagagagaagaagggaaagtagtgggagtagtagt

SEQ ID NO: 91 - DNA, 214 bp, Cicer arietinum
gtatcctttcccagttgacccaaaggtttcaatagcataaaattccccctcttccatctttgtctgctctccacctttcacaatgggaacagattttccagcatgaatttgatagcggccaatgctatgtccattcaaattccgcatactcttgacttgatacaccttcccattaatctcaacctcataagactccatgacctcttgaattgcc

SEQ ID NO: 92 - DNA, 465 bp, Cicer arietinum
gatttcgagcgggccgcccgggcaggtcaagatctaggctaaggaaggtattcccccagatcagcagaggttgatcttcgccggaaagcagctggaagatggaaggaccctcgctgattacaacatccagaaggagtctacccttcaccttgtgttgcgtcttcgtggtggtatgcagatttttgtgaagaccttgactgggaagacaattacccttgaggtggagagctctgataccattgataatgtgaaggcaaaaattcaggataaagaaggtatcccaccggaccagcagaggttgatctttgcagggaagcagttggaggatggaaggacccttgctgattacaatattcagaaggagtccacccttcaccttgtgctccgtcttcgtggtggtttctaatctgtggctgtgggattaatatctgtctgatgtttcttttacttgttgtggaagtgata

SEQ ID NO: 93 - DNA, 258 bp, Cicer arietinum
actgaaatggaaaagacgaaaacgcccaaagggaccacttcattttgcactcctcaacattattcttcgggggaaattaattaacaccatagactcattgacaaataagtgatagatagaggtgaattaattaagcattgcttctgaaggatccaagagctttaatggctgatcctctaagaatgtattggtggtatattgcagccactgtagctccaataattggatcaacccagaatatccactggtcatcccaaa

SEQ ID NO: 94 - DNA, 228 bp, Cicer arietinum
actactatcacgaagagattacgccttctagacgatacacaggtcatcatcaccatcaccaccatcaccaccatcactcacgctctccccgagcaagctacaccagtgtctctagacggtcctacagccacagcccacgaaacagtggcactgttgtctatgagcgctattgatcatctgaaggcaccaatgctgaattgtgggtgtaattagagacgatgacgttgt

SEQ ID NO: 95 - DNA, 228 bp, Cicer arietinum; identical to SEQ ID NO: 94

SEQ ID NO: 96 - DNA, 228 bp, Cicer arietinum; identical to SEQ ID NO: 94

SEQ ID NO: 97 - DNA, 312 bp, Cicer arietinum
acaaagcagagaaacagagcgttggagagaagttgtagctgttccaacacttgtaacatcaccggcacttcttctacgtgaacgattttgattgcatccatttacatgaggaacttgaagctgctccaaatttgtaacaacctcatccatgtttggtctcaactttgcttctattgaaatgcaccttacggagagtgtggcaaccttgtaggcatcatctaattcatattggccttcaaggcgattatccaacacgcgcaaaaccttacgcttgttggatagataaggcctagcccattccaccaaattgtg

SEQ ID NO: 98 - DNA, 344 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcgtccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaacccctcgcagggaaaaa

SEQ ID NO: 99 - DNA, 467 bp, Cicer arietinum
accagagtttctaaccccgaggctacctactaggttccatcatttctcctttccgatcgttctcctccgcggacccacgctactacgaccccggagcttttcagcactgtctcaattcaacatacctacctaatacgtttgtcccaggagaataaacgaatactacagccaaaatgtcgccaaccgaggagaagagtgacgatatcgatttcggtgacaacatcgatatgactactttcgagcagatcctcgaaatggacgagccaggcgattgtgaattcagctcttctattgtatttggcttcttcgagcaagcggaagaaacgtttgaacagataaaggaggcattggaagaggaagatcttgataagctctcgtctcttggacacttcctcaagggctcatcagcgaccctcggactcatcaaaatcagggatggttgcgaaaagattcagcgttatggcaag

SEQ ID NO: 100 - DNA, 462 bp, Cicer arietinum
gatttcgagcgggccgcccgggcaggtactgagaaagctgttaaattgggtgaaaggaaggaactcaaaccgactatgtcaaccatcggtggcactgcgcagtgtcaaaagtgtttccagagtggtcactggacgtatgaatgcaagaatgagcgggtttatatttcgagaccgtctcggacacagcaacttaaaaaccctaaattgaggccggatgtgtctgtgagttatgatttagatgatgatcatcgtgaggctaaggatgaaaaggctaaagtgagttccaaaaaggccaagaggaaacatccagctgcctctgattctggtagtgatagtgaggattcggtgtttgagactgatagtggaagtgggtcgtcgtctgttactggatcggattattcttctgaaagttccagctcatcatctgattcagaggaagaaaggaggcggaggaagaagaag

SEQ ID NO: 101 - DNA, 352 bp, Cicer arietinum
cggccgaggtactcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaa

SEQ ID NO: 102 - DNA, 372 bp, Cicer arietinum
acctaactgaaaagcctctttgcaaactgcacagtgtgattccatatccaaatgacacccattgatttcaatagttggtaatgaatcaacggctgtttttgaagctggtggatgttcatatcttccaatatcgttgatttcaatctgagaaagttgttctaacagtctatcaaatccagatcccaaaagaaactctgacatacttggtggtaaaggtctaagaccagaaccagcaccatcatcatagaaaagctcaaacccacgactctctcctgtgctaccaccttctgttacctccgttgatccacttccgcgtaggacgatcaccggattgaaaggtgaccggtcacctccgttgcggcgggttcgacg

SEQ ID NO: 103 - DNA, 470 bp, Cicer arietinum
agaaaacggaatctgataaagatgtattagaaaaggaaattgatgaagtgaagaaggagcttcagaaaattaatgaaaactcgtctaatccatcacaaccacaaccattacacaataaaccctcttcgaataaagctttaatcaatttggatatcgacgtgaagattataggttgggatgcaatgataagaatccaatgcagtaagaaaaaccaccctgcagcgaggttgatggcagcgttgatggagcttgaccttgaagtgcaccatgccagtgtgtcagtggtgaatgatttgatgatacaacaagcaacagtgaagatggggggtcgattttacacccaggagcagcttagggcagcattgtcatctaaagttgggggtgtttcatgagtctgcaaatttgctgcaatgagaaattgggaatgttatgtctgtgatttctcattcctccaaagttgttggcctcta

SEQ ID NO: 104 - DNA, 337 bp, Cicer arietinum
cggtctcctcgctatttacgtccttgcccagttcttcttcaacttcggccctaacactaccactttcatcgtccctggtgaggtcttccctacccgctaccgatctacctcccatggtatctccgctgcctcaggaaagattggttccatcattggccagggtgccatctccatcctccgcacccacggtgccaccgacaagaacgaggccccctggatggaccacgtcctcgagatctatgctctcttcatgcttctcggtatcttcactactctccttatccctgagactgcccgtaagactcttgaggagctcagtggtgaggatgactatgcc

SEQ ID NO: 105 - DNA, 319 bp, Cicer arietinum
actcattcccccaaaaggcacctctctacccgtagctagccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggatctattcctctccagcctagaattctcttgcacagatagatcaagtagctttccataccctgaggcaggaagtccatgatcccctaagatcgccagtagctgcaacctaggaccgtgcatccttg

SEQ ID NO: 106 - DNA, 447 bp, Cicer arietinum
gagacatttgcgaaaaaccgtgaactggaggtaatccacagcaggtgggctatgttgggagcattgggatgtgtgttcccagagcttttgtcccgaaatggtgttaaattcggtgaagctgtatggttcaaggctggatcacaaatctttagtgagggtggacttgactacttgggtaacccaagtttggtccatgctcaaagtatccttgctatatgggctacccaagttgttttgatgggtgctgttgaaggttaccgtattgctggtgggcctcttggtgaggtcactgacccactctaccctggtggtagctttgacccattgggcttagctgacgaccctgaagcttttgcagaattgaaggtcaaagaacttaagaacggtagattagccatgttctctatgtttggattctttgttcaagctattgtcactggcaagggt

SEQ ID NO: 107 - DNA, 441 bp, Cicer arietinum
acctctaccaagctaacctatgaatatgcagctccagaatacctagccaatggtaatcacactactaagagtgatgtctataattttggagttgttctactggaaatattatcaggaaggagagttattgacaagaatagaccacacaaacaacacaatttggtggaatgggctaggccttatctatccaacaagcgtaaggttttgcgcgtgttggataatcgccttgaaggccaatatgaattagatgatgcctacaaggttgccacactctccgtaaggtgcatttcaatagaagcaaagttgagaccaaacatggatgaggttgttacaaatttggagcagcttcaagttcctcatgtaaatggatgcaatcaaaatcgttcacgtagaagaagtgccggtgatgttacaagtgttggaacagctacaacttctctc

SEQ ID NO: 108 - DNA, 469 bp, Cicer arietinum
acctgttgtaggaggccatgcgggagttactattctcccattattttctcaggcaacacctaaagccaatctgagtgatgattacattaaggctctaacaaagaggacacaagagggaggaacagaagttgtggaagctaaggctggaaagggttctgcaactttgtcaatggcttatgctggagccatatttgctgacgcttgcctcaaaggtcttaatggagttccagatgttgttgaatgctcgtatgtgcaatccaatatcatcgccgatcttcctttcttcgcttccaaggtgaggattgggaagaatggtgtggaggaaattgttggcttaggtcctctctcagatttcgagcaacaaggccttgaaaacctcaagtctgaactcaaatcatctattgagaagggaatcaaatttgcctcccagtaatgaaacatgtcatgtttttctgacagcttgctggat

SEQ ID NO: 109 - DNA, 449 bp, Cicer arietinum
acgggaagtctcgtgaacgagatatggcccgagtcccccgcagtgtcatatcctcctcatttctcaggtaagaagcatctatgggttctgcttgtaggcctctcccttagctccatgggtgctctcatcgatcttgtcgccaactgcatctttggcagcggaagcacgagtgccaatgccggcgttggagtccttggcaacctccttgttagcctccttgctggtgccagagataccctcctggaccttctcggtagcttggttaacggtgttcttgatggtatccattgctggtttatatagttttcttgtttaaaaagaaaaagataattgagttggttatgttgaggttggtggtttgtttgaatttattagttagttgtgaaaaactgagaagaaggagaaggaggatgagcacacgatggccatggaccatggccatggaggtt

SEQ ID NO: 110 - DNA, 413 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaat

SEQ ID NO: 111 - DNA, 413 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctaccagtagagaggtgcctcttgggggtaat

SEQ ID NO: 112 - DNA, 235 bp, Cicer arietinum
ctctaatcccccatctggtggcagcagaagaagaaccaccatcaccaccggcatttatgctccccctaaccgtgatcacattgcgctggcattagcaatggcttatcaggaagccactaatcaccataaacagcgaccgcctattaatgacctcggtccaaatgataagatacctgatgcatctattgttgcttatcctcccagggtttttggtccttgagcaactgggtgcaac

SEQ ID NO: 113 - DNA, 228 bp, Cicer arietinum
acttcgattgaggggcggaatgcaaatttttgtcaagactttgacgggaaagaccatcaccctggaggttgaatcatcggatacaattgataatgtcaaagccaagattcaggataaggagggtatccctcctgatcagcagaggcttatttttgcagggaagcagcttgaggatggaagaaccctagccgattacaacatacagaaggaatccacccttcatttggt

SEQ ID NO: 114 - DNA, 312 bp, Cicer arietinum
tacggttcttcatgccctcgaatttgatggtgagtggactgcaaattcaaaacagtcctcaattccacatgaaattcgatggctgccaaggagtgttgattgataggctaaccatctctgcacctaaactcagccctaacacagatggaatccatgttgaaaactcacaggctgttggaatatataactctatgataagcaatggggatgattgtatttcaattggacccggaacctcagatgtggacatagctggtgtcacttgtggtcctagccacgggattagcataggaagccttggtgtgcacaact

SEQ ID NO: 115 - DNA, 232 bp, Cicer arietinum
acacagggccagcgagaccaacagaagaagtagcggaaggtctggcatgaaccagaacaagcctgaaagcagaactattgttgttgaaaaagtgatccagagtccatttcagagcgtatgcactgtgctcactctcatcgattgcaaccaacatcactggttgtggcttctctgactcatctgaattttttgaactcgccattccaaaaacccaattactctcttttctctt

SEQ ID NO: 116 - DNA, 465 bp, Cicer arietinum
acaggacatcttctcaacaaatccactgcagtcacctattgagaagatgtcctggaaaaccaacgcttccggctctagcccaagtagcagagaggcaaggtaaatacttagcaggcttattaaacaaaataggtaaaaccaatggaggccacgcaaacagcatgaaagacattgacttgggggatcagtttgtttacaagcaccttggaagcatggcgactgtcggcagttacaaggctctagtggaccttagacagaacaaggaagcaaaggggttgtctctggcaggtttcatcagttggtttgtttggcgttcggcgtatctaactcgtgtcactagctggaggaacagattctatgtagctattaactgggctacgacttttgtttttggccgtgacataagcagaatatgaaaattttaaggttattattaaaggaataagtgatgaatttcagttaagc

SEQ ID NO: 117 - DNA, 460 bp, Cicer arietinum
ctctcctatcaacaatttttgtttcccgaaataccctcccaaatacgtcaaattcccttcgctgccactttctgcacttccgcgttcttcacctgctccgatggaagctcctcccgaaggttaccgcaggaacgttggaatctgtctcatcaataatcacaaaaagattttcgcagcttcaaggctagacattcccaatgcttggcaaatgcctcagggtggtattgatgaaggtgaggatccgagaaatgctgctattagggaactaagagaagaaacaggcgttagttcagcagaagtgattgcagaggcaccttactggttaacttacgacttcccaccaaaagtcagggagaaattaaacattcagtggggatctgattggaaggggcaggcacaaaaatggtttctttttaagtttactggagaagatcaagaaattaatcttttgggcgatggt

SEQ ID NO: 118 - DNA, 336 bp, Cicer arietinum
cggccgaggtactcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaa

SEQ ID NO: 119 - DNA, 246 bp, Cicer arietinum
acatctccttccactcgtcactcttctgtggccggtgtgaatgcccgcaagcgtgacaagcccctgccccctatcgttatcgatgaccctagcgacatcgtcgccatgaagcgtgctcgtaacactcttgcagcacgaaagtctcgtgagcgaaaggctgctaagttggaagaacttgaggataagattgctaagctggaagctgagcgcgatcactggaagaggatcgctcttgcgcaaaccggc

SEQ ID NO: 120 - DNA, 316 bp, Cicer arietinum
accggtattaacccggcaagaagtttcggatcagccgtaatctacaacgaaggcaaaatttgggatgaccagtggatattctgggttggaccaattattggagctacagtggctgcaatataccaccaatacattcttagaggatcagccattaaagctcttggatccttcagaagcaatgcttaattaattcacctctatctatcacttatttgtcaatgagtctatggtgttaattaatttcccccgaagaataatgttgaggagtgcaaaatgaagtggtccctttgggcgttttcgtcttttccatttcagt

SEQ ID NO: 121 - DNA, 160 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggccgtcaagattccgg

SEQ ID NO: 122 - DNA, 234 bp, Cicer arietinum
acagaaaccggatccctggtaagcaagaagtcatgattggatattcggattcaggaaaagacgccggaaggttttctgcagcatggcagctatataaggctcaagaggaactcaaaaatgttgctcagaaattcggtattaagctaaccatgttccacggccgtggtggaacagttggaagaggaggtggacctactcatcttgctatcttgtctcaacctccagacacgattc

SEQ ID NO: 123 - DNA, 412 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcgtccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaacccctcgcagggaaaaacccaaggcggctagaacgctgctctgtggacaaggcagtcgcctcgttccacggtctccaggtaagct

SEQ ID NO: 124 - DNA, 417 bp, Cicer arietinum
cgcacacagcgatcaagactcaagaggcgcagcaactttgctcgtctctttttacaattcgcaaacatggcaagagggttgaagaaacatttgaagaggctcaatgctccaaaacattggatgcttgataagcttggcggtgcctttgcaccaaagccatcatctggaccacacaaatcaagggagtgcctgcctttgattcttatcctgcgaaacaaactaaaatatgctctcacatatagagaagtaattgccatcttaatgcagcgccatgttttagttgataacaaagttaggacagataagacatatcctgctggttttatggatgtcgtgtctatccccaagactaatgaaaatttccgtcttctctatgacacaaagggtcgattccgtctccactctgtaagggatgat

SEQ ID NO: 125 - DNA, 365 bp, Cicer arietinum
acttatcgtcaaacttatcaacattaactgaagaaacatctactttggttgatgtcccgataacataagactgattcacacgcctcaatgggactccattgatcttaaaaggaccagtaacaagaagaaggccagaaggaagctgtttcaaaaacacaaccctctttcccttgaatctaccggcaagaagaatcaacactgtccctggagtaatgttagccctgagcttagtaggcttaggtttgtgcttgttgcgaagtggcttcttgacatcatcggcggggtagaatttaggagccttctcagcgggagcttcaggcttaggtttgggatcatgtttagggaaagcgccgccgtgtttggcc

SEQ ID NO: 126 - DNA, 335 bp, Cicer arietinum
acaatgtgattaagaataaaaggaaatcaaatgaaacaaatacatatttcttttaagactcaagaactcactaccttcctaatcacatcacatgctaagaactttaaaggcagtagcctcacatgactatttctggattcagaatgcttgtcttgatttccttgtggggcaaaaccacaccaccattactgtaaacttcatcacacacatggacatcttctccaaggatagtcatattctccacacgggcccactgcccaactgtggaatgccacccaatgatgctgctggatatgcacgcatgcttcttaatccgtacctgcccggacggccgc

SEQ ID NO: 127 - DNA, 422 bp, Cicer arietinum
acatcttggaggatgaccttgataagcgtgagccgcagaggaacgcgtatggaaaggcctacaccctgaaaatgaaggatgatggctttgagaagcgagaccctcagaatacttatggcaaggcctataccctgaagatgaaggacgatggtttcgagaagcgtgagcctcagaggaacacgtatggaaaggcctatactctgaagatgaaagatgatggctttgaaaagcgagaccctcagaatacatatggcaaggcttacactttaaagatggaggatgacggctttgagaagcgtgaggctgaaagtcgggcttgaatgtttgtccatattataaatatctaggccatagacacgtgcaatgttggtttcatgtatccaggaagaaacccaaatgagtaaccttcgttggcaccaatc

SEQ ID NO: 128 - DNA, 318 bp, Cicer arietinum
accggtattatcccggcaagaagtttcggatcagccgtaatctacaacgaaggcaaaatttgggatgaccagtggatattctgggttggaccaattattggagctacagtggctgcaatataccaccaatacattcttagaggatcagccattaaagctcttggatccttcagaagcaatgcttaattaattcacctctatctatcacttatttgtcaatgagtctatggtgttaattaatttcccccgaagaataatgttgaggagtgcaaaatgaagtggtccctttgggcgttttcgtcttttccatttcagtac

SEQ ID NO: 129 - DNA, 192 bp, Cicer arietinum
actagtgattaccggtcatttaaggcaattccagccttggcatcaaagatacttgacctagtatcaccaatgaagtcggtggagaccacatcatcttcagtgtatccgagaatgcctttcaacttgccctcagactcctccttgatagcagccttgatttcgtcgtaggtagcggccttctcaagcttcact

SEQ ID NO: 130 - DNA, 392 bp, Cicer arietinum
acaggacatcttcccaacaaatccactgcagtcacctattgagaagatgtcctggaaaaccaacgcttccggctctagcccaagtagcagagaggcaaggtaaatacttagcaggcttattaaacaaaataggtaaaaccaatggaggccacgcaaacagcatgaaagacattgacttgggggatcagtttgtttacaagcaccttggaagcatggcgactgtcggcagttacaaggctctagtggaccttagacagaacaaggaagcaaaggggttgtctctggcaggtttcatcagttggtttgtttggcgttcggcgtatctaactcgtgtcactagctggaggaacagattctatgtagctattaactgggctacgacttttgttttt

SEQ ID NO: 131 - DNA, 171 bp, Cicer arietinum
gcgccgttctctttgcaaccctaaggtagacagtccctcttgttttgttggcttagttttagagaactgtgaacttccatgtgccaatcatggccacgtcatacttggagatccttcgccaattcttttctatcctataagtagttcagaaattcgttgtctggttgatgt

SEQ ID NO: 132 - DNA, 335 bp, Cicer arietinum; identical to SEQ ID NO: 126

SEQ ID NO: 133 - DNA, 313 bp, Cicer arietinum
actggctcaccgagcgcaccttcggcgagttctctcgcagcttcaacttccccactcgtgtcgaccaggacaacgtctctgccaagtttaaggacggtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgt

SEQ ID NO: 134 - DNA, 436 bp, Cicer arietinum
acatgttctctgggagaaggatgaaaccggcaagtttcaatttaaggaaattgagggcagtgaagagattattgaggcagacatagttttactagccatgggattccttggtcctgagtcgaatattgcagagaggttgggtgtggagcgagacaacaggtcaaacttcaaggctgattatggtcgcttctcgaccaatgtgaatggggtgtttgcagcaggtgattgtcgccgcggtcagtcgttagttgtatgggctatttcagagggaaggcaagctgccgcacaagtcgacagctacctcaccaaagaagaccaagaccataatattgatgggaatcaggatgaatttgtgaagaggcaaaaagatctcaacaagaagcaccaggacagtggcattcacacagtgatgacataggatatgtcttctgtgatt

SEQ ID NO: 135 - DNA, 341 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacgagcggggaagttgaagctgcgagagaactcgccaaaggtgcgctcggtgagccagt

SEQ ID NO: 136 - DNA, 270 bp, Cicer arietinum
tttagcgcttagcgtggtcacggccgaggtacgtctcttctttctgccattgctcccatttttcggccaaaccatcgccttctagcattctcaccacctcggacatctttggtctttccataggggacccttgtgtgcatagtaaagctacttgaattaactgctctacctcatcatcatcataatctccctttaattctgcatctaccagtgtttccaacttcttgtctttgagaagtcctttaacccaatcaagcaacatgacatcat

SEQ ID NO: 137 - DNA, 434 bp, Cicer arietinum
gactctcttaaggtagccaaatgcctcgtcatctaattagtgacgcgcatgaatggattaacgagattcccactgtccctgcctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacattgtcaggtggggagtttggctggggcggcacatctgttaaaagataacgcaggtgtcctaagatgagctcaacgagaacagaaatctcgtgtgg

SEQ ID NO: 138 - DNA, 427 bp, Cicer arietinum
accattagaagcgatctccactgcactctttgcatcaggggcagaattattggtctgaactggttgttgctgcgaagcatggaatgctcgggcttttgccctgtgtttctttccatcagcatggagaagaagcgcttgcttacttgcagcttttgtattgcagagactacagaaccaaggaggccgttcagataaacccacattaatatcaacttctggcctttgcttcccatctttgacaggcttggcagctgcagcattcaaagttttgccttggccttttggaccatacttttccgcttcggtaatacattgagtgtgattctgaacggcgtctcgaccaaacatttggccacagtcaatgcacgaaagcttgttggcggagcaagttcggaagtgattgggcaacttgggttttttgagattg

SEQ ID NO: 139 - DNA, 327 bp, Cicer arietinum
ttcacttttagtatggcattggttatagctgtgttatctattttcagaatgcagaaattagctcaggaacaaaatgaaaagattgaaaaagttaatcgtgaaaggaaatatcatcagcaaaatactgcatatgagcttaatgctttgtcaatgcaatggaaggagctctgtcagaaaaatataggcatcagtgctgcgtgtgcttctgttgaaatttgcctacatgaactgagaagagaagctgcagaaagaggctggaacttggatgctatcactgaaaatggccaattaaatcattccgagtcatgagattcttatgtgcttacg

SEQ ID NO: 140 - DNA, 437 bp, Cicer arietinum
accttagcgtggtcgcggccgaggtacaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccaa

SEQ ID NO: 141 - DNA, 240 bp, Cicer arietinum
gccaaccattaaaagttacctacatgctaaacaaataaatcgcacaagttaaacagtaaaataaggatacgctcagagcaatcaccgtctatctacacttcattgaaacgcatgaaaacaaattttatcatggcaaaatacaagaaccatacaaataccagaccttagaaacaagtataacagtcacaaattactcctttcccttcaatgatgtggttgatgaaaaacattggaaataaa

SEQ ID NO: 142 - DNA, 302 bp, Cicer arietinum
acacctttgattgtccccttctcttcatgtagggaagtgactgttccttgctccaaatttacattgggaagggaagcagccttctctcgcattctctgaataaaacggccattgtgaaagcttctgccagatacatctgagtgaaacttatccaagggataggagagacgggtatgtttcccatctttgaaaagtgcataaccaaacacttgctgcgcatcaatattgttcacacaatcttcaaggcccagttcaactaatttgagatagccgccaggttgtagcaactctccaacaattct

SEQ ID NO: 143 - DNA, 382 bp, Cicer arietinum
taaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtgg

SEQ ID NO: 144 - DNA, 436 bp, Cicer arietinum
gggaactggaacaattactgctgtaactcttgttgctgtggatgctgagatcagcgtcaatgctgccatgcttcaggaaggacttgctagaatggaaaaaagaaacaggtgggacagatcagcaagaaagcaggcccttgatagcttggaagcgttccaaggagaggctaggacaagcaggcgtggaatgtggcagtatggagatattcagtcagatgaagaggattctggtcctcctcagagaaaagccgctggccgcagataagtgtaatgcgattaataaattatataatatatagacatcttgagagaaaatgattcaagttatagacatgagttagagagaaaaagaagaaaatgccgtgcgtatttcctttgtaagttttgttttgttttatcttattttataacttttgttgttagatttggtggaaca

SEQ ID NO: 145 - DNA, 320 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccac

SEQ ID NO: 146 - DNA, 344 bp, Cicer arietinum
actctactaataccccactaaaaaccaagactgatgattcttgttttccttacactaaattatttttctttatttgtttttctccttatttcgccctgcagcataccaactgccaaccaagaatgcctaaaaggaaaaaccaatgaaagtcctgcttaatcattgaacattcattttcttttttattctgtgcatttgatttaggaactcagccaacataaaaatcacagaagacatatcctatgtcatcactgtgtgaatgccactgtcctggtgcttcttgttgagatctttttgcctcttcacaaattcatcctgattcccatcaatattatggtcttggt

SEQ ID NO: 147 - DNA, 446 bp, Cicer arietinum
cgcaatcgcagatctcgtgatcgtcgatcgaaatggacggttacgatggaaccgttaggctcggagctcttaacatgaagtatgatcgcggcgactttgactccggtgccgacgtgtcggtttcttctccggttaccaaacagaaagccgctgccgctaagcaattcatcgagaatcattacaagaattatcttcaaggattgcaggatcgtaaagacagacgcagagcacttcaaaggaaagtgcaggaatctcaaataccagcggaagaacaggaggtaatgatgaggaatttggagcgtaaagaaaccgagtacatgaggcttcagagacgtaaaattggaattgatgattttgagcaattaacagtaatcggtaaaggtgcttttggtgaggtgaggttatgtcgtgctaaaaatacaggagaaattttcgctatgaaaaaa

SEQ ID NO: 148 - DNA, 241 bp, Cicer arietinum
ataaattgtggagaacaactaagatagaaaatggaaatattgatactgaaaaagatggatttgaagttgaagttgaaacattgggaaagattagacacaagaatattgtaaggttatggtgttgttgtaatagtggagatagtatgcttctagtttatgagtatatgccaaatggaagcttggatgatttgttgcatatcagcaagatatttttgttggattggtcaactagacttagaat

SEQ ID NO: 149 - DNA, 328 bp, Cicer arietinum
actcttctccatatcctcgccgctccataagcttaaataggttgacttccaaatcagtttgggagacatcaagaaggctattgtctatgagcagcttcttcagttcgagagcaattttgatagctacatggtttggaatcttggttacagttagcattctactgagcaaaaatctggaaagaacatagtaatgatccgcattatcacccaaccacacctttaccttgacgaaatcgtatttggaagaagcgttacgggaagagaatctgacggaggaaaaggaagggtgttgttgtttatcatcactgtcttcttcgccactgatggg

SEQ ID NO: 150 - DNA, 319 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgcca

SEQ ID NO: 151 - DNA, 438 bp, Cicer arietinum
acttgctaatgcaagttagttgcttatcttattgatagtttcatgattcacatatccacccatgtcctacaaattctaaattgaaaaccatactgaaaccaggcaaactgactcaaatagaaaaaaatgcaaactgactcgaaatagatgacaatattttatttatatgacccttcaagcatgcttggctattgtcgattgcagcttctccttctgagcacccacaaccttgtccactagttttccttcttccaagaacaagaatgttggcatagcttcaacaccccactcctcagcaacagtcttcaattcatccacgtcaaccttaaggaaggtgacattcggcagctttttagcaatctctgctagaattggagcaatgaaacggcatgggccgcaccaagaagcagtaaaatcaacaacaatcaatttcccgga

SEQ ID NO: 152 - DNA, 232 bp, Cicer arietinum
acgctttactcagacgacggaactctggagccgaacaatgctctcgcggggttgatggataacctcaaaaaagtccacgacaagattggccgcacgctagatcccgctcctgagttcaagaactgggtatgggaggctggcttccacaacattacggagcaaaggttcaagtttcctgtaggcccgtggcctaaggacaggaggttgaaagagatcggggcttgcttgagca

SEQ ID NO: 153 - DNA, 252 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgtcgtcgcgtttactcgacgttgatgcggcgagactcgtgcttcttggccttgggaacaacaatgctcaggataccgtcctt

SEQ ID NO: 154 - DNA, 309 bp, Cicer arietinum
acaaagccttccaagtacaaagccaaatttgtagcaaagggatttatgtagaggcttgaacttgattatgatgaagactttacacttgtggctagaaatgaaacaatgaggcttgtagtgcccacggttatttacaaagatggatcatgcatcagttggatgtaatgtcaacattcctcaatggaccattggaagaagtgtatgtgaaacaaccacctgaaacaaccaccaggatgaggaaagagaaagaagacaatgtgtataggctgaggaaattgtatggcttgaagcaagctcctagtgcttagt

SEQ ID NO: 155 - DNA, 300 bp, Cicer arietinum
acatagttgtgctgatgtattgagtggatcgcaagaatactttcagcaatgtagaagcgagcaacattttcggaaagagcatcttctctcattaacaatgtcataatgtcaccaccaggtaaatattccatgatgagatataagaaatctgaatcttggaatgaataatggagtttaactatgcatctgctatcaacctctgcaagcaaattcctctcagatcgcacatgttccacctgtccacggctaggcatctctgatttcttcaattttttcatagcgaaaatttctcctgtattt

SEQ ID NO: 156 - DNA, 340 bp, Cicer arietinum
ggacacgtcaccgtttgagtgggagcattaaccaacaacaatgagcaattcctctgccggaacctcatcaaaaccaaaagcagcttcctcacaaccatcagaaacttcatccaagcgcaaaagaggagttttccaaaaagaattgcagcacatgatgtatggtttcggagatgatcctaatccacttcctgagagtgtggcacttatggatgatatcgttgtggaatatgttacagaactggttcataaagcacaagatattggatcgcagagagggaagctatcagttgaggatttcctctatttgattcgcaaggatatgccaaaacttaaacgttgt

SEQ ID NO: 157 - DNA, 414 bp, Cicer arietinum
acaacactcttcaattgcattatgaatggaaaggccaatctaaaactggttttaatttcaatccctgcagcaataaaccgctttcgcaaatttaattattaaatctaggcgtatacctgctctaaataaaacaacaaagctgccacctctgcgggcaacattacaaacaattgttttgaatttgcaaaatttgagttggttctaaatggaaaatccagcaagctgtcagaaaaacatgacatgtttcattactgggaggcaaatttgattcccttctcaatagatgatttgagttcagacttgaggttttcaaggccttgttgctcgaaatctgagagaggacctaagccaacaatttcctccacaccattcttcccaatcctcaccttggaagcgaagaaaggaagatcggcg

SEQ ID NO: 158 - DNA, 222 bp, Cicer arietinum
actgcgttcaagtgcatgctaaacggggctgttgattttctcattaaacctgttcggaggaatgagcttaggaacttgtggcagcatgtgtggagaaggcatactattagcaggccttctcaaaatatgacatctccacaggctaaacttgacgttgctccagaaagcaatgctccaagcaataattctagtggttctgtggcttccacgcaaaaaaataat

SEQ ID NO: 159 - DNA, 240 bp, Cicer arietinum
gatttcgagcgggccgcccgggcaggtcgagaaggttgcaaggcaacaattttattcaagctggaaaaatctggaaaatgggttgtctcaagatttgtaaaggatcacaaccatcctttaattgctacagctaatggtttcaattcagcggacgataaagataaaaaaattgctgaacttactatcgaattggagcgccaagatgaactgtgtgctgcgtatagagaaaaactaatgagc

SEQ ID NO: 160 - DNA, 318 bp, Cicer arietinum
actctagaaacgagatctatcaacaactgccacaagagatttctccgtaagctcctcccaaagatgtcaggctgccctgtatcgtccgctcgtaaatagctgatgagacagcctggtaacggatattgaagacccgtgttgcttttttcaatttttttttagattgagcttagatgaggtcggcaacgttcatgggcatctcctcaatctgggtgctgtagaactgctcaatctcacgcatcatgcggacgtcctcagcggtgacgaagttgatggcgacaccctttcggccgaaacgaccaccacgaccaattcggt

SEQ ID NO: 161 - DNA, 435 bp, Cicer arietinum
acttctatcacaaccctgcaatggtttctacggcaacgtggcttcgctaccttgtttccaaaactcaattcaccctcgccaccggcttcaagaactataaaggaggtcatctcaaagacaatgagctatcagattttatctggaagcacttccttcatggaaaaatgaccttcttgcactggaataaaggagaggagatggcccctactattgctggaaatggagcaactcttcttgttcggagaataccaattccagacccaacacatgtttatgtaggagatgttgtggtcttgaagaaccctgaaaagccagatgactacctagtcagaagattagctgcgactgaaggctatgaaatggcttctactgatgaaaaggatgaaccatttgttcttgagaaagatcaatgttgggtagtggctgaaaatgaaa

SEQ ID NO: 162 - DNA, 129 bp, Cicer arietinum
ttttttttatagacagtttactgaacctattcgaagactaattatgcatatatatataaccaacttcatagatggacaagacagaacagcaaataattactcagagtccacttctaaggacaccttccg

SEQ ID NO: 163 - DNA, 359 bp, Cicer arietinum
actattacccctattgaaaggtccttaagtttcgcagataaatttccagacaaaattcttcacaaaacacaattccaaagattttcaagaagcttgaactatgtattagatttttgtcccaacattaataggatagcaaaacttctccatgataggttatagaaaaacctcgtcgcatggtcagaagaacataccaaaatagttcaaataatcaaaaaacaagttaaagaaataccttgcttgcatttagctgacccatcagcccaaaaaattgttgaaacagatgcatcagacaaaggatatgggggtatccttaaacaaaaaacaaataacaaagaatgcattgtacctgcccgggc

SEQ ID NO: 164 - DNA, 431 bp, Cicer arietinum
cgggaccccaagccgtggaactttgaagatataaagaaccatgttgagaaatctgaccagggcgatgtagtcctcatcgacgtccgagaaccagtcgagcttttcgagacgggcaagatccccggtgcgatcaatattcctatcacatcggcagctcagagcttccacatctccgacgaggattttgaggacatgtatggcttccagagaccggcaaagaacaaagagcttgtgttttattgcaagcaggagtgcgtgcaagggcggctgcgcaactggctcatcatgctggctggaacaagatcggcgactatgcaggcagctggctggactgggaagctcagaaaggaccagttgagaaggttaagaaaccatattgaacagacagagcttgatgaagacatccattggcagaatggttggccaaataa

SEQ ID NO: 165 - DNA, 411 bp, Cicer arietinum
actcattacccccaagaggcacctctctactcgtagctcgccctacagtagttgtcggtgaagcacgtcccattggacatcaatacagttgatcctcgcagagcttccctccagcagcgtcccatctagttcatccagcatatcatcggcacaaaggcgcatttactttcaagaggtcatcccgtcagcgggatctattcctctccagcctagaattctcttgcacagatagatcaagtagctttccataccctgaggcaggaagtccatgatcccctaagatcgccagtaactgcaaccctagaaccgtgcatccttggggaaaaccctcgcaggagaaaaccccaaggcggctagaacgctgctctgtggacgaggtagtcgcctcattccacggtctccaggtaagct

SEQ ID NO: 166 - DNA, 383 bp, Cicer arietinum
acaacactcttcaattgcattatgaatggaaaggccaatctaaaactggttttaatttcaatccctgcagcaataaaccgctttcgcaaatttaattattaaatctaggcgtatacctgctctaaataaaataacaaagctgccacctctgcgggcaacattacaaacaattgttttgaatttgcaaaatttgagttggttctaaatggaaaatccagcaagctgtcagaaaaacatgacatgtttcattactgagaggcaaatttgattcccttctcaatagatgatttgagttcagacttgaggttttcaaggccttgttgctcgaaatctgacagaggacctaagccaacaatttcctccacaccattcttcccaatcct

SEQ ID NO: 167 - DNA, 403 bp, Cicer arietinum
acttgctaatgcaagttagttgcttatcttattgatagtttcatgattcacatatccacccatgtcctacaaattctaaattgaaaaccatactgaaaccaggcaaactgactcaaatagaaaaaaatgcaaactgactcgaaatagatgacaatattttatttatatgacccttctagcatgcttggctattgtcgattgcagcttctccttctgagcacccacaaccttgtccactagttttccttcttccaagaacaagaatgttggcatagcttcaacaccccactcctcagcaacagtcttcaattcatccacgtcaaccttaaggaaggtgacattcggcagctttttagcaatctctgctagaattggagcaatgaaacggcatgggccgcaccaa

SEQ ID NO: 168 - DNA, 362 bp, Cicer arietinum
gtacaggcattaaacctgatttgttggtctctttgacagcaccaaaattatgtgcaaagaaatttggcggccctcaccactttttaggagggagatttgtcccacctgctattgctgaaaagtataagcttatacttccaccatatcctggaacatccatgtgtgtccgaattggaaagcctcctcaaattgatatttcaactctacgagaaaactatatctctccagaatttcatgaataccaggtggaggcggaccccaataatcagtttcgtaaatggtttgatgatgcattggctgcgggtttgaaggaaccaaatgctatgggcttgtcaactgtagggaaggatggaaaaccctcg

SEQ ID NO: 169 - DNA, 439 bp, Cicer arietinum
actattggtgttatgcagtgctttggagagttccatggcagaaagactccatgatctagcaaggaactccattgattctgtgggcgtatcaggcggggggcaagatgatgcaggcccatctgcaggaacattctcatcaatgttctctatttgatgaaccgagcatttagagacagaggtgttggagctcattgtaaagatgaatgaatattccaagtccctaaagcttcaataaccaaagacttagttacatatgatgagagaactgaggaccaacagttagatatttaaaagaaaatgtgacgttgtttcaaagtgcttgttatttaaaatgatgaagaaaaaaattaacttcaagtattcatagtgatgaacaaaaggaccctaattgaaaacgccattatatttgtctccacttaagttgtatacctcggccgcg

SEQ ID NO: 170 - DNA, 409 bp, Cicer arietinum
acaggcattaaacctgatttgttggtctctttgacagcaccaaaattatgtgcaaagaagtttggcggccctcaccactttttaggaggtagatttgtcccacctgctattgctgaaaagtataagcttatacttccaccatatcctggaacatccatgtgtgtccgaattggaaagcctcctcaaattgatatttcagctctacgagaaaactatatctctccagaatttcatgaagaccaggtggaggcagaccccaataatcagtttcgtaaatggtttgatgatgcattggctgcgggtttgaaggaaccaaatgctatgggcttgtcaactgtagggaaggatggaaaaccctcgtcacggattgtattgctaaaaggcttggaaaaggacggatttgtgtggt

SEQ ID NO: 171 - DNA, 221 bp, Cicer arietinum
ttctgagaaattttctactctctaattaacggagctattaacggcgcgactcttagatgtcatcatctgcttaaactcatcaaatccgacgctaccgtcaccgtcagaatcaacggaattgatcatatcacggcattcctcaacagaacatttcattccgaggcggttaagcgccaagtgaagttcctcagtcgagatgaggccgtttttgtcgtggtcgt

SEQ ID NO: 172 - DNA, 336 bp, Cicer arietinum
ttcacttttagtatggcattggttatagctgtgttatctattttcagaatgcagaaattagctcaggaacaaaatgaaaagattgaaaaagttaatcgtgaaaggaaatatcatcagcaaaatactgcatatgagcttaatgctttgtcaatgcaatggaaggagctctgtcagaaaaatataggcatcagtgctgcgtgtgcttctgttgaaatttgcctacatgaactgagaagagaagctgcagaaagaggctggaacttggatgctatcactgaaaatggccaattaaatcattccgagtcatgagattcttatgtgcttacgtagtgtccc

SEQ ID NO: 173 - DNA, 434 bp, Cicer arietinum
actgcccagagaacctcttcttctttgcagcctcggctgccgcccggaacacggccgggcttcgacaattggtctcactggctgagaccactagacaaaaccgctgggtcgaaatggtatagagcttacctggagaccgtggaatgaggcgactacctcgtccacagagcagcgttctagccgccttggggttttctcctgcgagggttttccccaaggatgcacggttctagggttgcagttactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggacgctgctggagggaagctct

SEQ ID NO: 174 - DNA, 439 bp, Cicer arietinum
actaccttgatccagaattccaagatcttggtaaggaagccaattaaaggacaagaaaacgttgtggtggaagatgactcatttcaaaaggacaccgcacactcgaataattctccaaaattgttccatcatgtcaatcattgagctatatccttatcgatttacagtgaagacttacttggcaaggcaatagatggctttttgagaggtggattcattaataattattttgattattttattcaacgagatggatatatgatatggaaaattaatgaaacaaacactgaaaactcttacttcgctcagttttacaacattggatatggtgtcaatgctacaacaagaattaaatggacaaacgatgtcattactaaagatgaagctattagattcactgctcaatcgtggcttaatgccagcacttggttgccttttt

SEQ ID NO: 175 - DNA, 250 bp, Cicer arietinum
actgtagcccaactcgttgtcataccatgagacaagcttaacaaaccggtcatttaaggcaattccagccttggcatcaaagatacttgacctagtatcaccaatgaagtcggtggagaccacatcatcttcagtgtatccgagaatgcctttcaacttgccctcagactcctccttgatagcagccttgatttcgtcgtaggtagcggccttctcaagcttcactgtaagggtcacaactgagacatca

SEQ ID NO: 176 - DNA, 240 bp, Cicer arietinum
cacggccatggtctacagcacttcgcaggcagtaaaggactctgcctacaatgttggtcatgtgaactggaccaaatgttcgactatcaattgcttccttgactttcaatttttcattttcagccactacccaacattgatctttctcaagaacaaatggttcatccttttcatcagtagaagccatttcatagccttcagtcgcacctaatcttctgactaggtagtcatctggctttt

SEQ ID NO: 177 - DNA, 371 bp, Cicer arietinum
  misc_feature (88)..(88): n is a, c, g, or t
  misc_feature (161)..(161): n is a, c, g, or t
  misc_feature (169)..(169): n is a, c, g, or t
  misc_feature (274)..(274): n is a, c, g, or t
  misc_feature (282)..(282): n is a, c, g, or t
  misc_feature (306)..(306): n is a, c, g, or t
aaaaccctaaaccctgaaactggaacagaacgtgagcttaatcggaaggcatgtctaacttggaagttgatgttgccggaatccgctngctcgaactccggctcatccggtggacctttactccttcgccggcgaaggcgttgaatcccgaacctcaaacngaatcctnagatgactccatcaaggagctcttgtccttaatcgagtgtggcaactatggccgaagcactcacctctcaaccttgcaaacttatcttccgactcgaccatgacncactttcnccagggattcttgccgaaccgatnctactcccgagttggtgggatcgcgcttgagtcctttcataacaggacgcctccgcttagtcctg

SEQ ID NO: 178 - DNA, 324 bp, Cicer arietinum
acattagtatcagtttctcctaagtcatctgctaatgctgcttctagttcacttaactcaatatagccgctcccatctttgtcaaaaaacttgaatgctttgcggaaatgctcgtcattctccattctttgcaagtgaattgtcacagctacaaactccccatagtcaagcactccattcccatcaacatcagccacgtccatcagcaactttatctctggctcagccagttgtgaaccaaccttctgcaaaccagccttcagttcctcatatgttattctgccatctttgtcagtatccatcaatgtaaacatgtctttgatt

SEQ ID NO: 179 - DNA, 432 bp, Cicer arietinum
acttcaacttcttttctgtgaaattgttgccaccaaaatgcaccttgaccatctatggtcccattttcccctgtgacaataacatcggtgaggttagttccaaatatgaggctggtgtatcttcctgctggtgcgtctctccctctaccgtatgatggtaaaggttcaatcacaggccactcagttatatcctgagaagcaaggagaatagcatctttatccaaatagagagtgaaatgactattaaggctgaaactaccagtaagccattttcctgcaggaacatacagctgagaaccaccttcattaccatactgactcaagtgactaattgcagactcaaaagcctttgtattagatgtttttccatctccaacaccaccaaaatctgtcaatgaagcactctgagctctgcagtttataccattgtac

SEQ ID NO: 180 - DNA, 467 bp, Cicer arietinum
acaatcgactaacaaataagttgcaatgagctcttccaaatgtatgagcacctgagagagcaactagatcagtagtgttgaggccttgagcagcaaaagcagatttaagtttgtccaatgtgtcgaatggagctggaagatttatattagctagagattggtttgctgttaaactatctcttcttcctaatggaactttccaatcaggaccaccagccagagttgaagataattcagcagcaagagcaagaatatcagcacaagaaactgtgttaggacaaacactttccaatgcagtcttgatctgattcacaacatctaaacctcttaaagagttgttatttgggaaagcttgttgttcgctcacaatagtatcagtcttgttcaacaaaactgatgcgtcacaaccttgaacaaaacagtcatgaaagtgaagccggacaagactagcaagcatacgaggatcc

SEQ ID NO: 181 - DNA, 304 bp, Cicer arietinum
acaggatacccctcttccttcaccatccagcataccaaggcacaaaaggcactgtttttgtcaagcccgtcacccgtcagcgggttcggaggcaatttgtcgaatttttccaccgaccagaattctctcacgcatcgctacatctgctgacgcagtccataatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgt

SEQ ID NO: 182 - DNA, 434 bp, Cicer arietinum
accagaatgatcctaccggcacacctcagttgagagactatgagcatatgctgcaggtgctcaatcacatttttagcacggcgccagagtggacggatgcggcggagagtgtgggcatggtaggtgtgccgctttgtgccatctttgactatcctatgggaacgcctagtggttatgcggcgtttttggaccctgatgtgaatcggatgctgaagaaggttctcaaccactggggcaagtttctcatgacacctaaatcggctgaagttctgggagatcacaagcagggctggttcggacccgcgggtctgaatgacctcgtcgaggtcgccaacaagcccaacaaaacgaacttcaagtttgaggaggtctttgagtgtgatccatcagccaaatactacggcttcaagtcctgggacgacttttttactcgc

SEQ ID NO: 183 - DNA, 347 bp, Cicer arietinum
acatttgatttattttttgcttgagggatgcaacctagaatgaagaaactgacctcagccaattggaagagtttttcccttgtttcaagtgtggcctgctgccttgagtagtccaatagaattccatcaaattcaaccatcattgatttggatctctcgtcgtcactcaataaatcacgtaaatgattcgctttaatgtcctcaacgtgcgccttcaactccttccatggctgggtgtcactgatgagagtcgaggaagccatttcgaacaataactggtaagatttcctgaaaaaggaatcaactttggtaagaaaggggaaatgggtgtgtgatttggaaaatgg

SEQ ID NO: 184 - DNA, 303 bp, Cicer arietinum
acacctttgattgtccccttctcttcatgtagggaagtgactgttccttgctccaaatttacattgggaagggaagcagccttctctcgcattctctgaataaaacggccattgtgaaagcttctgccagatacatctgagtgaaacttatccaagggataagagagacgagtatgtttcccatctttgaaaagtgcataaccaaacacttgctgcgcatcaatattgttcacacaatcttcaaggcccagttcaactaatttgagatagccgccaggttgtagcaactctccaacaattcta

SEQ ID NO: 185 - DNA, 438 bp, Cicer arietinum
acagaaaccggatcgatggtaagcaagaagtcatgattggatattcggattcaggaaaagacgccggaaggttttctgcagcatggcagctatataaggctcaagaggaactcagaaatgttgctcagaaattcggtattaagctaaccatgttccacggtcgtggtggaacagttggaagaggaggtggacctactcatcttgctatcttgtctcaacctccagacacgattcatggatcgcttcgtgtgacggttcaaggtgaagttattgaacagtcatttggagagcagcacttgtgctttagaacgctgcaacgtttcactgctgccactctagaacatggaatgcgtcccccaagttctccaaaaccagaatggcgtgccttgatggatcaaatggctgtcattgctaccgaagaataccgttcaatagtgt

SEQ ID NO: 186 - DNA, 405 bp, Cicer arietinum
acatctcttgcagcatatgaagattcttaacatccttctcaataacttgtttaaatgctgctccaaatcctagccatactggaagatgaaaccttgtttgtgtccatgcaaagatccacggtatcgcacgcagtgtttcgattcctccactaggccttctctttgccggtcggcttccaatgttcatccttccatactccatctctggtgtagccaggcggaaatactcaacaaaacgcggctccttgaacactattgaacggtattcttcggtagcaatgacagccatttgatccatcaaggcacgccattctggttttggagaacttgggggacgcattccatgttctagagtggcagcagtgaaacgttgcagcgttctaaagcacaagtgctgctctccaa

SEQ ID NO: 187 - DNA, 375 bp, Cicer arietinum
  misc_feature (361)..(361): n is a, c, g, or t
ctcaactcaacgctacaatggttaacgttccaaagacaaagaaaacatactgcaaaagcaaggaatgcaaaaagcataccttacacaaagttacccaatacaaaaagggtaaagatagcatcgctgctcagggaaagcgtcgttatgatcgcaaacaatctggttatggtggtcagactaaacctgtttttcacaaaaaggccaaaaccactaagaaaattgtcttgaggcttcagtgtcaaggttgcaaacatgtttctcaacatgctattaagaggtgcaagcactttgagattggtggtgataagaagggaaaaggaacgtctctattttagttgcagaattagaattctgcattttncatgtgtttttcta

SEQ ID NO: 188 - DNA, 440 bp, Cicer arietinum
acagaaaccggatcgatggtaagcaagaagtcatgattggatattcggattcaggaaaagacgccggaaggttttctgcagcatggcagctatataaggctcaagaggaactcagaaatgttgctcagaaattcggtattaagctaaccatgttccacggtcgtggtggaacagttggaagaggaggtggacctactcatcttgctatcttgtctcaacctccagacacgattcatggatcgcttcgtgtgacggttcaaggtgaagttattgaacagtcatttggagagcagcacttgtgctttagaacgctgcaacgtttcactgctgccactctagaacatggaatgcgtcccccaagttctccaaaaccagaatggcgtgccttgatggatcaaatggctgtcattgctaccgaagaataccgttcaatagtgttc

SEQ ID NO: 189 - DNA, 324 bp, Cicer arietinum
cctatgatgaagcccttgtgtcacaggagaggcaagaactcggccgcgagctaagaagtgagctcttgacagctgaaaagtttgtgctggtgattagtggacatgagaaacttcagcagaataataggagcttgaggaggttggttgagaatagacttccatttctcaatcctatgaacctgttgcaggtggagatactgaagaggttaaggcgtgatgatgacaaccttaaactcaggggtgctttgcttattactgtgaatggtattgctgctgggatgaggaataccggttgaagttgcttctcaacaactacaataatgt

SEQ ID NO: 190 - DNA, 254 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaa

SEQ ID NO: 191 - DNA, 364 bp, Cicer arietinum
tgcttgcagctactcgcttatgatccttcatgatgaacaaatccctgtcactggtgacaaaatttccactttgttgaaagctgcaaaggttgatgttgaatcttattggccaagcttgtttgctaaacttgccgagaagaaaaaccttgaggatttgatattgaatgccacaggaggtggggctccggtttctgtttcagccccagttgctgctgctgccgcaactgcagttgccgcacctgcagaagagaagaaggaagaacccaaggaagagagtgacgacggacatgggattcagcttgtttgattaggagaacttttagtgtgatctagtctgatttgaccttggcccccgggcggcccg

SEQ ID NO: 192 - DNA, 318 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgcc

SEQ ID NO: 193 - DNA, 439 bp, Cicer arietinum
acagctctagttgctgtgattgctgattggttccaaaacaatcgcgaactcatgccgataaagtcccagttcgatagtttgattcgagacggttcattagaatggagaaacttatgcgaaaaccaaacatacagggaacgattccccgacaagcattttgatcttgaaacagtcgttcaggccaaaatacgccccctttccgtggttcctgggaaatcctttatcggtttctttcatccagaaggaatggatgaagaaaggtttgattttctccaaggggccatgtctttcgataacatttgggatgagattagtaatgccggacaggaaaacaccgataacggtgaaccccggatttatatcatcagttggaatgaccatttcttcatcctcaaagttgaagacgacgcttactgcatcatcgacactctaggggaga

SEQ ID NO: 194 - DNA, 322 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgccgtggcggcagggaaaaacctcgggaagggatcagaggccggcggtgcggcttgccttcaaaggagaaaaacccatcgcaatcggcgtcgttgatcggaaggatgtcgctaccgatgccacggg

SEQ ID NO: 195 - DNA, 406 bp, Cicer arietinum
acacaagtgagctgctagctcttcttatccactataaacaacaacaaagttacaagacaactcaaagaagctgtgataatcaccatactagtagctaacagcaacgatgcatatcccatttatctttgttttcagcaataacctcaactctatcgaggcagagtgtaaggtccacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttgtgacacacttgcattttcatcttgtgctgcacttgcacaaggagctagcttaaaagcttcattatctggtg

SEQ ID NO: 196 - DNA, 432 bp, Cicer arietinum
  misc_feature (418)..(418): n is a, c, g, or t
accatagtggacaatatatttttgttaattgtgcagatgtctctccatttcaatggcatcctttctctattacatcagcccctggagatgattatgtgagcgttcacattaggacttcaggtgactggacatcacaactcaaggctgttttcgccaaggcatgtcaaccagcaagtggtgaccaaagtggtcttctacgagctgatatgttacaaggcaacaacataccaaggatgccaaagctattgattgatggtccttatggagctccagcacaagactataaagactacgaagtaatccttttggtgggtttaggaattggtgcaacccctttaattagcatactgaaggatgtgctaaacaacatgaaacaacaaaaagacatagaacaaggagtggtagaaagtggtgttanaaacaacaaaagaa

SEQ ID NO: 197 - DNA, 414 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccaaaa

SEQ ID NO: 198 - DNA, 344 bp, Cicer arietinum
tgcttgcagctactcgcttatgatccttcatgatgaacaaatccctgtcactggtgacaaaatttccactttgttgaaagctgcaaaggttgatgttgaatcttattggccaagcttgtttgctaaacttgccgagaagaaaaaccttgaggatttgatattgaatgccacaggaggtggggctccggtttctgtttcagccccagttgctgctgctgccgcaactgcagttgctgcacctgcagaagagaagaaggaagaacccaaggaagagagtgacgacgacatgggattcagcttgtttgattaggagaacttttagtgtgatctagtctgatttttgt

SEQ ID NO: 199 - DNA, 436 bp, Cicer arietinum
accctcgccgactacaatatccagaaggaatctacccttcatctcgtcctccgtcttcgtggaggtatgcagatctttgtgaagaccctcaccggtaagaccatcactctcgaagttgaaagctctgacaccatcgacaacgtgaaggctaagatccaagacaaggaaggaatcccaccagaccagcagagactcatcttcgccggaaagcagcttgaagatggccgcaccttagctgactacaacatccagaaggagtcaacccttcaccttgtgttgcgtcttcgtggtggtatgcaaatcttcgtgaagaccctcactggtaaaactattacccttgaggtggagagttctgacacaatcgacaacgttaaggccaagatccaggataaggaaggtattcccccagatcagcagaggttgatcttcgccggaa

SEQ ID NO: 200 - DNA, 460 bp, Cicer arietinum
actctgaggatgagaatatatgtcctggccaccataatagatcgatgaactaaggtgacatggttgaactctttgttcttgataaatagaactcatatccttatatgctgtcttcttctgattttcaccatcacttcccttacttatgtagtcaattttggagttcaatccctcagtggcagttttcccattcagtgcagagttcagagactctcttccaaacactttaggagatggagaaaaaatagagtcaaaaattccagaagaagaagatggatgtaagtcattggaaccaaagagttcagaagtgaaagaagatgaagaaccaacttgcttgtttccttccatttttttttcttttctaatctatgcttcaatccttcaaacaaagttagattttttatgcgaagacaactccacaaagaaacatcaaccaccgcccctaagaacaagtttgtaa

SEQ ID NO: 201 - DNA, 326 bp, Cicer arietinum
actcattacccccaagaggcacctctctactcgtagctcgccctacagtagttgtcggtgaagcacgtcccattggacatcaatacagttgatcctcgcagagcttccctccagcagcgtcccatctagttcatccagcatatcatcggcacaaaggcgcatttactttcaagaggtcatcccgtcagcgggatctattcctctccagcctagaattctcttgcacagatagatcaagtagctttccataccctgaggcaggaagtccatgatcccctaagatcgccagtaactgcaaccctagaaccgtgcatccttggggaaaa

SEQ ID NO: 202 - DNA, 341 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacgagtggggaagttgaagctgcgagagaactcgccgaaggtgcgctcggtgagccagt

SEQ ID NO: 203 - DNA, 160 bp, Cicer arietinum
acaaaaacgagaaccacagttacacaaaaccataacatgataaataccatagccaaaccactaatttcttaaacctactaaagtgacgtgacaaggagaacattcttaatcataaaccccaacaagaagaacttaaatctagtccctccagtttccacca

SEQ ID NO: 204 - DNA, 404 bp, Cicer arietinum
acaaaagtttctgcaatgacttagaaaacaaaatgagaataatgtaaactggttgtctaactctcggtctgctccctcagccttcggatggtgcttcgcacagttacagcactggcagtattcaatgtgtatgcaccaccagctttcacctttccacaatctttgcagccccagatatcaacagccttcctcttaacagcatactttccacagaactcgcagaagaatttactgtgctgactgacttccatcttcttaatctgcttccttaaactggcaccatatcgtgtgccgtatttgccaacaataccggccttcttggttctcttagtcattttgggtggctcggagggaagaagtgagaaacgagattggggcgcggctgcaaaatcgatacctcggcc

SEQ ID NO: 205 - DNA, 399 bp, Cicer arietinum
atcgattttgcagccgcgccccaatctcgtttctcacttcttccctccgagccacccaaaatgactaagagaaccaagaaggccggtattgttggcaaatacggcacacgatatggtgccagtttaaggaagcagattaagaagatggaagtcagtcagcacagtaaattcttctgcgagttctgtggaaagtatgctgttaagaggaaggctgttggtatctggggctgcaaagattgtggaaaggtgaaagctggtggtgcatacacattgaatactgccagtgctgtaactgtgcgaagcaccatccgaaggctgagggagcagaccgagagttagacaaccagtttacattattctcattttgttttctaagtcattgcagaaacttttgtacct

SEQ ID NO: 206 - DNA, 156 bp, Cicer arietinum
  misc_feature (65)..(65): n is a, c, g, or t
  misc_feature (132)..(132): n is a, c, g, or t
aaaaccctaaaccctgaaactggaacagaacgtgagcttaatcggaaggcatgtctaacttggangttgatgttggcggaatccgctgctacgaactccggctcatccggtgcacctttactccttcgccgncgaaggggttgaatcccgaacctc

SEQ ID NO: 207 - DNA, 255 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaa

SEQ ID NO: 208 - DNA, 191 bp, Cicer arietinum
acttctttctttatatgtatcgaattccaaggtggttttattgaagctgtgactgaaacagtttggagccttcttgtcccatcaattaagtaactatctgtgactccagtaactatccataaagtcttggaatgtcaattattccctgtcttggacatgttgagttgccaagctgttgaaactatgggatc

SEQ ID NO: 209 - DNA, 431 bp, Cicer arietinum
acccgtggctccatctcttctagtaaaatcgcgccgagtgaaaaccgcttattcctcagcactgtcggcctggacgcgctgaacaacgttgaccaattgtgggaagatcttctcgttgtcctgaataccgcagacctgcttgacaacgtcctcaggtccgttctcggacatgatctcggcgagctgcttggattcctcgtcatcgggggcatcctggaagcggaaggccatctcgatagcgtcgaggaggtacctcggccgcgaccacgctcgagcggccgcccgggcaggtacaggataccccgcttccttcaccatccagcataccaaggcacaaaaggcgctgtattttctcgagcccgtcacccgtcagcgggttcgggggcatactgtcgactttttccaccgaccagaattctctcacgcatcgc

SEQ ID NO: 210 - DNA, 368 bp, Cicer arietinum
acatgtaacgttaaatgtaacatattgttattgttaaggaaagaatcatcttccaatattctttgtctgcaaggattaattgataataactagccaaaagaattgcttgccagcaaacaagactgagtctgaaaaacccgaaaaaaggtcccgggtgcacacattattaccaggaagactttgtgttgtaatacgttgcaaacctcagtgtgacgcttcagccaatttctcttctttcttgcctcctgcaaataacttgtatcctccatagatgagtagtccccagccagttaaagaaacaatcacaaagtgctcttccttccatttagaagactcattgggtctttccagcaggcaactttaggggg

SEQ ID NO: 211 - DNA, 200 bp, Cicer arietinum
agcctgatagaattgttggagagttgctacaacctggcggctatctcaaattagttgaactgggccttgaagattgtgtgaacaatattgatgcgcagcaagtgtttggttatgcacttttcaaagatgggaaacatactcgtctctcttatcccttggataagcttcactcacatgtatctggcagaagctttcacaat

SEQ ID NO: 212 - DNA, 273 bp, Cicer arietinum
actgcaggagcagcaagactcttccaagagtcgcaatctcgcctcaaaagtgttatcgatgtcaatctttccatttccactgataacaaccacaccgccagcaattccctcggggagaggatcgtcctcttgaatctttgccgtaatatcttttccaagctccttcttgaactccttggcagcctcctcgatggccttcttgacaacatcataatccttcttgcgcgcgcggacctggagctcaggctcgttcagagcgtacaaaccctcgag

SEQ ID NO: 213 - DNA, 238 bp, Cicer arietinum
attcgatatattcacttggaagaatgaagagtgtgtggggtgaagattgtatggagtttaaaccggagaggtggttatcggttcagggagaccggttcgaaccgcctaaagatgggtataagtttgttgcgtttaatgctggaccgaggacttgtttggggaaggatttggcttaccttcagatgaagtctgttgctgcggctgtgttgattcgttaccggatttcaccggttcccgg

SEQ ID NO: 214 - DNA, 222 bp, Cicer arietinum
cgattttgcatccgcgccccaatctcgtttctcacttcttccctccgagccacccaaaatgactaagagaaccaagaaggccggtattgttggcaaatacggcacacgatatggtgccagtttaaggaagcagattaagaagatggaagtcagtcagcacagtaaattcttctgcgagttctgtggaaagtatgctgttaagaggaaggctgttggtatctg

SEQ ID NO: 215 - DNA, 300 bp, Cicer arietinum
acgttggatttcccatgataggctgccattaaccagcagatcaagctgtcatgggactgcatcctacttgaaacagccatctgactgcaccaccacgccatcaacccaacgagtgcagcagctgtcggcttcggagttaggtttcgggtcttgcagaaggccgtaacaggttcgataaaattcggggccttggattgccacatcggtcttttcacaccatatatccccatttttacaaatggatatcgcgcggtgtttaccactgccacaggccttgatcgtggcacagtcattgggggt

SEQ ID NO: 216 - DNA, 352 bp, Cicer arietinum
acttaactactgcctcggcagaagactgggatcggtgccgatgtatgaaataccctgagacgggaacccccaatgactgtgccacgatcaaggcctgtggcagtggtaaacaccgcgcgatatccatttctaaaaatggggatatatggtgtgaaaagaccgatgtggcaatccaaggccccgaattttatcgaacctgttacggccttctgcaagacccgaaacctaactccgaagccgacagctgctgcactcgttgggttgatggcgtggtggtgcagtcagatggctgtttcaagtaggatgcagtcccatgacagcttgatctgctggttaatggcagcctatcatg

SEQ ID NO: 217 - DNA, 432 bp, Cicer arietinum
actaacacaaatcggcaaattatttgatgctattcttactctgcacagaatggatgttttcaacattttgattaaggtatgcgcatctactcaagaagcttattgcaggtgcctacaccaacagcagcagcaagatgccatgcagcatgaaggtatggagttttagggaataaatcatctgctataaaaagcaaaccacccattaatgatgacattttgtgcactgtgtgagccgttctcaagtctggatctttcaatgcccttttagcaaatgctacctccatcatcccagtgtgaataactgaaaccattaatggattaactggaagaaatgctgcagatgccgccatcagcaactttgggttctcatttctgatggcccttgatagacaaacagttgttgtagctatcattgtgtagtcaacccatctc

SEQ ID NO: 218 - DNA, 383 bp, Cicer arietinum
acagagaagtatttaaggattacatacaggcaaagaggaacgatggtaacatagccataaaacaaaccagcagaccaagtcaccagatttatgtcatagtcccattccttatccttcaacttgtgtgctatatatgtcacaaatgttccaatagacgctgctacaaatattaatgtagtgcaaatccagaatggtccatacaaatcaggggttggtagaagtcttttcattaaaagttcctctgaatggaaaaagtgagtctataatcctctccaaaacatctgaagtgtcaacgtcaaagtatggtttgtaagcagcaactgcaaaattccgaagccaaccaccctgctggggttcatcagaaccagatacaggttttgaaa

SEQ ID NO: 219 - DNA, 278 bp, Cicer arietinum
acgcgctcagctctcaacagagagtgccttagcaccaatcagcttaccgtcagcgtgcgaagcaacccaatactcggtcctcgtagcgtctctcgacacttgatatacacgaacatcgttaccctgcgaggcttctcgaacagcctcgatgacgtcggtgtatttgccgtgagagtcccagttgagaggatcaaggatcctgatgtctgccgagtcgggggaggagtggttgatgagtttggcgaattcggtctcgctggggagaccattcttgccct

SEQ ID NO: 220 - DNA, 459 bp, Cicer arietinum
  misc_feature (359)..(359): n is a, c, g, or t
accagacggaaggttgattggctgactggcaagatgcgaagccgtgatcacacagtctcagcaactcatggagacatggaccagaacactagggacattattatgcgagaattccgttctgggtcttcccgtgttttaataactactgatcttctagctcgtggtattgacgtgcagcaagtgtcattagttataaattatgatctcccaacacagcccgagaactatcttcatcgtattggtcgtagtggaaggtttggtaggaaaggtgttgccatcaactttgtcacaaaggacgatgaaagaatgctgggtgacatccagaagttctacaatgtgataattgaggagctgccttncaatgttgcggaacttctgtgatgagattttttcttccatcatactagaggaaagttggtttctgagataagtgttatgtaatgttccccctttttgccc

SEQ ID NO: 221 - DNA, 297 bp, Cicer arietinum
actcactcttggaacgatgcatgggttgagaaagatgaacaaaatggtatattgctctacttgttgtatcgatcggatgctacattggagcatttgcggtgtcaggaattctttttatttggttcagccctggtggatatgactgtggtctcaatgtctttttccttgtcacgacgatgattcttgcttttgtgtttgcagttgttgctctacatcctaaggtgaacggaagcttgttgccagcatctgtgatatcactttactgtgcatatgtgtgctacacgggtctttctagcg

SEQ ID NO: 222 - DNA, 344 bp, Cicer arietinum
tgcttgcagctactcgcttatgatccttcatgatgaacaaatccctgtcactggtgacaaaatttccactttgttgaaagctgcaaaggttgatgttgaatcttattggccaagcttgtttgctaaacttgccgagaagaaaaaccttgaggatttgatattgaatgccacaggaggtggggctccggtttctgtttcagccccagttgctgctgctgccgcaactgcagttgccgcacctgcagaagagaagaaggaagaacccaaggaagagagtgacgacgacatgggattcagcttgtttgattaggagaacttttagtgtgatctagtctgatttttgt

SEQ ID NO: 223 - DNA, 364 bp, Cicer arietinum
  misc_feature (361)..(361): n is a, c, g, or t
tgcttgcagctactcgcttatgatccttcatgatgaacaaatccctgtcactggtgacaaaatttccactttgttgaaagctgcaaaggttgatgttgaatcttattggccaagcttgtttgctaaacttgccgagaagaaaaaccttgaggatttgatattgaatgccacaggaggtggggctccggtttctgtttcagccccagttgctgctgctgccgcaactgcagttgccgcacctgcagaagagaagaaggaagaacccaaggaagagagtgacgacgacatgggattcagcttgtttgattaggagaacttttagtgtgatctagtctgatttgtaccctggcccccgggcggncgc

SEQ ID NO: 224 - DNA, 376 bp, Cicer arietinum
accataatgatcctaccggcacacctcagttgagagactatgagcatatgctgcaggtgctcaatcacatttttagcacggcgccaaagtggacggatgcggcggagagtgtgggcatggtaggtgtgccgctttgtgccatctttgactatcctatgggaacgcctagtggttatgcggcgtttttggaccctgatgtgaatcggatgctgaagaaggttctcaaccactggggcaagtttctcatgacacctaaatcggctgaagttctgggagatcacaagcagggctggttcggacccgcgggtctgaatgacctcgtcgaggtcgccaacaagcccaacaaaacgaacttcaagtttgaggaggtctttga

SEQ ID NO: 225 - DNA, 177 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaa

SEQ ID NO: 226 - DNA, 238 bp, Cicer arietinum
acaagtctcttcaggatatcattgccattctgggtatggatgagttgtctgaggccgacaagcttactgtcgagcgtgcccgtaagatccagcgtttcctgagccacctttttcactgtccccccaggttttcactggtatcgagggtaagctcgtcgaccttaaggagaccatcaactccttcaaggccatccttaacggtgagggtgacagccttcctgagggtgccttctacatg

SEQ ID NO: 227 - DNA, 275 bp, Cicer arietinum
acgggaagtcgaggggcgcagagcccggattgtcgaaggctcgcgaagccggaatgtcggggtaagaagaagccgcaaataacacgtgagaagtagcgcccgaaggcggtgtcaagagctcgcgaagctcaatgtcgttgcagacactcgtcgcgaagaaaggtcaactctctgaatccctttcttcaggcagctgttagggtcccgttagccccacagctgcttttgctgccattttagcctgcaaaaattctctaccctagcaaagcgacctg

SEQ ID NO: 228 - DNA, 374 bp, Cicer arietinum
accctttgttgtaggatgccatttgctcgtaagttttgctccgttagctccttcctttgctgattttccaaatataccctgcgtccatttagagaaccctaagtcaccagattcattactattactatcaccatcaccaatttccaaatccgagagaagtgggtttgatggagatccaacgaatccagtcttaaggagtgcatagaagatgcagatcctaccagcccacagaacgggagtttcaagcaaagaagcatgggtagtggtaggttttttggatttttgactggaaaaaatgaatgatttgagggaaagggggggtgcagtagcaaaacctggaataagggttttgtgtaagataattgaagagggat

SEQ ID NO: 229 - DNA, 309 bp, Cicer arietinum
acgggaagtcgaggggcgcagagcccggattgtcgaaggctcgcgaagccggaatgtcggggtaagaagaagccgcaaataacacgtgagaagtagcgcccgaaggcggtgtcaagagctcgcgaagctcaatgtcgttgcagacactcgtcgcgaagaaaggtcaactctctgaatccctttcttcaggcagctgttagggtcccgttagccccacagctgcttttgctgccattttagcctgcaaaaattctctaccctagcaaagcgaccttgcccgggcggtcgctcgaaatctctagtgaattc

SEQ ID NO: 230 - DNA, 433 bp, Cicer arietinum
caagaagtgtccattcactggaaatgtttccatccgaggtcgtatcttagctggcacttgtcatagtgctaaaatgaatcgcactattattgttaggaggaattatcttcatttcatcaagaagtatcagagatatgagaaaagacactcaaacattcccgctcatgtatcaccttgcttccgtgttaaagaaggagatcatgttactattggccaatgcaggccactctccaagacagtgaggttcaacgtgttgaaggtgatcccagctggttcatccagcggtgttgccaagaaggcttttaccggaatttgagatttgactttcgattgagccaagacatctgattatatctattgaatgtagttctgattttctttatgttgactagtataaagatctgaacaattttgttttgccggcgaagttctg

SEQ ID NO: 231 - DNA, 436 bp, Cicer arietinum
accccatcgcctatggtatctctgacggcggtaacgtggttggtgtcactggaagcttcatcttctttggtatcctcgacgtccttttgattcctggactcgcttttgccttcatgttcttgtccaagcgttgggactacggtgcgctcaacctgcactttacgcagtatggtcgtgtcaatgctggcaatggtgtcttccctgagaagcgagcccctgttgctcctgcggctgaacaacctgttcctgccactgctacggctgctgtctaagacgtgtaaaccatgtctgaactgactgagaacaccagcatctgcttgttggacgcaatgatgagtgcgtttatgaataacgtgactatgaggacactcgtttagaatatggttatgggaggaaataatggtgaagacattgtggagatatcattcgagtcgga

SEQ ID NO: 232 - DNA, 445 bp, Cicer arietinum
actacgcatatttccatgcaagtaaccaccggtcattatgaatgataccagtgacacaacacctgctggaaatatcttccccgatttcttgaagcgagaacccatcactgcaagtagtgcagcagatatgcctagtcccacagatgatgctaaaacaggtcttccaggtagctcagtataaacataatacagcagtgcagaagacaaacccccagccaaaagtgacttctgactgccactcttgagatagcccattacaccacccgctccgacgagaatagcataacctagagttaatttctgagacattgacaaagccattttcctcttatctccgtccgatccttctttgcctttatcactattatctcctccgccgccgctgccaccaccgccgccgacaaaatcgtctccgtttccttcgaaacctccgccgccgctggta

SEQ ID NO: 233 - DNA, 292 bp, Cicer arietinum
acattttcaaaagccaatgctttagctgaatcaaacatcctatctagatgctcctcaagtttaaatatctttttatcatacactcgaagaccctcccaaactgagtcacctccttggacaactgagtcaaacacagaaaccttagcactctcacgtgtcacaatctcatcaccaacccaagcaaccaatttctcatttgcaggaactggaaggtcgggaggaggtgaaggagagctcagaatggataacttcttctttacatggctccggagcatgttgtagtgaggcagag

SEQ ID NO: 234 - DNA, 199 bp, Cicer arietinum
tgttaattattctcccctaacagcgcgtgaatcgacgaaatggcgaggattaaggtgtatgagctgaggaacaaaaccaaggcggatttgttgaaccagttgaaagatctgaaggcggaactcgctttgctacgagtggcgaaagtcaccggcggtgcgcctaacaagctctccaaaataaaagttgtgaggctttcaa

SEQ ID NO: 235 - DNA, 109 bp, Cicer arietinum
tgagaccccaagccggaaatattggtctgatcatacaaaaacttgcaccgatagaaagccctcggcgacagaaatctagagggactaattttttgtctgcatttcttcc

SEQ ID NO: 236 - DNA, 294 bp, Cicer arietinum
ctctgcctcactacaacatgctccggagccatgtaaagaagaagttatccattctgagctctccttcacctcctcccgaccttccagttcctgcaaatgagaaattggttgcttgggttggtgatgagattgtgacacgtgagagtgctaaggtttctgtgtttgactcagttgtccaaggaggtgactcagtttgggagggtcttcgagtgtatgataaaaagatatttaaacttgaggagcatctagataggatgtttgattcagctaaagcattggcttttgaaaatgtac

SEQ ID NO: 237 - DNA, 382 bp, Cicer arietinum
actcatcaccagaagacgatgaccaccgagtcagaagataaggaatggaccgccaagtatggtcctgaggcgcaagaggttatccgcaagacggtcgaggacaacgtagctgattacgagtacctgaagcagtttgcgctacctatctaaattaaattagctatgtgctcgctctgctttttcaggggttgctttttttttctctacggtttggacctgttctggcgtttccgccccatatcagattggacttttgcacctggtgacgaaccgaggtaatgaatgatttatgagtgtttggatttagttgatggtacagctattatcgtacagcgactttggcaccacgccacctgatgaatatatacgtgctccttcatcc

SEQ ID NO: 238 - DNA, 296 bp, Cicer arietinum
accgctaccgttttcgtgatattctccgagtaactgggtttcataactctgctcctcagtttcactttgtgcgtcgaaagaacgtgttgcttagtattgactctgataaaacagacgagtcagagctacagagagctatggaaaatgcttcaaagttgcttgtggagttcaacacgagtgtggtcgaatacacgagctatgcagacacaaagacaataccaggtcactatgtgatatattaggagttgttgaccaaggacatttcaaactcaccgagtaccgaggtgcttaatcaa

SEQ ID NO: 239 - DNA, 462 bp, Cicer arietinum
accgctaccgtgttggtgatattctccgagtaactgggtttcataactctgctcctcagtttcactttgtgcgtcgaaagaacgtgttgcttagtattgactctgataaaacagacgagtcagagctacagagagctatggaaaatgcttcaaagttgcttgtggagttcaacacgagtgtggtcgaatacacgagctatgcagacacaaagacaataccaggtcactatgtgatatattaggagttgttgaccaaggacatttcaaactcaccgagtaacgaggtgcttaatcaatgttgtctggaaatggaggaatcattgaactcggtttataggcagtgtagggtcgctgaccattcgattggaccactagaaataagggttgtgaagaaaggaacttttgaggagcttatggattatgcaatctcaagaggtgcatcaataaatcaatataaggtac

SEQ ID NO: 240 - DNA, 463 bp, Cicer arietinum
actatgcgaccatgtctctcaaatgctgtcaaagttcaggcagaagaattaaccaaagaggactttcagggctccaagtggttggtgttgagatatgcaatacttaatttggaagttattcaagcagccattcttttagccaaacaggaaggtctttttgtttccttggatttggctagttttgagatggttagaaatttcaaacagccacttctgaagctattggagtctggaaacatagacctttgctttgctaatgaggatgaggcaacagagcttctaagaggtgaacagaatgctgatccagtagctgctgtagaatgtctggccaaatactgtcaatgggctgtagtaacattgggttctaatggatgcatagctaaacataaaaatgagattgtatgcgttccagcgataggtgaagcaaaggcaattgatgctacaggtgcaggggacctttttg

SEQ ID NO: 241 - DNA, 163 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcag

SEQ ID NO: 242 - DNA, 219 bp, Cicer arietinum
actatgcgaccatgtctctcaaatgctgtcaaagttcaggcacaagaattaaccaaagaggactttcagggctccaagtggttggtgttgacatatgcaatacttaatttggaagttattcaagcagccattcttttacccaaacaggaaggtctttttgtttccttggatttggctagttttgagatggctagaaatttcaaacagccacttctgaag

SEQ ID NO: 243 - DNA, 433 bp, Cicer arietinum
gcggggacgccatcggctccctaacagcagttttcagagaaggaattttggagagttcaccttctctgacaacacctttgtcggatctaatggcggcacctcagaaccagaacgccttagatatcggagggcggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtgaactgcgtcagcagatgtagcgatgcgtgagagaattctggtcggtggaaaaagtcgacagtatgcccccgaacccgctgacgggtgacgggctcgagaaaatacagcgccttttgtgccttggtatgctgg

SEQ ID NO: 244 - DNA, 352 bp, Cicer arietinum
acaactgaagagccaagttcatgatcttaagggaagttaattaaaaagaaaagcaatcaatagaaatagtaaacatgtccttaatttatacttatagatgctttttagttttgaattttaaccttgtctatgaaagacttggtatcaattcccttgctgtaaaagttgtcaaaaaattcttgttgagtgaaatcacgataaattggtggtttatttggagataacaattcaggaagaggcccatggtaaccttctcctttccatttactcaagttcaagaacatcacaattgatattcttgatttttcatgtgaattggccaataccctgtgttgaacactagtgaccttgc

SEQ ID NO: 245 - DNA, 349 bp, Cicer arietinum
  misc_feature (16)..(16): n is a, c, g, or t
actggctcctttgcgnaccttcggcgagaatctcgcagcttcaacttccccactcgtgtcgaccaggacaacgtctctgccaagtttaaggacggtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggccccccgttgggaagtttcttagcatgaaatagcattgtaggcctggcttggtcattcgctccttgtacctgcccgg

SEQ ID NO: 246 - DNA, 120 bp, Cicer arietinum
acgaagaacattatcaatcagttcagttgtcaccataaatccacttctctgaattgcttgtgaaactaaccaattcctctggcttataccacaacttaatctcatcctttgcagtctctg

SEQ ID NO: 247 - DNA, 384 bp, Cicer arietinum
acacctttgattgtccccttctcttcatgtagggaagtgactgttccttgctccaaatttacattgggaagggaagcagccttctctcgcattctctgaataaaacggccattgtgaaagcttctgccagatacatctgagtgaaacttatccaagggataagagagacgggtatgtttcccatctttgaaaagtgcataaccaaacacttgctgcgcatcaatattgttcacacaatcttcaaggcccagttcaactaatttgagatagccgccaggttgtagcaactctccaacaattctatcaggctcactcagacctctttcaatgacaagcactcggcgtccatccttgccgagagtgtgagcgagtgcagcgccagcg

SEQ ID NO: 248 - DNA, 358 bp, Cicer arietinum
actggtgcacatcgtttttcttatgcttgtgtgtttccctgaacttattatgccaacagtgtttctatacgtgtttgttatcgggatgtggaactggagattccgcccgagataccctcctcacatgaacaccagactctcttacacagacggagtgaccctagacgagcttgacgaagaattcgacacatttccttccgcaaagagccctgatatagtgcggtggaggtatgatcggttaagaagtgtggctggaagggttcaaagcgtcgttggagatttagctactcaaggggagaggatccaatcacttgtgagctggcgcgatccgcgcgcgagttccatgttcatggtattt

SEQ ID NO: 249 - DNA, 460 bp, Cicer arietinum
accgctaccgtgttggtgatattctccgagtaactgggtttcataactctgctcctcagtttcactttgtgcgtcgaaagaacgtgttgcttagtattgactctgataaaacagacgagtcagagctacagagagctatggaaaatgcttcaaagttgcttgtggagttcaacacgagtgtggtcgaatacacgagctatgcagacacaaagacaataccaggtcactatgtgatatattaggagttgttgaccaaggacatttcaaactcaccgagtaacgaggtgcttaatcaatgttgtctggaaatggaggaatcattgaactcggtttataggcagtgtagggtcgctgaccattcgattggaccactagaaataagggttgtgaagaaaggaacttttgaggagcttatggattatgcaatctcaagaggtgcatcaataaatcaatataaggt

SEQ ID NO: 250 - DNA, 190 bp, Cicer arietinum
acggttctagggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatggg

SEQ ID NO: 251 - DNA, 425 bp, Cicer arietinum
acatccattgccaattttctaatgtcacctcaccaccaagagaacgaataacagacccaccactgcatgttcctactttgcagcattcttcaagtgataagcctttgatcactccatacaaaaatccacttgcaaaaaggtcccctgcacctgtagcatcaattgcctttgcttcacctatcgctggaacgcatacaatctcatttttatgtttagctatgcatccattagaacccaatgttactacagcccattgacagtatttggccagacattctacagcagctactggatcagcattctgttcacctcttagaagctctgttgcctcatcctcattagcaaagcaaaggtctatgtttccagactccaatagcttcagaagtggctgtttgaaatttctaaccatctcaaaactagccaaa

SEQ ID NO: 252 - DNA, 358 bp, Cicer arietinum
gtgtcaagttcgatagccatggcctctctcgcacgtggagccgcatctctaactcgcgctactctttccgcttccaaatctccgattcaactcatccaacgtcgcggtctcgccggagctgcagatcaccatggtccccctaaagttgcctgctggaaagacccaatgagtcttctaaatggaaggaagagcactttgtgattgtttctttaactggctggggactactcatctatggaggatacaagttatttgcaggaggcaagaaagaagagaaattggctgaagcgtcacactgaggtttgcaacgtattacaacacaaagtcttcctggtaataatgtgtgcacccgggacct

SEQ ID NO: 253 - DNA, 238 bp, Cicer arietinum
acgacggattccgcctccggaaacttctcctgcgtcacaggcgactgtggatccggaaaaataccatgcggcggccgtagtggatcgccgcctgtgacgctagcggagttctcaataaacagtttcaacaatcaagacttttatgatgtaagcttagttgacggttataacgtcccgatggatgtgattccgttaagtaactctggaaagtgtaaaagcacgggttgtcctacggatc

SEQ ID NO: 254 - DNA, 427 bp, Cicer arietinum
actgctattatcatcataagcataactatatgcttgaggacatgcctttttgaatatctgagcatacacacttggttcacaagtctctggagttgaatgattcccaacacaacaaaaaaactgcaaattgaaatttgtacaaggaccctgacacgccacaactatcccattttccgttactttcaactccgttggacacaccgcattcagatccgtaggacaacccgtgcttttacactttccagagttacttaacggaatcacatccatcgggacgttataaccgtcaactaagcttacatcataaaagtcttgattgttgaaactgtttattgagaactccgctagcgtcacaggcggcgatccactacggccgccgcatgctatttttccggatccacagtcgcctgtgacgcacgagaagttt

SEQ ID NO: 255 - DNA, 429 bp, Cicer arietinum
acacacttgacttacaatctcacacttctacaacaaaatgaaaagaagaagagagtatgacatttggcaaccaaattaagcacactaaatataataaaatgtgtcacaaaacaacacgccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccactttgtgcaacacaaacttggtttct

SEQ ID NO: 256 - DNA, 413 bp, Cicer arietinum
  misc_feature (405)..(405): n is a, c, g, or t
acaagcttgttggaatcaaagtattgactcctacaaaggaatttgccgcacagcactatcacgacctgaaagaaagacccttcttcaatggattgtgtgacttcctaagctctggccctgttgttgcaatggtgtgggaaggacgaggggttattacctatggccggaaactaattggagccacagatccacagaaatctgagcctggaaccattagaggcgatctggctgttgttgttggaagaaatataatccatgggagcgatggaccagagactgcaaaggatgagattaagttgtggtttaagccagaggaattggttagtttcacaagcaattcagagaagtggatttatggtgacaactgaactgattgataatgttcttcaccttgccccgggcggncgctcgaa

SEQ ID NO: 257 - DNA, 351 bp, Cicer arietinum
acaccataggtggttcattgggatactctggagggaaacatatatcaaagataaacaatccatcatgatacggagttccagatgcaccaacaatagctgctcgcatgagatccattcgttcttcaaacgcacgaacatagatagagtcaggaagacttttctcagggatgctccattcttgctgaaccttttttacccaacctctttttacctgggatgttgacaatccttttccctcatcaaaaaaatgatggtcagagcaactttctataacatcaaactgcttaaactggtttgaactgttgctgtctaaagaaaatggacaatcgttattgtcatggatcctattga

SEQ ID NO: 258 - DNA, 358 bp, Cicer arietinum
agcgtgcccgtgtttacggctctggacttgttgagaccattgcactcataacctcgaggttcgctagaaagacccgtgtagcacacatatgcacagtaaagtgatatcacagatgctggcaacaagcttccgttcaccttaggatgtagagcaacaactgcaaacacaaaagcaagaatcatcgtcgtgacaaggaaaaagacattgagaccacagtcatatccaccagggctgaaccaaataaaaagaattcctgacaccgcaaatgctccaatgtagcatccgatcgatacaacaagtagagcaatataccattttgttcatctttctcaacccatgcatcgttccaagagtgagt

SEQ ID NO: 259 - DNA, 457 bp, Cicer arietinum
acaaaagatttcaagctgaggaacttctaggatatggttccatcagtgatttactcactgtcaaattcctaatgggaacaagtggatcagttcaagttcaaggaagatgtccagctaaacatggcttaagtcgtttccgaatggaacgaggaacagaagagtggaaagttgattgcatttgtggtgctaaggatgatgatggagagaaaatgttagcatgtgatacttgtggtgtctggctgcataccagatgtgctggaattgggagttctgatggtatgccttccaagtttatatgtataagatgtgttaactcataccgtcggggaacaaaaaaattgccagtctctagtgtgggagatggcgaggcttgtaaattgaacacatcttgcagagatgaagcggtagctactgactctgcagctgttgcttgtaatataaatgtgaattttggtgt

SEQ ID NO: 260 - DNA, 284 bp, Cicer arietinum
acaccatgctactcttcctacagtctcgaacaacatgaccaggccgagaatatctagacgcaatatcccgagcgccgactcgcaacgaaaccagcgaaacgaacaagaattataggaactattgagacagataccggagtggaatgaagctattactcgtcttgcttcttgttcttcttcttctttccaccaccggaatgaccacccaatgttgtgcttgtgggctgatcctgaaggtgaacaacaatttgggtccatgactcttccttgtcccactcgaaacc

SEQ ID NO: 261 - DNA, 384 bp, Cicer arietinum
acgaaacctcaagggtgtaacaatcaaggatgcattagacgctatccacaaggcatataagaagcgggccgatgatgagctcgacaagccctacctcgctggtttcgagtgggacaaggaagagtcatggacccaacttgttgttcaccttcaggctcagcccacaagcacaacattgggtggtccttccggtggtggaaagaagaagaagaacaagaagcaagacgagtaatagcttcattccactccggtatctgtctcaatagttcctataattcttgttcgtttcgctggtttcgttgcgagtcggcgctcgggatattgcgtctagatattctcggcctggtcatgttgtttgcgactgctggaagcgtcgcttggtgt

SEQ ID NO: 262 - DNA, 434 bp, Cicer arietinum
acgacggattccgcctccggaaacttctcctgcgtcacaggcgactgtggatccggaaaaatagcatgcggcggccgtagtggatcgccgcctgtgacgctagcggagttctcaataaacagtttcaacaatcaagacttttatgatgtaagcttagttgacggttataacgtcccgatggatgtgattccgttaagtaactctggaaagtgtaaaagcacgggttgtcctacggatctgaatgcggtgtgtccaacggagttgaaagtaacggaaaatgggatagttgtggcgtgtcagggtccttgtgctgctttcaatttgcagtttttttgttgtgttgggaatcattcaactccagagacttgtgaaccaagtgtgtatgctcagatattcaaaaaggcatgtcctcaagcatatagttatgcttatga

SEQ ID NO: 263 - DNA, 245 bp, Cicer arietinum
acgacggattccccctccggaaacttctcctgcgtcacaggcgactgtggatccggaaaaatagcatgcggcggccgtagtggatcgccgcctgtgacgctagcggagttctcaataaacagtttcaacaatcaagacttttatgatgtaagcttagttgacggttataacgtcccgatggatgtgattccgttaagtaactctggaaagtgtaaaagcacgggttgtcctacggatctgaatgc

SEQ ID NO: 264 - DNA, 342 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaa

SEQ ID NO: 265 - DNA, 439 bp, Cicer arietinum
cggccgaggtatagcgcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctgcccgggc

SEQ ID NO: 266 - DNA, 437 bp, Cicer arietinum
acaccataggtggttcattgggatactctggagggaaacatatatcaaagataaacaatccatcatgatacggagttccagatgcaccaacaatagctgctcgcatgagatccattcgttcttcaaacgcacgaacatagatagagtcaggaagacttttctcagggatgctccattcttgctgaaccttttttacccaacctctttttacctgggatgttgacaatccttttccctcatcaaaaaaatgatggtcagagcaactttctataacatcaaactgcttaaactggtttgaactgttgctgtctaaagaaaatggacaatcgttattgtcatggatcctattgacttctggatatgaagtcctgtcttcagtagattgaaactcggtcgttggatatggttcaatgcagcggttgcaagtttgacctgcc

SEQ ID NO: 267 - DNA, 320 bp, Cicer arietinum
actgcattaatttcttcttgataagctttagcttcagcagtttcatccataagtttctgaacatcctcaatgtttatctcactttgtatggctttcattgcttcattaccggccttcaaactttcaaacacagatttctgcttgcttgccagttcaatatctgctaattgttgctcaacatttataagccaggcgtcaacttgcttcaacaattcttcttgtgtcttttttttctttaatgccagcaaggccctatctttcttcttttcacgaatcaagtctcgtgcagcttgcttttctgcttcaataatagcatcaag

SEQ ID NO: 268 - DNA, 242 bp, Cicer arietinum
accaatggcccaaactggctcataggccaaaacaacattatcccaatttgatactttagctgcaattgcctttgtttgctcagcaacaacagcgattgtagttccagcttcacgctcctcaagagtctcaccgatgcaagcaataactttcctccctagtgaaagtgttttacgcaactttatctccgacaaactcatttgattcatttagaagctgccttcgttcagagtgaccaagaata

SEQ ID NO: 269 - DNA, 294 bp, Cicer arietinum
actacatattgcaaatcaataatcctctccttcatcttcatcttctgctccctcagcaccgacttcttcataatctttctcaagagcagcaagatcttcacgtgcttctgagaactccccttcttccatgccctcaccgacataccagtgaacaaaggcccttttagcatacataagatcaaacttgtgatcaatgcgagagaagacctctgctacagcagtgttgttgctgatcatgcaaactgctctctgcacctttgcaaggtcaccaccaggcacaactgatggaggctg

SEQ ID NO: 270 - DNA, 271 bp, Cicer arietinum
gcatgctcccggtccccatggcggccgagggaactcgattagcgtggtcgcggccgaggtacatctctattggcacgtaaaccgttaatggccaaaaggacagtgaaccaatcaggcccagaaagtcattgaagaatggaaatagcatacctatcaaagcagtgactacaacatatgttgttctccacactaccctgaagaagttgacatagtaggttccacataaaggaatggttacagcgtgctctccatttacaaattgactattgga

SEQ ID NO: 271 - DNA, 238 bp, Cicer arietinum
acgaaacctcaagggtgtaacaatcaaggatgcattagacgctatccacaaggcatataagaagcgggccgatgatgagctcgacaagccctacctcgctggtttcgagtgggacaaggaagagtcatggacccaacttgttgttcaccttcaggctcagcccacaagcacaacattgggtggtccttccggtggtggaaagaagaagaagaacaagaagcaagacgagtaatagctt

SEQ ID NO: 272 - DNA, 374 bp, Cicer arietinum
caaacttgcaaccgctgcattgaaccatatccaacgaccgagtttcaatctactgaagacaggacttcatatccagaagtcaataggatccatgacaataacgattgtccattttctttagacagcaacagttcaaaccagtttaagcagtttgatgttatagaaagttgctctgaccatcatttttttgatgagggaaaaggattgtcaacatcccaggtaaaaagaggttgggtaaaaaaggttcagcaagaatggagcatccctgagaaaagtcttcctgactctatctatgttcgtgcgtttgaagaacgaatggatctcatgcgagcagctattgttggtgcatctggaactccgtatcatgatggatt

SEQ ID NO: 273 - DNA, 344 bp, Cicer arietinum
acagggaaaccccgcttccttcaccatccagcataccaatggcacaaaaggtgctgtatttctcaagcccgtcacccgtcagcgggttcgggggcaatctattgtcgaactttttccaccgaccagaattctctcgcgcatcactacatctgctgacgcagtccacaatctccagtaaccaagttgtagctcgtagtcgactgtcgaggcggcagggaaaaacctcgggaaggaatcagaggccgacggtgcggcttgccttccaaggagaaaaacccatcgcaatcggcgtcgttgatcggaaggatgtcactacgaatgcccggggcatcgtcctccgatat

SEQ ID NO: 274 - DNA, 408 bp, Cicer arietinum
actcattacccccaagaggcacctctctactcgtagctcgccctacagtagttgtcggtgaagcacgtcccattggacatcaatacagttgatcctcgcagagcttccctccagcagcgtctcccatctagttcatccagcatatcatcggcacaaaggcgcatttactttcaagaggtcatcccgtcagcgggaactcgtccctctccagcctagaattctcttgcacagatagatcaagtagctttccataccctaaggcaagaaatccatgacccctaagattgccagtagctgcaacctagaaccgtgcatccttggggaaaaccctcgcaggagaaaacaccaaagcggctagaacgctgctctgtggacgaggtggtcgcctctttccacggcctctacgta

SEQ ID NO: 275 - DNA, 439 bp, Cicer arietinum
  misc_feature (47)..(47): n is a, c, g, or t
gcttgtcccaacagaaaacaactaaaaacccaaattcaaagaccttngaattgaatagtcctcttttgatcataatcattagtattcatctatgatcgatttggattcggttcagtccatacccgagttataaaacacatcttcatcgaattgacaaatcgaaatcgatggggaatatattcgtcaagaaacccaaggtgacggatgtcgatcgtgcaattcttgcactcaagacccagagacgtaaacttgcccaatatcaacaaaagcttgatgctattattgaagcagaaaagcaagctgcacgagacttgattcgtgaaaagaagaaagatagggccttgctggcattaaagaaaaaaaagacacaagaagaattgttgaagcaagttgacgcctggcttataaatgttgagcaacaattagcagatattgaact

SEQ ID NO: 276 - DNA, 437 bp, Cicer arietinum
accgctaccgtgttggtgatattctccgagtaactgggtttcataactctgctcctcagtttcactttgtgcgtcgaaagaacgtgttgcttagtattgactctgataaaacagacgagtcagagctacagagagctatggaaaatgcttcaaagttgcttgtggagttcaacacgagtgtggtcgaatacacgagctatgcagacacaaagacaataccaggtcactatgtgatatattaggagttgttgaccaaggacatttcaaactcaccgagtaacgaggtgcttaatcaatgttgtctggaaatggaggaatcattgaactcggtttataggcagtgtagggtcgctgaccattcgattggaccactagaaataagggttgtgaagaaaggaacttttgaggagcttatggattatgcaatctcaagaggt

SEQ ID NO: 277 - DNA, 318 bp, Cicer arietinum
accgctaccgtgttggtgatattctccgagtaactgggtttcataactctgctcctcagtttcactttgtgcgtcgaaagaacgtgttgcttagtattgactctgataaaacagacgagtcagagctacagagagctatggaaaatgcttcaaagttgcttgtggagttcaacacgagtgtggtcgaatacacgagctatgcagacacaaagacaataccaggtcactatgtgatatattaggagttgttgaccaaggacatttcaaactcaccgagtaacgaggtgcttaatcaatgttgtctggaaatggaggaat

SEQ ID NO: 278 - DNA, 425 bp, Cicer arietinum
acaccaaaattcacatttatattacaagcaacagctgcagagtcagtagctaccgcttcatctctgcaagatgtgttcaatttacaagcctcgccatctcccacactagagactggcaatttttttgttccccgacggtatgagttaacacatcttatacatataaacttggaaggcataccatcagaactcccaattccagcacatctggtatgcagccagacaccacaagtatcacatgctaacattttctctccatcatcatccttagcaccacaaatgcaatcaactttccactcttctgttcctcgttccattcggaaacgacttaagccatgtttagctggacatcttccttgaacttgaactgatccacttgttcccattaggaatttgacagtgagtaaatcactgatggaaccata

SEQ ID NO: 279 - DNA, 408 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctccaggt

SEQ ID NO: 280 - DNA, 296 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcc

SEQ ID NO: 281 - DNA, 407 bp, Cicer arietinum
acatgtaacgttaaatgtaacatattgttattgttaaggaaagaatcatcttccaatattctttgtctgcaaggattaattgataataactagccaaaagaattgcttgccagcaaacaagactgagtctgaaaaacccgaaaaaaggtcccgggtgcacacattattaccaggaagactttgtgttgtaatacgttgcaaacctcagtgtgacgcttcagccaatttctcttctttcttgcctcctgcaaataacttgtatcctccatagatgagtagtccccagccagttaaagaaacaatcacaaagtgctcttccttccatttagaagactcattgggtctttccagcaggcaactttagggggaccatggtgatctgcagctccggcgagaccgcgacgttg

SEQ ID NO: 282 - DNA, 426 bp, Cicer arietinum
acaatatgtttataaatctacggttttgtggttgacgagaatgattttgctctccccctaaaatattaataaagctactcaaaataaattaatttgcaatattataattttaactatcgcgttgtaagtcagttcactttcaatagtaaaacaaaattttgcacttcgaaagcagcagatgaagcaactgaagcagctatcttctgcgctttgattctttccgcatctctgttatgtagctctccatatttgatttttcccataagcatctaagcacaagatcttcctttgttgcttcgtctatacttctccatctatcatctggaaaaccaagggacctttgtgtcagataagaagcatcatcccaagaataagggcactttttcaccttgtatgtccaaaaccaaaagccagaccataacagca

SEQ ID NO: 283 - DNA, 147 bp, Cicer arietinum
gatttacacactcttcaacacatcaacacaaacacaatggctttcttccctcgcaacttctacaactccgatgcttcctttactcccctcttccgtctcctcgacgacttcgatagctactctcgtcagggacaacagaacggtggt

SEQ ID NO: 284 - DNA, 436 bp, Cicer arietinum
actattattagcccatggtataagaagggcttggcaagtttatcacagtagttttggtcttggtcatcatgtttatgctgtttgttattccttgtgatccaattccactgtcctttataccctgaaagggaaaatgatctggcccacgagctggggcagaatttatctgaactgttcctgtttccatcgcatcactaatcaagattgctttgttcacatcttttgtgaatacacatccctgaagtccaaagttgctagcattacaatggtggataccttcttcaacagaattgatcctaattactggcaaaactggtccaaatggctcttcccatgcaattctcatgtctggcttaacattatcaagtaacaaaggccaaatgagattcccttctcttttatactcctggcagaatgttgctcctttctgtttagc

SEQ ID NO: 285 - DNA, 406 bp, Cicer arietinum
actcattacccccaagaggcacctctctactcgtagctcgccctacagtagttgtcggtgaagcacgtcccattggacatcaatacagttgatcctcgcagagcttccctccagcagcgtctcccatctagttcatccagcatatcatcggcacaaaggcgcatttactttcaagaggtcatcccgtcagcgggatctattcctctccagcctagaattctcttgcacagatagatcaagtagctttccataccctgaggcaggaagtccatgatcccctaagatcgccagtagctgcaacctaggaccatacatccttggggaaacccctcgcagggaaaaacccaaggcggctagaacgctgctctgtggacgaggtagtcgcctcgttccacggtctccaggt

SEQ ID NO: 286 - DNA, 437 bp, Cicer arietinum
gcttgtcccaacagaaaacaactaaaaacccaaattcaaagaccttgaattgaatagtcctcttttgatcataatcattagtattcatctatgatcgatttggattcggttcagtccatacccgagttataaaacacatcttcatcgaattgacaaatcgaaatcgatggggaatatattcgtcaagaaacccaaggtgacggatgtcgatcgtgcaattcttgcactcaagacccagagacgtaaacttgcccaatatcaacaaaagcttgatgctattattgaagcagaaaagcaagctgcacgagacttgattcgtgaaaagaagaaagatagggccttgctggcattaaagaaaaaaaagacacaagaagaattgttgaagcaagttgacgcctggcttataaatgttgagcaacaattagcagatattgaac

SEQ ID NO: 287 - DNA, 440 bp, Cicer arietinum
  misc_feature (47)..(47): n is a, c, g, or t
gcttgtcccaacagaaaacaactaaaaacccaaattcaaagaccttngaattgaatagtcctcttttgatcataatcattagtattcatctatgatcgatttggattcggttcagtccatacccgagttataaaacacatcttcatcgaattgacaaatcgaaatcgatggggaatatattcgtcaagaaacccaaggtgacggatgtcgatcgtgcaattcttgcactcaagacccagagacgtaaacttgcccaatatcaacaaaagcttgatgctattattgaagcagaaaagcaagctgcacgagacttgattcgtgaaaagaagaaagatagggccttgctggcattaaagaaaaaaaagacacaagaagaattgttgaagcaagttgacgcctggcttataaatgttgagcaacaattagcagatattgaactg

SEQ ID NO: 288 - DNA, 329 bp, Cicer arietinum
actagtgattaccggtcatttaaggcaattccagccttggcatcaaagatacttgacctagtatcaccaatgaagtcggtggagaccacatcatcttcagtgtatccgagaatgcctttcaacttgccctcagactcctccttgatagcagccttgatttcgtcgtaggtagcggccttctcaagcttcactgtaaggtctacaactgagacatcaacagttgggacacggaatgccattccggtcaattttccattcaaaacaggaagcactttgccaacagccttagcagctccggtactgctaggaatgatgttaaatgaggcagc

SEQ ID NO: 289 - DNA, 432 bp, Cicer arietinum
gcttgtcccaacagaaaacaactaaaaacccaaattcaaagaccttgaattgaatagtcctcttttgatcataatcattagtattcatctatgatcgatttggattcggttcagtccatacccgagttataaaacacatcttcatcgaattgacaaatcgaaatcgatggggaatatattcgtcaagaaacccaaggtgacggatgtcgatcgtgcaattcttgcactcaagacccagagacgtaaacttgcccaatatcaacaaaagcttgatgctattattgaagcagaaaagcaagctgcacgagacttgattcgtgaaaagaagaaagatagggccttgctggcattaaagaaaaaaaagacacaagaagaattgttgaagcaagttgacgcctggcttataaatgttgagcaacaattagcagatat

SEQ ID NO: 290 - DNA, 291 bp, Cicer arietinum
actggagcaaagagcaaggggcaacctatcttactaataataagaaacgggttgagataggcgacatgtagcttgcttccaagccgacccggccgcgaggaatcaagagatctttgacggtgctgactttctcgagtggtggaagaaggcgcccaaaagtgacaagcagtcgcggtcgaagcttggctctaggcgataggctagcagtaatcttagttatagtgagttagaacgatttggagaataaagatttgggggagagtttagagagagcgcgagacatgggagaaa

SEQ ID NO: 291 - DNA, 235 bp, Cicer arietinum
acagagcttacctggagaccgtggaatgaggcgactacctcggccacagagcagcgttctggccgctttggggttttctcctgcaagggttttccccaaggatgctcggtcctaggttgcagctactggcgatcttaggggatcatggacttcctgcctcagggtatggaaagctacttgatctatctgtgcaagagaattctaggctggagaggaatagttcccgctgacggga

SEQ ID NO: 292 - DNA, 477 bp, Cicer arietinum
gggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaag

SEQ ID NO: 293 - DNA, 429 bp, Cicer arietinum
cggccgaggtacagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtac

SEQ ID NO: 294 - DNA, 411 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctcca

SEQ ID NO: 295 - DNA, 291 bp, Cicer arietinum
actggtgcacagagcaaggggcaacctatcttactaataataagaaacgggttgagataggcgacatgtagcttgcttccaagccgacccggccgcgaggaatcaagagatctttgacggtgctgactttctcgagtggtggaagaaggcgcccaaaagtgacaagcagtcgcggtcgaagcttggctctaggcgataggctagcagtaatcttagttatagtgagttagaacgatttggagaataaagatttgggggagagtttagagagagcgcgagacatgggagaaa

SEQ ID NO: 296 - DNA, 416 bp, Cicer arietinum
acagagcttacctggagaccgtggaatgaggcgactacctcgtccacagagcagcgttctggccgctttggggttttctcctgcaagggttttccccaaggatgcacggtcctaggttgcagctactggcgatcttaggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggaggaaagctctgctaagatcagctgtattgatgtccgatgggacgtgcttcaccgacaactactgtagggcgagctacgagtagagaggtgcctcttgggggtaatgagt

SEQ ID NO: 297 - DNA, 382 bp, Cicer arietinum
acatgccattttgcccagacggccacgatgctgtgctccatgaattgacaaacttgcacgaggtatttccggctctaaacatgcactgccatagatatccatggctctgagaatttttcaatagatttactcttttccaaaatcagcattgtaatgtgcactggattcaagtttctttgcctcattcagtttcctaacagccttcataaaatcttcgtggatcacataatcacgctctgcacgaattgctgacattccagcttcggtgcacacatttcggagatcagccccattaaacccctctgcaagcttcacaaccgcttcatagtctatttcaccatgcttagcaattccagctgcatggatcttaagaatttccatc

SEQ ID NO: 298 - DNA, 319 bp, Cicer arietinum
caaggatgcacggtcctaggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggctagctacgggtagagaggtgccttttgggggaatgagt

SEQ ID NO: 299 - DNA, 191 bp, Cicer arietinum
actcccgaatataaacaccttgctccaagaatggggtctgagcatctggcgaagatgctctcaaagcatttggagacagtaatcaagtccaaaattccaggcattcagtctcttattaacaaaacaattcatgaaattgaaactgaactgactcgtttgggaaagcctgttgcagctgatgctgggggcaa

SEQ ID NO: 300 - DNA, 435 bp, Cicer arietinum
gccgtgttaggagcgggattttctgcaggccacgcgaccacacaaaactgcggggatgctatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgacaatagattgcccccgaacccgctga

SEQ ID NO: 301 - DNA, 414 bp, Cicer arietinum
actagtgatttcggcggccgcccgggcaggtcagttacacaatcggtgcttgcatttccatcctttgtatacacaacacacttcatacccaaccaatctcactgaaccttaacaatggcatcttctactctcaccaacaccatctctcacactttttctcctctcaaatcttcatctctcacatttcccacctccagatctctccatctccccacccagttcaggaacaccacacgtttcactatctcttgttcttcagattctacaaattctccaaaacaagacaccaccccaattgaattaaggcattctgcatttccaaccgtattggacatcaatcagattcgtgaaattcttcctcataggtttccatttcttctagtggatagagtgattgaatacaatcctggagtt

SEQ ID NO: 302 - DNA, 394 bp, Cicer arietinum
actttgtctatcccaacaaagaagaaactctcacgagaacctccaacttcaggttgtaacataaccaatccacccacctgtgccatcgcctcaaccatgagaacaccaggcatgataggtctttctggaaaatgtccaggaaagaagttgtcatttattgttacattctttatagcaacagcagaaactccaggattgtattcaatcactctatccactagaagaaatggaaacctatgaggaagaatttcacgaatctgattgatgtccaatacggttggaaatgcagaataccttaattcaattggggtggtgtcttgttttggagaatttgtagaatctgaagaacaagagatagtgaaacgtgtggtgttcctgaactgggtggggagat

SEQ ID NO: 303 - DNA, 332 bp, Cicer arietinum
gatttttgtgggatgttcccaatagttggggacagatatagatgtgatgattgtaaagaagagattggctttgatctttgtggtgattgctataagaaccgctcaaagcgtccgggacgatttaatcagcagcacacccctgaccacaatttaaagcttatacaatgtcgacggacactaaataacagacagtggattggacaagtttcgtcggatttggtaattatagacgatgatcctgcttcctctactgatgaagatgaaaaccaaagtgactctgaaaccaccaactgaaaagttgaattcgcaaaatcccatgatatttttgtggt

SEQ ID NO: 304 - DNA, 452 bp, Cicer arietinum
acggaatgacccagacaaggcctgacttagcatttctgctctcgatactctcaagatacatgtcgaatccatcgccagcgcattcacaattgatcaaaagaggctaccgctatttacaacagacgaagcatcacggcctagtgcttgggggcgttaggaaagaccccaaagacgcttggagcgtcacggcctgggccgactctgattggaaaggcgacaatttcacaggaagatcgacgtttggatggctcgttcagcttgaagaatctacggtctcatggagagcgaaacgacatgaaacagtagcactctcaactaccgaggccgagtatactgctctatcacaatgcgccagagaattaacatggattcggaatctgttctcagaactacaactatcactagacattccgatccttttgaatggcgataatcagggttctctgaaactc

SEQ ID NO: 305 - DNA, 408 bp, Cicer arietinum
cggccgaggtcttgttcaccctcaatctcaaatctcaccctatattttttttctttcttcatttccaatctcccactcatctttctttgttttcttctcaacaacctataaaatttgaaagtgtaatgatgtagaagaataataagagaccaaaacagtgttgtcaaaaaaacatacatattaattggtcactttgttgttgtgttggaattgtttgatgggtgaagaaaagggaaaagaacaagtgttgagaaaaaagaaaggtagacacatgggagttaatggagataaatggttgtatagtagctgtttaaagaattgtgctaattggcgttgcttaagataccaaaactctccatttaagtgaaacaaaaacaaaacaaaacaaaacaaaacctttttctcttc

SEQ ID NO: 306 - DNA, 436 bp, Cicer arietinum
ccttctctcacctccaatggccgaccagctcaccgacgatcagatcgctgagttcaaggaagccttcagcctcttcgataaggacggcgatggttgtattactaccaaggaacttggaactgtaatgcggtctcttgggcaaaacccaactgaggcagagctgcaggacatgataaatgaagtcgatgctgatggaaatggtaccattgatttcccagaattcctcaacctgatggctcgcaagatgaaagacactgattcagaggaggaacttaaggaagccttccgtgtgtttgacaaggatcagaacggttttatttctgcagctgagctccgccatgttatgacgaatctcggtgagaagctgacagacgaagaagttgatgagatgattcgcgaggctgatgttgatggtgatggacagatcaattatgag

SEQ ID NO: 307 - DNA, 437 bp, Cicer arietinum
acgagcttggtcgccagccagctaacaccaagctatcaagcaacaaaactgttagacgcattcgtgttagaggtggcaatgtgaagtggagagccctcagattggatactggaaatttctcatggggaagtgaagctgtcactcgtaaaacccgtttgctcgatgtggtttacaatgcttccaacaatgagcttgtgcgaactcagacccttgtgaagagtgctatcgtgcaggttgatgctgctcctttcaagcagtggtatcttcaacactacggtgttgaaattggaaggaaaaagaaaactgcttccaaaaaagatacaccagaggaggccgaagctgttacagaagaagccaaaaagagtaaccatgtccaaagaaaattagagacccgccagaaagaacgccagcttgattcccacattgaagagcagttt

SEQ ID NO: 308 - DNA, 199 bp, Cicer arietinum
cccgtcccccatggcggacgagggaattctattagcgtggtcgcggccgaggtactagacaacctttagcgaaggcacttgcagcagcaccatcaatgtggactcttggaaatgcagggatgggggcattacagaggcttgcggaggatagtaacccggccattgcagctgcagcatccaaagctatttatgaactgaa

SEQ ID NO: 309 - DNA, 406 bp, Cicer arietinum
acaatcaagcggcacccttgcccttcttcctctggagtttcttcatgtaaaattcaagctcttttccttcaagaatgtaaccatcagccctgccgcattgaccaggtcgagatgaaatgcatgcaagcaaacgcccaccaccaaactgctcttcaatgtgggaatcaagctggcgttctttctggcgggtctctaattttctttggacatggttactctttttggcttcttctgtaacagcttcggcctcctctggtgtatcttttttggaagcagttttctttttccttccaatttcaacaccgtagtgttgaagataccactgcttgaaaggagcagcatcaacctgcacgatagcactcttcacaagggtctgagttcgcacaagctcattgttggaagcatt

SEQ ID NO: 310 - DNA, 410 bp, Cicer arietinum
acttcttctgctcatacttgtttacatttaaaatgctaataacaagcaataaaagccttataagccaaggcaagtagagttgtaatagttcatttgaagtttgactaaggaaaaaatgaacaaaacacaacagctggatcataggtattcattcctccacctacaatctcattttggcaatgtgatcatctgagtagtaaaacttcccttttatttatccacggggaaatcattcggattcaactggctcaacttttggtccatggagagaagggtgacgaccatccttgccccaaccaataccacgtgttgattcaagatactgtttaacaaggtgacgacatttctgaagatgattgataccttcaattcgataacaccaacgaagtttctccctaatgattttagct

SEQ ID NO: 311 - DNA, 408 bp, Cicer arietinum
acttcttctgctcatacttgtttacatttaaaatgctaataacaagcaataaaagccttataagccaaggcaagtagagttgtaatagttcatttgaagtttgactaaggaaaaaatgaacaaaacacaacagctggatcataggtattcattcctccacctacaatctcattttggcaatgtgatcatctgagtagtaaaacttcccttttatttatccacggggaaatcattcggattcaactggctcaacttttggtccatggagagaagggtgacgaccatccttgccccaaccaataccacgtgttgattcaagatactgtttaacaaggtgacgacatttctgaagatgattgataccttcaattcgataacaccaacgaagtttctccctaatgattttag

SEQ ID NO: 312 - DNA, 407 bp, Cicer arietinum
acttcttctgctcatacttgtttacatttaaaatgctaataacaagcaataaaagccttataagccaaggcaagtagagttgtaatagttcatttgaagtttgactaaggaaaaaatgaacaaaacacaacagctggatcataggtattcattcctccacctacaatctcattttggcaatgtgatcatctgagtagtaaaacttcccttttatttatccacggggaaatcattcggattcaactggctcaacttttggtccatggagagaagggtgacgaccatccttgccccaaccaataccacgtgttgattcaagatactgtttaacaaggtgacgacatttctgaagatgattgataccttcaattcgataacaccaacgaagtttctccctaatgatttta

SEQ ID NO: 313 - DNA, 226 bp, Cicer arietinum
accaagagacaccatagtattgatcaatgcatgggccattcacagggatcctaagtcatggagtgaggccacaaccttcaagccggagaggtttgacaaaaaaggggagattgaaaaggtgattgcatttgggatgggaagaagagtgtgtcctggagaagctttggctcttcgaacaattagcatgactttggcattattgattcaatgctttgattggaaacgt

SEQ ID NO: 314 - DNA, 136 bp, Cicer arietinum
acaatatgtcagatcccatgagcaaatagcagatggtcttacgaagccattacctgctgcgagtcatgataaattcctggaagcgctacgaggtagccaaagccctactgaagaaggtggacgtctcctatggaac

SEQ ID NO: 315 - DNA, 405 bp, Cicer arietinum
accagcaacaatataaagcataaaataaaataaaataaaatttaacaataggtcaagcaaatcaaattatatcagacacttgacactactaaaatgtctcaattgaaaaggagaatccaacagaacctaatacaagtaataactcaaaattaacaaaatgttgtgtttcaactacaactctaacaggaattgcaaattttccggcaaaaagatcagaccttttagtcgaacaaactgaagcccatgtcatcatcagattcttctttttcttcaaccttcttttcttccttggcttcagcagcaggtgcagcagctgctgcagcacctccaccaggtgcagcagaaacagcaacagcacctccaccagatggcactgaagacaacttttctcttccactagcaatt

SEQ ID NO: 316 - DNA, 291 bp, Cicer arietinum; identical to SEQ ID NO: 290

SEQ ID NO: 317 - DNA, 328 bp, Cicer arietinum
acattagctaaatgaccgaaagctaaggcatctttggtagatagaattgttggaagctccatctttgacttatggctccacaaaagtttcctcttgggcttcagaagacttgataaactcttcaagctgtgcttcaatagaaaaatcatcagcaacatcaagatcaaatgcatcaggcaacaaatcaacaacatcatcttcatgataaaagccttcatcatcatgttgctggctaagccagaagtcatgataccatgtcagtgttgtcaccagctgccaccattcaggagaaaaatcctccacttggtgaaaagcagctggaatgaaa

SEQ ID NO: 318 - DNA, 189 bp, Cicer arietinum
acgtatttcagcgagcctctattcgaaggtgtaggcgaacctggatcgacggagatctcgtcagcgggattgtcgcagagtcagggatatttgagtgcgttggcaacgagggctatcattctgattgaggctgatgagccggcgatcggactccttgcgtttgttggtattggtatggacgaggttagt

SEQ ID NO: 319 - DNA, 416 bp, Cicer arietinum
acgcgctcagctctcaacagagagtgccttagcaccaatcagcttaccgtcagcgtgcgaaacaacccaatactcggtcctcgtagcgtctctcgacacttgatatacacgaacatcgttaccctgcgaggcttctcgaacagcctcgatgacgtcggtgtatttgccgtgagggtcccagttgagaggatcaaggatcctgatgtctgccgagtcgggggaggagtggttgatgagtttggcgaattcggtctcgctggggagaccattcttgccctcccacttgagagaaacctcttggaagggctcgtctgcgtcggatgtgtatacggcgttcttgcacacgtcactgatgggtttggggacttgagcgccctggtcctttgtcttgaaggtagccttttcttgagtcgcgg

SEQ ID NO: 320 - DNA, 240 bp, Cicer arietinum
acgtgtacatgcctgccactttctcttctctctctcactaaatccatttcccattcattccccataagctagtgtcatcatgccgtttaattaatgcttaacgcttcgacttgattcctttattaatcaattcgatttcaacgagccatggaaatttcagagttagttgtaagttttgatttcactgtggcgaagtggccagagatgatgacattattgtgtaaggggacagctaacgtg

SEQ ID NO: 321 - DNA, 229 bp, Cicer arietinum
actaatgtaggtatcgacataggagtcatcggcgaatctgagaagcaagcaagacttcccaacggaggagtctccgattataagaaccttaaataggtaatcgtattcgttgctcattacgtcgccaaatctctcttctgctttgctttcaaatttcaattcaaacttcaaaccacctctcctctcttcccctcgccgctcaattcaataaatcattgccctttcacct

SEQ ID NO: 322 - DNA, 413 bp, Cicer arietinum
cacggcctagtgcttgggggcgttaggaaagaccccaaagacgcttggagcgtcacggcctgggccgactctgattggaaaggcgacaatttcacaggaagatcgacgtttggatggctcgttcagcttgaagaatctacggtctcatggagagcgaaacgacatgaaacagtagcactctcaactaccgaggccgagtatactgctctatcacaatgcgccagagaattaacatggattcggaatctgttctcagaactacaactatcactagacattccgatccttttgaatggcgataatcagggttctctgaaactctgcagaaatcccgagctacatcaacgaacaaagcatatccctttagtcgaacaccacatacgagaggaaattgaagctggcaacatcgatgt

SEQ ID NO: 323 - DNA, 436 bp, Cicer arietinum
acagagcttacctggagaccgtggaagggggcaattgtctcgtctacagagcagcgttctggccaccttgggtttttcccctgcgaggggtttccctaaggatgcatagttctagggttgcagctactggcgatcttaggggttatggttctcctgcctttgggcatggaaagctacttgatctatctgtgcaagagaattctaggctggagaggaatagttcccgctgacgggatgacctcttgaaagtaatgcgccttcgtgccgatgatatgctggatgaactagacgaaatcgcagttgcatggggatatgtcctgaatcacctgctttgacatccaagatgatgtgcttgaacctaccgtagggctggctacgagtaggaaggtgccctcgggggaaggagctcgagaggctctccgttgatgcgagtgga

SEQ ID NO: 324 - DNA, 357 bp, Cicer arietinum
acaggaatggttggctacaccggtgctggccttacgaagaccaagactggcgctgatgcctcggcaaccggcaagatcaagctgttctaagtgggaatattcagacaggcccatttgaaggtgcctcatgggggagatgtccctggcttttctccgctgacagaaaaattgtggaaacgggaagtttttgttttttgcttgtttttgttttcagttcagcagtttgagtggatgcacgtgcatacataggttgaagttttatagaagatggtgggagatgggagagatacagaaggaggaggttggcataagtcagacctgacattcactggctgaactggactgatcttttttggt

SEQ ID NO: 325 - DNA, 432 bp, Cicer arietinum
acagagcttacctggagaccgtggaagggggcaattgtctcgtctacagagcagcgttctggccaccttgggtttttcccctgcgaggggtttccctaaggatgcatagttctagggttgcagctactggcgatcttaggggttatggttctcctgcctttgggcatggaaagctacttgatctatctgtgcaagagaattctaggctggagaggaatagttcccgctgacgggatgacctcttgaaagtaatgcgccttcgtgccgatgatatgctggatgaactagacgaaatcgcagttgcatggggatatgtcctgaatcacctgctttgacatccaagatgatgtgcttgaacctaccgtagggctggctacgagtaggaaggtgccctcgggggaaggagctcgagaggctctccgttgatgcgag

SEQ ID NO: 326 - DNA, 320 bp, Cicer arietinum
agaaaaaagttaaacatcattttccaattttgcccctgagcttaacaccaagaaccctctccatcttagccaaaacaccttgattaggcacagctttaccattctcatattcctgaacaacttgaacacgttcgttaatctgttttgccaactcagcttgactcattttcttatccaaacgcgctttttgaatcgtgtgtcccacttccccaccaacccgctccaacgctgctggttcagccgcttcatctaatttcctcgcgtttaaaaccgaaccggcggttttcttgttcgaaccggcgtcgaattttttaaccatt

SEQ ID NO: 327 - DNA, 442 bp, Cicer arietinum
actatgcgaccatgtctctcaaatgctgtcaaagttcaggcagaagaattaaccaaagaggactttcagggctccaagtggttggtgttgagatatgcaatacttaatttggaagttattcaagcagccattcttttagccaaacaggaaggtctttttgtttccttggatttggctagttttgagatggttagaaatttcaaacagccacttctgaagctattggagtctggaaacatagacctttgctttgctaatgaggatgaggcaacagagcttctaagaggtgaacagaatgctgatccagtagctgctgtagaatgtctggccaaatactgtcaatgggctgtagtaacattgggttctaatggatgcatagctaaacataaaaatgagattgtatgcgttccagcgataggtgaagcaaaggcaattgatgcta

SEQ ID NO: 328 - DNA, 153 bp, Cicer arietinum
acatctccttccactcgtcactcttctgtggccggtgtgaatgggcgcgagggtgacaagcccctgccccctatcgttatcgatgaccctagcgacatcgtcgccatgaagcgtgctcgtaacactcttgcagcacgaaagtctcgtgagcga

SEQ ID NO: 329 - DNA, 419 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccaaaattcct

SEQ ID NO: 330 - DNA, 410 bp, Cicer arietinum
atcacattccatctctcttttatactgatctctagtacctaatataccttcaacaaacaagttcaagttattcagaccttatttatagtataacaaatatggtatacaagaattcatttattgttaccaagacaatatcattttttctcaagctactgattcccggtgcttgggccgcccggaaatttcttgttatcgtcccagcctcttacccatggctgcccaggtgttgctcttgtttcaggagcagaatggctgttaagattcttcataactccttctcgaactgcagcaaagacaggattaatgcttattgattctgggggttcctcctgcccagataaccatttccataaatctggattttcgaggtcgaggagataaatgagagatggaatgtgattatgatc

SEQ ID NO: 331 - DNA, 406 bp, Cicer arietinum
acaaaaacgagaaccacagtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacgtgagtagcgagaaccaccatcaccaccaccatatccacgacctctgctaccaccataaccaccaccacctcctccgccatatccaccttcacgacgtccaccaccatatccaccgcctccaccatatccaccgccaccacggccgcctccaccaccgctaccacgagactgagcttcgttcacggtaatgttacgtccgtcaacatcttgaccgttcatcccttcaattgcg

SEQ ID NO: 332 - DNA, 442 bp, Cicer arietinum
accatgcgaccatgtctctcaaatgctgtcaaagttcaggcagaagaattaaccaaagaggactttcagggctccaagtggttggtgttgagatatgcaatacttaatttggaagttattcaagcagccattcttttagccaaacaggaaggtctttttgtttccttggatttggctagttttgaggtggttagaaatttcaaacagccacttctgaagctattggagtctggaaacatagacctttgctttgctaatgaggatgaggcaacagagcttctaagtggtgaacagaatgctgatccagtagctgctgtagaatgtctggccaaatactgtcaatgggctgtagtaacattgggttctaatggatgcatagctaaacataaaaatgagattgtatgcgttccagcgataggtgaagcaaaggcaattgatgcta

SEQ ID NO: 333 - DNA, 437 bp, Cicer arietinum
gtcatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattatggactgcgtcagcagatgtagcgatgcgtgagagaattctggtcggtggaaaaattcgacaaattgcctccgaacccgctgacgggtgacgggcttgacaaaaacagtgccttttgtgccttggtatgctggatggtgaaggaag

SEQ ID NO: 334 - DNA, 216 bp, Cicer arietinum
acagtaacctcaataggaactccaaatacatcagtctttgcaactcccttctgccatctttcaatgtctgtcaagatagtcttacttttttgtgctgttatttttgccacctcttcaaccttggacttccccacagccaccttatcttttgtccctgacaaacctctcctcaggaatgcaccagttgtagcagcagctgatatcattctatcctgt

SEQ ID NO: 335 - DNA, 372 bp, Cicer arietinum
  misc_feature (372)..(372): n is a, c, g, or t
gtgagattgcccaggacttcaagtctgatctccgcttccagtcttctgccatcggtgctctccaggagtccgttgagtcctacctcgtctccctcttcgaggacaccaacctctgcgccatccacgccaagcgtgtcaccatccaatccaaggacatccagctcgcccgccgcctccgcggtgagcgtaactaagcgatctcacacatgggtatttgggaggatcacgactttttgctttgacacgagggatatcatggttaggggataatcaaggcgttcacgaggaacatgctttctacagttgggatgtatattaaatggcaggctagttagctgccctacgcaatcgaccaccggtctttgatcaacn

SEQ ID NO: 336 - DNA, 368 bp, Cicer arietinum
acatgatcggtcaacatcccggttccgatgacaattctcgtccaccttttctccgtcgaacccgccgcaacggaggtgaccggtcacctttcaatccggtgatcgtcctacgcggaagtggatcaacggaggtaacagaaggtggtagcacaggagagagtcgtgggtttgagcttttctatgatgatggtgctggttctggtcttagacctttaccaccaagtatgtcagagtttcttttgggatctggatttgatagactgttagaacaactttctcagattgaaatcaacggtattggaagatatgaacatccaccagcttcaaaaacagccgttgattcattaccaactattgaaatcaatggg

SEQ ID NO: 337 - DNA, 189 bp, Cicer arietinum
actaacctcgtccataccaataccaacaaacgcaaggagtccgatcgccggctcatcagcctcaatcagaatgatagccctcgttgccaacgcactcaaatatccctgactctgcgacaatcccgctgacgagatctccgtcgatccaggttcgcctacaccttcgaatagaggctcgctgaaatacgt

SEQ ID NO: 338 - DNA, 99 bp, Cicer arietinum
caaaattggaaaagagattttggagtggtccgtttgtttatgcgaattcgaaggcaccgaaacgctgcgtttgattccaaaatctgttttccaattttg

SEQ ID NO: 339 - DNA, 436 bp, Cicer arietinum
gcagtccgaaatccagcaaatatgaagatcatcgcggcgtatttgctggccgttttgggcggtaaagcagcccctacctctgatgatatcaaacacatcctcacttcagttggaattgaggccgaggatgagaagattgagttgctcttgggtgaagtcaagggaaaagattttgccgagctaattgctagtggaagagaaaagttgtcttcagtgccatctggtggaggtgctgttgctgtttctgctgcacctggtggaggtgctgcagcagctgctgcacctgctgctgaagccaaggaagaaaagaaggttgaagaaaaagaagaatctgatgatgacatgggcttcagtttgttcgactaaaaggtctgatctttttgccggaaaatttgcaattcctgttagagttgtagttgaaacacaacattttgtt

SEQ ID NO: 340 - DNA, 341 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtccaggtcgacacgagtggggaagttgaagctgcgagagaactcgccgaaggtgcgctcggtgagccagt

SEQ ID NO: 341 - DNA, 443 bp, Cicer arietinum
gccgaggtcggccgaggtacagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctgccc

SEQ ID NO: 342 - DNA, 240 bp, Cicer arietinum
cacgttagctgtccccttacacaataatgtcatcatctctggccacttcgccacagtgaaatcaaaacttacaactaactctgaaatttccatggctcgttgaaatcgaattgattaataaaggaatcaagtcgaagcgttaagcattaattaaacggcatgatgacactagcttatggggaatgaatgggaaatggatttagtgagagagagaagagaaagtggcaggcatgtacacgt

SEQ ID NO: 343 - DNA, 401 bp, Cicer arietinum
acaaaaattggcatgcagatatagagacaaacaaattaagcaacatttaagtttcaataattcaaataactggtctacaaccggaagctagaaagcaatcctagcctaagctttgattgcatactttcttaatggaaagtatatctccttcttcttctctcgttctgtcttcaatgatgcctggtgtttggtaaggtgtcttcgaatggcacgggtcttcttaggacgtaggtcaagtggcaaatacttcttattcttataaacctctctgagtgcagctttctgcttctgtgaaatcactgtcaacacttgtgctattgaaagcctcacaacttttattttggagagcttgttaggcgcaccgccggtgactttcgccactcgtagcaaagcgagttccg

SEQ ID NO: 344 - DNA, 402 bp, Cicer arietinum
actatgcgaccatgtctctcaaatgctgtcaaagttcaggcagaagaattaaccaaagaggactttcagggctccaagtggttggtgttgagatatgcaatacttaatttggaagttattcaagcagccattcttttagccaaacaggaaggtctttttgtttccttggatttggctagttttgagatggttagaaatttcaaacagccacttctgaagctattggagtctggaaacatagacctttgctttgctaatgaggatgaggcaacagagcttctaagaggtgaacagaatgctgatccagtagctgctgtagaatgtctggccaaatactgtcaatgggctgtagtaacattgggttctaatggatgcatagctaaaacataaaaatgagattgt

SEQ ID NO: 345 - DNA, 252 bp, Cicer arietinum
acatcataacatgtatttttttacttatatttcattgcatagcaataacacaattataattcaaattacttgacctatatttgatgttctaatactccgcttgaaaaacaggatattggatactccaagcttgcacatttggctccacagtatggactatgtaagacttttatcaccaaccccaagatgtttttcttttttagctttttggatgttgaactgaaatcttgttacattttgatctaccctttt

SEQ ID NO: 346 - DNA, 419 bp, Cicer arietinum
acacgtgtcattgtcgtttactgtttcggaagaagttgttgttgtttcttttgtgtcatggaaatgaccttcaccccatgttaagaagatgttatctctttcgtcttttgttgtttgccaaaatatggcgtagacccaatggtttggttgggcttggagtaaaaattgaagtttttgttcaagggttggtatttgtggtggtggtggtgacggtgaagggtttttttcatggggaaatgatatcatagaagaggatgaagaaggtgagatgatgaaaccttccataggaaaaaatatacgaagagaaacaagagttggtttttttgttgttgttgatgaaattgtaaaagttgggggagaagggaacaaggggttgagattgattaatcgagtaataaaagtggaagtctttatgttgt

SEQ ID NO: 347 - DNA, 407 bp, Cicer arietinum
accacgaccagttcccaagttgtaagcagtgcaacctatgttttccgttgtgaaaagctttctcagggcagcaatgtgaccatctgctaagtccataacatggatatagtcccgtatcgcggagccatccctggtaggataatcatgaccgtatacattgagctcaggtaatcttccaacagctacttgctgtatataaggcatgagattgtttgggattcccctgggatcttcaccaagtttaccactttcatgggccccaactggattgaagtatcttagtaaaatgatcctccattctggctcagctatctgaatatctctcgcaatttcttcgaggaaaagcttggtccgtccatatggattcatggcttgtagcttgaaatcctccacacaaggtatctttt

SEQ ID NO: 348 - DNA, 432 bp, Cicer arietinum
actactatcacgaagagattacgccttctagacgatacacaggtcatcatcaccatcaccaccatcaccaccatcactcacgctctccccgagcaagctacaccagtgtctctagacggtcctacagccacagcccacgaaacagtggcactgttgtctatgagcgctattgatcatctgaaggcaccaatgctgaattgtgggtgtaattagagacgatgacgttgtacctcggccgcgaccacgcccgaaattttaatggttaaaaaattcgacgccggttcgaacaagaaaaccgccggttcggttttaaacgcgaggaaattagatgaagcggctgaaccagcagcgttggagcgggttggtggggaagtgggacacacgattcaaaaagcgcgtttggataagaaaatgagtcaagctgagttggca

SEQ ID NO: 349 - DNA, 197 bp, Cicer arietinum
caaaatcacagtgaaattcgatggaagaagagggagaggtttatgtgaacgatgaagcagaggttgttaaagctgaagacaaacttgctttgcaattcatggattcatttcataactatctaaccctctctcattctttgtcttccacacttcgtcagggatggatggatttagcaagtgccagacattctatgggt

SEQ ID NO: 350 - DNA, 357 bp, Cicer arietinum
aaaatggcaatcacactgaacagtggctttaagatgcctatcatcggtcttggagtgtggcgcattcaaggacaagaaatcaaagacctcattctcaattccatcagaatcggttatcgccattttgattgtgctgctgattacaagaacgaatcagaagttggagatgcgcttaaagaggcttttgacagtggccttgtgaagagggaggaccttttcattaccaccaagttttggaattctgatcacggacatgttgttgaggcatgcaaagatagtcttaagaagcttcagttagattatctggatttatatcttgttcactttcctgtagccacaaggcatactggggttggt

SEQ ID NO: 351 - DNA, 428 bp, Cicer arietinum
actattggtgttatgcagtgctttggagagttccatggcagaaagactccatgatctagcaaggaactccattgattctgtgggcgtatcaggcggggggcaagatgatgcaggcccatctgcaggaacattctcatcaatgttctctattcgatgaaccgagcatttagagacagaggtgttggagctcattgtaaagatgaatgaatattccaagtccctaaagcttcaataaccaaagacttagttacatatgatgagagaactgaggaccaacagttagatatttaaaagaaaatgtgacgttgtttcaaagtgcttgttatttaaaatgatgaagaaaaaaattaacttcaagtattcatagtgatgaacaaaaggaccctaattgaaaacgccattatatttgtctccacttaagttgtata

SEQ ID NO: 352 - DNA, 240 bp, Cicer arietinum; identical to SEQ ID NO: 342

SEQ ID NO: 353 - DNA, 356 bp, Cicer arietinum
cgattgtaaccattttccaaatcacacacccatttcccctttcttaccaaagttgattcctttttcaggaaatcttaccagttattgttcgaaatggcttcctcgactctcatcagtgacacccagccatggaaggagttgaaggcgcacgttgaggacattaaagcgaatcatttacgtgatttattgagtgacgacgagagatccaaatcaatgatggttgaatttgatggaattctattggactactcaaggcagcaggccacacttgaaacaagggaaaaactcttccaattggctgaggtcagtttcttcattctaggttgcatccctcaagcaaaaaataactcaaatgt

SEQ ID NO: 354 - DNA, 436 bp, Cicer arietinum
acttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgcctcgatagagttgaggttattgctgaaaacaaagataaatgggatatgcatcgttgctgttagctactagtatggtgattatcacagcttctttgagttgtcttgtaactttgttgttgtttatagtggataag

SEQ ID NO: 355 - DNA, 426 bp, Cicer arietinum
acttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgcctcgatagagttgaggttattgctgaaaacaaagataaatgggatatgcatcgttgctgttagctactagtatggtgattatcacagcttctttgagttgtcttgtaactttgttgttgtttat

SEQ ID NO: 356 - DNA, 360 bp, Cicer arietinum
acttgttagcgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgcctcgatagagttgaggttattgctgaaaacaaagataaatgggatatgcatcgttgct

SEQ ID NO: 357 - DNA, 274 bp, Cicer arietinum
tttctcccatgtctcgcgctctctctaaactctcccccaaatctttattctccaaatcgttctaactcactataactaagattactgctagcctatcgcctagagccaagcttcgaccgcgactgcttgtcacttttgggcgccttcttccaccactcgagaaagtcagcaccgtcaaagatctcttgattcctcgcggccgggtcggcttggaagcaagctacatgtcgcctatctcaacccgtttcttattattagtaagataggttgcccc

SEQ ID NO: 358 - DNA, 390 bp, Cicer arietinum
actagaaaaaatgatgtatagaaaaataatatgataccaggatagcagttactgtcagtgtgaagcacacacactacactaggcactgccacataacatgcaatcaaagcagatgtggtgcttttaactgtatccacttttcacttttcagatatcttaaattccttggaaaactaaaattccagtcttaattaagaaggcacaaaggtgaaaataacaagagaaaataatgacaaaaagcaaagaatccttaagatttcgctccattacatttacaagaaaaagaaacaacacaaaggacgttattcacgagaatggaacaaattaatttgaatcaggaatcttcagatattccagagaataattgaaatgaaaaaacataaatgaaaa

SEQ ID NO: 359 - DNA, 403 bp, Cicer arietinum
acacaagtgagctgctagctcttcttatccactataaacaacaacaaagttacaagacaactcaaagaagctgtgataatcaccatactagtagctaacagcaacgatgcatatcccatttatctttgttttcagcaataacctcaactctatcgaggcagagtgtaaggtccacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttgtgacacacttgcattttcatcttgtgctgcacttgcacaaggagctgcttaaaagcttcattatctgg

SEQ ID NO: 360 - DNA, 393 bp, Cicer arietinum
acttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgcctcgatagagttgaggttattgctgaaaacaaagataaatgggatatgcatcgttgctgttagctactagtatggtgattatcacagcttc

SEQ ID NO: 361 - DNA, 435 bp, Cicer arietinum; identical to SEQ ID NO: 83

SEQ ID NO: 362 - DNA, 460 bp, Cicer arietinum
acccgataattggacttctttttccggttttacattatcggatcaacctgattatgctaaaaagtcacacgagttagggttttctggtcaaagtgctgctaatcagttttcagagttcgacaatggtaagagtaaacaggtgggaattggagggagtaggtggtcctcaaatcaaacaaattttgctggttctgttgctgaagaaaggattaacttagggtgtcaagatataactggcagtcatggtaaagttccacatatgattggttgggagaaacatagcttgcctacaagtgcggatcacttagatgataaatcttgctggtggagaactaccaaacccatgccagttgatttttctcatacatcaggtttacaatccccttcgttgtctgtagaaactcatcatgaggctcctttgaagttagctgtggattcagggaaccatcactttcagtat

SEQ ID NO: 363 - DNA, 191 bp, Cicer arietinum
acaggacgtgctgagctaaactatctacaatcgctgccctgctgattctcgctcggatcatctgcaaggcctcttgcatcggagccgtatacatgctcgagcgttttctgtattcattacctccaagaggcacctctctactcgtagccagctctacagtagttgtcggtgaagcacgtcccatggacatc

SEQ ID NO: 364 - DNA, 403 bp, Cicer arietinum
tttgcctagcgtggtcgcgagaagaggtactgcaaaaataacccatgagtatgcacggattaccaaaatagctaacggaagacaccacaacagagtttaaaaggatggcaacaaaaataacataaataacgatttccaacatttcaaagcagcagccataactaagctttgaggcgtccatagaacttctgtttctcttgtgttgtctggaagcgaccatgcccaaactttgaagaggtatcgataaacttaagtttgatatcctccccggcattgcgagaagtctgcttgagtagagactgacgcaaagtaataacccttttcttgggaccaacaacacctcccttgatcatcagataatcctccttcacaacaccatagtgggggaatccacccattgggg

SEQ ID NO: 365 - DNA, 408 bp, Cicer arietinum
actgcaaaaataacccatgagtatgcacggattaccaaaatagctaacggaagacaccacaacagagtttaaaaggatggcaacaaaaataacataaataacgatttccaacatttcaaagcagcagccataactaagctttgaggcgtccatagaacttctgtttctcttgtgttgtctggaagcgaccatgcccaaactttgaagaggtatcgataaacttaagtttgatatcctccaaggcattgcgagaagtctgcttgagtagagactgacgcaaagtaataacccttttcttgggaccaacaacacctcccttgatcatcagataatcctccttcacaacaccatagtgggggaatccacccattggggtgatgtctttctcagtcctatcataatcagttt

SEQ ID NO: 366 - DNA, 188 bp, Cicer arietinum
cgagctacatcttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgt

SEQ ID NO: 367 - DNA, 291 bp, Cicer arietinum
tttctcccatgtctcgcgctctctctaaactctcccccaaatctttattctccaaatcgttctaactcactataactaagattactgctagcctatcgcctagagccaagcttcgaccgcgactgcttgtcacttttgggcgccttcttccatcactcgagaaagtcagcaccgtcaaagatctcttgattcctcgcggccgggtcggcttggaagcaagctacatgtcgcctatctcaacccgtttcttattattagtaagataggttgccccttgctctttgctccagt

SEQ ID NO: 368 - DNA, 431 bp, Cicer arietinum
acttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgcctcgatagagttgaggttattgctgaaaacaaagataaatgggatatgcatcgttgctgttagctactagtatggtgattatcacagcttctttgagttgtcttgtaactttgttgttgtttatagtgg

SEQ ID NO: 369 - DNA, 436 bp, Cicer arietinum; identical to SEQ ID NO: 354

SEQ ID NO: 370 - DNA, 310 bp, Cicer arietinum
acgagcttggtcgccagccagctaacaccaagctatcaagcaacaaaactgttagacgcattcgtgttagaggtggcaatgtgaagtggagagccctcagattggatactggaaatttctcatggggaagtgaagctgtcactcgtaaaacccgtttgctcgatgtggtttacaatgcttccaacaatgagcttgtgcgaactcagacccttgtgaagagtgctatcgtgcaggttgatgctgctcctttcaagcagtggtatcttcaacactacggtgttgaaattgggaggaaaaaagaaaactgctt

SEQ ID NO: 371 - DNA, 402 bp, Cicer arietinum
actatgtgaccatgtctctcaaatgctgtcaaagttcaggcagaagaattaaccaaagaggactttcagggctccaagtggttggtgttgagatatgcaatacttaatttggaagttattcaagcagccattcttttagccaaacaggaaggtctttttgtttccttggatttggctagttttgagatggttagaaatttcaaacagccacttctgaagctattggagtctggaaacatagacctttgctttgctaatgaggatgaggcaacagagcttctaagaggtgaacagaatgctgatccagtagctgctgtagaatgtctggccaaatactgtcaatgggctgtagtaacattgggctctaatggatgcatagctaaacataaaaatgagattgta

SEQ ID NO: 372 - DNA, 417 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaggagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 373 - DNA, 398 bp, Cicer arietinum
ggaagtggcgtctcaacactgcaggaagttgtcgttgaaactggcgaagaaaatgaggaagtagttttcaatgcagattcagtgttgtttgaatttgcagacggtggttggaaggaacgtggaaagggagaggtgaaagtcaatgtaactagtggaacagaaaagaaagcaagagttcttatgaggtctagaggaaattacagactgattttaaacgcccggctttaccctgaaatgaaactcacaaatatggagaagaaaggggttacctttgcttgtgcaactgaagggaaagactgtctttcgacatttgcattgaagttcaaagatgggtccatagtggatgattttaagactgctatcacagcacataagggtgaggcggcgtatccagttat

SEQ ID NO: 374 - DNA, 294 bp, Cicer arietinum
tgcttgcagctactcgcttatgatccttcatgatgaacaaatccctgtcactggtgacaaaatttccactttgttgaaagctgcaaaggttgatgttgaatcttattggccaagcttgtttgctaaacttgccgagaagaaaaaccttgaggatttgatattgaatgccacacgaggtggggctccggtttctgtttcagccccagttgctgctgctgccgcaactgcagttgctgcacctgcagaagagaagaaggaagaacccaaggaacagagtgacgacgacatgggatt

SEQ ID NO: 375 - DNA, 407 bp, Cicer arietinum
actggcaacgtggccgactgctttcgccgtttgctttgtcgttcttgagagtcaggacggaccagtgatcgactaaatgctaatcggcgctcaatatagtccaaggcgctattgctctcagatgctgaaacggcattgcaggccaccccatgagccatgtccttgtacttctcttcccagactctcgttaagtttccttcataggtcttcctccattctgacgtctgacgagacggcagctggttccaaagctgctctagagttcgccatttcttacacgggtggaatacaactgccgctacgtaggcggtagaggtcagcttgccataatagtcattcagcttcttccatccgaacttgatgtaaatcttcaaaagcttccgggtcttcgcatccatgtcatcgaa

SEQ ID NO: 376 - DNA, 344 bp, Cicer arietinum
acaaaaatcagactagatcacactaaaagttctcctaatcaaacaagctgaatcccatgtcgtcgtcactctcttccttgggttcttccttcttctcttctgcaggtgcagcaactgcagttgcggcagcagcagcaactggggctgaaacagaaaccggagccccacctcctgtggcattcaatatcaaatcctcaaggtttttcttctcggcaagtttagcaaacaagcttggccaataagattcaacatcaacctttgcagctttcaacaaagtggaaattttgtcaccagtgacagggatttgttcatcatgaaggatcataagcgagtagctgcaagca

SEQ ID NO: 377 - DNA, 406 bp, Cicer arietinum
acttcttctgctcatacttgtttgcatttaaaatgctaataacaagcaataaaagccttataagccaaggcaagtagagttgtaatagttcatttgaagtttgactaaggaaaaaatgaacaaaacacaacaagtggatcataggtattcattcctccacctacaatctcattttggcaatgtgatcatctgagtagtaaaacttcccttttatttatccacggggaaatcattcggattcaactggctcaacttttggtccatggagagaagggtgacgaccatccttgccccaaccaataccacgtgttgattcaagatactgtttaacaaggtgacgacatttctgaagatgattgataccttcaattcgataacaccaacgaagtttctccctaatgatttt

SEQ ID NO: 378 - DNA, 189 bp, Cicer arietinum
cgatccacgaaaacttagtagaataatggatccaaggcttgaaggacagtattcagagatgggggcaagaaaagcagctgcattagcctatcaatgcttaagtcacaggccaaggaatagacctacaatgtctaatgtggttaacactcttgagcctctacaagattttgatgatattccaattggacc

SEQ ID NO: 379 - DNA, 168 bp, Cicer arietinum
gattccgatcgttatcgttagtgctgctctcactcctaaacgcccaaggcctgcggatattgtgtatgccaccatgctcgctattaaatcaccaccaccaaactctcacacccccactatgatgccgtctcgataaatgatccctttctcttaatctctttttcaggg

SEQ ID NO: 380 - DNA, 407 bp, Cicer arietinum
cggccgaggtcttgttcaccctcaatctcaaatctcaccctatattttttttctttcttcatttccaatctcccactcatctttctttgttttcttctcaacaacctataaaatttgaaagtgtaatgatgtagaagaataataagagaccaaaacagtgttgtcaaaaaaacatacatattaattggtcactttgttgttgtgttggaattgtttgatgggtgaagaaaagggaaaagaacaagtgttgagaaaaaagaaaggtagacacatgggagttaatggagataaatggttgtatagtagctgtttaaagaattgtgctaattggcgttgcttaagataccaaaactctccatttaagtgaaacaaaaacaaaacaaaacaaaacaaaacctttttctctt

SEQ ID NO: 381 - DNA, 417 bp, Cicer arietinum; identical to SEQ ID NO: 372

SEQ ID NO: 382 - DNA, 406 bp, Cicer arietinum
actcattacctccaagaggcacctctctactcgtagccagctctacagtagttgtcggtgaagcacgtcccatggacatcaatacagttgatcctcgcagagcttccctccagcagcgtctcccatctagttcatccagcatatcatcggcacaaaggcgcattactttcaagagggcatcccgtcagcgggaactcgtccctctccagcctagaattctcttgcacagatagatcaagtagctttccataccctaaggcaagaaatccatgacccctaagattgccagtagctgcaacctagaaccgtgcatccttggggaaaaccctcgcaggagaaaaacccaaagcggctagaacgctgctctgtggacgaggtggtcgcctctttccacggcctctaggta

SEQ ID NO: 383 - DNA, 238 bp, Cicer arietinum
ctttcttggcacccactgttagtgcggtgctaggagcgggattttctacgggctatgcgactacacaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccga

SEQ ID NO: 384 - DNA, 400 bp, Cicer arietinum
cggccgaggtcttgttcaccctcaatctcaaatctcaccctatattttttttctttcttcatttccaatctcccactcatctttctttgttttcttctcaacaacctataaaatttgaaagtgtaatgatgtagaagaataataagagaccaaaacagtgttgtcaaaaaaacatacatattaattggtcactttgttgttgtgttggaattgtttgatgggtgaagaaaagggaaaagaacaagtgttgagaaaaaagaaaggtagacacatgggagttaatggagataaatggttgtatagtagctgtttaaagaattgtgctaattggcgttgcttaagataccaaaactctccatttaagtgaaacaaaaacaaaacaaaacaaaacaaaaccttt

SEQ ID NO: 385 - DNA, 281 bp, Cicer arietinum
acttgactggagagttcccaggtggctatggttgggacactgctgggctttctgctgacccagagacatttgcgaaaaaccgtgaactggaggtaatccacagcaggtgggctatgttgggagcattgggatgtgtgttcccagagcttttgtcccgaaatggtgttaaattcggtgaagctgtgtggttcaaggctggatcacaaatctttagtgagggtggacttgactacctgggtaacccaagtttggtccatgctcaaagtatccttgctatatgg

SEQ ID NO: 386 - DNA, 436 bp, Cicer arietinum
ttcttggcacgcactgttagtgcactgttaggagcgggattttctacgggctactcggccacacaatactgcggggacgccatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgacaatag

SEQ ID NO: 387 - DNA, 408 bp, Cicer arietinum; identical to SEQ ID NO: 305

SEQ ID NO: 388 - DNA, 459 bp, Cicer arietinum
gattcacattgacgaggataatcaacgggctattttgcccgcggccgaggtaccgcctgtccgtccttcccgacggcattccttctctgtccattgaagtcatgagcaccatgggctgggagcgttacactcacgagcagttcggtatcaaccgattcggtgcttctggtgcctacaaggacgtctacaagaagttcgagttcacccctgagggcattgccaagcgcgccgtcgccaccatcgacttctggaaggacgtccccaacatccgatcccccatcaaccgtgctttccagcagatcatctagatcaaagataatagcgagtaaaaagaaacgaaggataagaataaaaactccgggaggataccagcccggacagaatgattatgcaagtgacgacgatggactttggagcaaggttttgtggatttatagcaacttagacacgtacctgccc

SEQ ID NO: 389 - DNA, 416 bp, Cicer arietinum
cccgattcaagtggtgctgcttatagtttggccttacaaacgagcttaccggatgttgctctatggtgtgatgtgcaattgacaaaagatgcagctgggatttgccttccaaatgtcaaccttttaaattctacttacgtttcaattgctatcccaaataaaactacgagttactcggttaatggtgtatccacccgtggctatttttccgtggattacaccttggaggacttatccaatgtcttcttatctcagggagtattttctcggtcagctctgcttgatgccaatggttatttaattcttactgttgatgatgtagtcaaatcagtggcgccacaaaaaccaaatctgtggttgaatattcagcatgatgcgttctatacacagcacaagttgagcatgagaagctatgt

SEQ ID NO: 390 - DNA, 275 bp, Cicer arietinum
acatcataacatgtatttttttacttatatttcattgcatagcaataacacaattataattcaaattacttgacctatatttgatgttctaatactccgcttgaaaaacaggatattggatactccaagcttgcacatttggctccacagtatggactatgtaaaacttttatcaccaaccccaagatgtttttcttttttagctttttggatgttgaactgaaatcttgttacattttgatctacccttttacagactccagctttgttccacc

SEQ ID NO: 391 - DNA, 406 bp, Cicer arietinum
acgaatcctttaggtcaataacagcaatgccctctggaaatttgcgtatcaggaaaagcagctcttttttgtccctaagggcatgtttcgacttgtaagagaatctttctccatcaaatcttacttttggatttttcctcatactgtcaaaaacatctttgttagctttcatgtccacatagcgtgcttcatttatttgatccaacgttaaagcctgccgagtctcataaaggatagcaataacacgcttcatttgagctccaacaggtgctttgcgtatactgttaatgacttgaagtctctccgtatcagatgagaatttgacaggaacaggggggtttgacgcagatacagatgaagccttgctcgctgctatgctcgatagtgttgtttgacatttctcttg

SEQ ID NO: 392 - DNA, 460 bp, Cicer arietinum
acctttgatacaccagaagaagctgctttggcttatgataaagcagcttttaagctccgtggtgactttgctaggcttaactttcctaacctgaaacacacaggttcatgtgttgttggtggtgaatttggtgagtataagcctcttccttcttctgttgatgctaaacttcaagctatttgtgaagatttagctcagatccagaaacaagggaagtcagagaagccaaccaagaagaaaacaccctccaaacttgcttccaagcctgtttccacggtcactattccgttggaggattctgttgatttgaagaatgtctcggataactgttgtaaagttgaagtttcgttttcgagtgaaggttcttcaccactttcggatcttacttttggtgatgttgctgagccaccatgggacagtgattctgataatttcaatttacttaagtacctcggccgcg

SEQ ID NO: 393 - DNA, 439 bp, Cicer arietinum
acaaggataagagaaaagatgcagtgaaaaaagtgattgctgctatgactgttggaaaggatgtttcgtcgttgttcacagatgtggtgaattgcatgcagacagaaaatttggagctcaaaaagttagtctatttgtatctgattaattatgcaaagagccagcctgaccttgctatacttgcagtaaatacatttgtgaaggattctcaagatccaaatcctttaattcgtgccttagctgtgcggacaatgggatgcattcgtgttgataaaattactgagtatctatgtgatcccctccaaagatgcttaaaggacgatgatccatatgttcgcaagacagcagccatttgtgttgcaaagctctatgacataaatgcagagttggttgaggacaggggttttttggaatcactgaaggatttgatatctgataa

SEQ ID NO: 394 - DNA, 408 bp, Cicer arietinum
actcattgcccccaagaggcacctctctactcgtagctcgccctacagtagttgtcggtgaagcacgtcccattggacatcaatacagctggtcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctccaggt

SEQ ID NO: 395 - DNA, 435 bp, Cicer arietinum
actatgcgaccatgtctctcaaatgctgtcaaagttcaggcagaagaattaaccaaagaggactttcagggctccaagtggttggtgttgagatatgcaatacttaatttggaagttattcaagcagccattcttttagccaaacaggaaggtctttttgtttccttggatttggctagttttgagatggttagaaatttcaaacagccacttctgaagctattggagtctggaaacatagacctttgctttgctaatgaggatgaggcaacagagcttctaagaggtgaacagaatgctgatccagtagctgctgtagaatgtctggccaaatactgtcaatgggctgtagtaacattgggttctaatggatgcatagctaaacataaaaatgagattgtatgcgttccagcgataggtgaagcaaaggcaatt

SEQ ID NO: 396 - DNA, 437 bp, Cicer arietinum
acgaggttaatggtttttctcaaatctcagggatgcagattctttacaagacttgcggaacaacaaatgctgctggaagagggtttgaagagagaagggacactgctttttctgttatggaaaatggggttgttagtggtcatggtttttatgctactagttatcaatctttgtatgttatgggtcagtgtgaaggtgatgttggtgattctgattgtggggagtgtgtgaaatctgctgttcaaagagctcaagttgaatgtggaagttctatttcaggacaagtttatttgcataagtgtttcattagttttaactattatcctaatggagttccagggaaacactcttcatctggagcatcatcttcttttgattatgcctcatctttttctggtcaaaatacagggaaaactgtggccataatattaggaggt

SEQ ID NO: 397 - DNA, 200 bp, Cicer arietinum
gccgaggtactatgcgaccatgtctctcaaatgctgtcaaagttcaggcagaagaattaaccaaagaggactttcagggctccaagtggttggtgttgagatatgcaatacttaatttggaagttattcaagcagccattcttttagccaaacaggaaggtctttttgtttccttggatttggctagttttgagatggtt

SEQ ID NO: 398 - DNA, 230 bp, Cicer arietinum
actgtgattttccctcaacaacaacccacaagagcttaaggggccccagggctggtatgatcttctaccggaagggacctaagccacccaagaagggtcagcccgagaatgcagtttatgattttgaagacaaaatcaactttgctgttttcccctcccttcagggtggtcctcacaaccaccagattggtgcccttgctgttgcttttattcaggccacgacgcccgga

SEQ ID NO: 399 - DNA, 409 bp, Cicer arietinum
gctgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgtcgcggcggcagggaaaaacctcgggaagggatcagaggccggcggtgcggcttgccttcaaaggagaaaaacccatcgcaatcggcgtcgttgatcgggaggatgtcgctaccgatgccataggcatcgtcctccgatatctaaggcgttctggttctgaggtgccgccattagatccgacaaagttgttgtcagagaaggcgaactctccaaaattccttctccgaaagctgctgttagggagccgatagcatccccgca

SEQ ID NO: 400 - DNA, 433 bp, Cicer arietinum
tgctgccctcgctgctaaggatgctggcaaggaaggccgaacaattctctttgttggtgatggatctttccaattgaccgctcaggagctgagcgccatgatccgacatcacctcaagcccacaattttcgtcatctgcaacgatggcttcaccattgagcgatttatccacggtatggatgctgtctacaacgacatcaacaactggaagtacaaggacctcgtcagcgtcttcggcggcgagaagacctgcaagaccttccagatcaagaccaagactgagctcaacgagctcctcaccaacaaggagttcaacgctgctgagtgcttgcaattcgtcgagctctacatgcccagagaggatgctcctcgcgctctgatcatgactgccgaggccagtgctaggaacaacgccaagaagcactaaacggtt

SEQ ID NO: 401 - DNA, 238 bp, Cicer arietinum
acctgatcggcaccttcacatgttggtttgatttaattttcgggttaaacgaaaaaccttcctccaacttcacaccgaaatcccattccaaccctaaaccaatgaaagtcaacatcttgcgtatcctttctcattattttcgcattttacctgtttgtgattttgcttcacaaattttcatgctttttctttactcttactctattgtttttgtagttgtcaagaattgggtatttgt

SEQ ID NO: 402 - DNA, 446 bp, Cicer arietinum
gccgaggtactatgcgaccatgtctctcaaatgctgtcaaagttcaggcagaagaattaaccaaagaggactttcagggctccaagtggttggagttgagatatgcaatacttaatttggaagttattcaagcagccattcttttagccaaacaggaaggtctttttgtttccttggatttggctagttttgagatggttagaaatttcaaacagccacttctgaagctattggagtctggaaacatagacctttgctttgctaatgaggatgaggcaacagagcttctaagaggtgaacagaatgctgatccagtagctgctgtagaatgtctggccaaatactgtcaatgggctgtagtaacattgggttctaatggatgcatagctaaacataaaaatgagattgtatgcgttccagcgataggtgaagcaaaggcaattgat

SEQ ID NO: 403 - DNA, 442 bp, Cicer arietinum
gagaaatcgtggaaattgaattctagggtttgttattgtatcgggaatcaaacaatcagcaatggcgttgaggagattctacaatgagatcaaggggaagaaggtaacagaacttcctcaacacgtgaaaccgatgctttcattcgattacctcaagaaatcaattcagagaggtttagataattacagcgaaaagtatatcgaaacaagttcgattcaacctcttctccatgtctgttatggtggaatgatcttctcttaccttgttgctcttcctaatgagcgtcgtcatctcgctcacaaagagcacgccgaatctcatcactgattcaggatcctgattgttgaattggagatggttggcttgcttgatctttttgttttaaaatttgaaaaatcaaggcagaaagatactgtcagcttcaatgtgtttcatcgttta

SEQ ID NO: 404 - DNA, 280 bp, Cicer arietinum
gattctcggatcccgttacaacgtattcggtcataaaatctgtttcagaggtaacacgagccagtccaaaatcacaaatctttaagtcacagttggcgttcaggagaaggttgctcggttttaagtccctatgcagaacatttgcagaatgtatgtacttcaacccacgaaggatttggtacagaaaatactgacagtgctcctcggatagtgcttgatttgatcgaataatttggtgtaggtcagtgtccattagctcatatgcaatgtaaacatcatt

SEQ ID NO: 405 - DNA, 251 bp, Cicer arietinum
agcataaaaagaggtatttatatatgctctacataacataactcataatgacccaaaccattccggtatatccccaacgccgaaccatgatatcttaagcacgtctatcctctatgtttcttttctctaccattccggcgcaccgccgccacaaccattcgctgccatcataaggtcaagtggcttagtggtcatcttcgcaccaccagtcggcttgacatatggcttctttcccctcaacccaacaaact

SEQ ID NO: 406 - DNA, 404 bp, Cicer arietinum
accccgaggtataaagttcgagctttcctagtgtggtatttctcaacgcgtatatctcacattcatctccactctgagcaactcacaaaatgtctttcctgttcgacggtaaattccctactgcctcttccacgggaccaactctcagatctcacagggtaacactaagcattggtccacgcatggttcattattcatcatatttatttgctcccaaagaaccctgatacagatctagtattgacgctcaagctccctttctgctcgatgttcacctcggcgcttggcctcctccttgtcaaagaagtccagacccttggtctcaaactctcgttcaacgaaagcaccaacagctccgacaatgaattccttggcctgggcatggctatctggcttgccattct

SEQ ID NO: 407 - DNA, 280 bp, Cicer arietinum
gattgactgtgaaactgcgaatggctcattaaatcagttatagtttgtttgatggtatctactactcggataaccgtagtaattctagagctaatacgtgcaacaaaccccgacttctggaagggatgcatttattagataaaaggtcgacgcaggctctgcctgttgctttgatgattcatgataactcgtcggatcgcacggcccttgtgccggcgacgcatcattcaaatttctgccctatcaactttcgatggtaggatagtggcctaccatggtg

SEQ ID NO: 408 - DNA, 293 bp, Cicer arietinum
actaggttgaattactattgcgacactgtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcaatgtcgctatgaacgcttggctgccacaagccagttatccctgtggtaacttttctgacacctctagcttcaaattccgaaggactaaaggatcgataggccgcgctttcacggttcgtattcgt

SEQ ID NO: 409 - DNA, 317 bp, Cicer arietinum
acaaagttgggtgctggggaggatttatatgcgctttttgctggagttctaacaatgagaccttggaatagagttgttgacccatccatggatcatttagttatacagggaagtgagagtgaccgttcggaactgcagatgtatgcttctgaatatttccatgaaatctcggagcttctaaggagattaccacgtgtgattcttctaatgatgaagacaaacgactgtttacgggcagtcaacaatacgctgttacagggatcatctctggagacatttttaatcattggaaaggtttcttctgaggctgtcattga

SEQ ID NO: 410 - DNA, 200 bp, Cicer arietinum
cgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgtacctagctagctcagcacgtcttttgctccagtaggagatttggcttcgttacagccaccca

SEQ ID NO: 411 - DNA, 437 bp, Cicer arietinum; identical to SEQ ID NO: 333

SEQ ID NO: 412 - DNA, 408 bp, Cicer arietinum; identical to SEQ ID NO: 279

SEQ ID NO: 413 - DNA, 379 bp, Cicer arietinum
ctcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctccaggt

SEQ ID NO: 414 - DNA, 221 bp, Cicer arietinum
gaggtttttccctgccgccgcgacagtcgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgt

SEQ ID NO: 415 - DNA, 422 bp, Cicer arietinum
actgttatagacttgctctctgaagcgcaaaccaccaagaagcatgctcatacctaagataagcaataaattcgctaagattgaacctaatagagatgcctggacaatgcgaatttcgtctttcgttaaggcatagatgaagataatgagttccacggcgttgccaaaagtgacattcagcaacgcgccgagagcatcacccatctttcgggcaacagactcggtagcataagctaagagaccagcaagaggaataatggcaactgcattgagaccaaaaacaatacctccattgatgccatctacctggggtactgcaataccaacagggacgaagatgaggaggatgttgagccagctgtggaagatagaaattttgacacttcgcttaacttcagcgaagaatctgttcattttgctgg

SEQ ID NO: 416 - DNA, 294 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttacc

SEQ ID NO: 417 - DNA, 408 bp, Cicer arietinum
actcattacccccaagaggcacctctctactcgtagctcgtcctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagattgccagtagctgcaaccctagaaccgtgcatccttggggaaaacccttgcaggagaaaaccccaaagcggccagaacgctgctctgtggacgaggtagtcgcctcattccacggtctccaggt

SEQ ID NO: 418 - DNA, 459 bp, Cicer arietinum
accaagctcagcttcagaagaatttgatgtatttagctgcaattgctgatgcgcagccgcaaacaccaaccatgcctccacagatggccccgcaccctgcaatgcaaccaggattctatatgcaacatcctcaagccgctgcaatggctcagcaacaaggaatgttcccccaaaaaatgccaatgcaatttggtaatccacatcaaatgcaggatcaacagcagcagcagcagcagctacaccagcaggccatgcaagggcaaatggggcttagacctaataacggcatgcattccatgcacaacgaagcttctctcggaggtggaggcagtggtggtccgccttcggcttccaatccaaacgatggacgtggtggtggaggcaaacaagatggttcggaagctgggacagctggtggagatggccaaggaagctcagctgcagccgcacataacagtg

SEQ ID NO: 419 - DNA, 352 bp, Cicer arietinum
gattctcggatccggtgacgacgtattcggtcatgaaaccggagttgtcctcctgggaagcagcggatcgcgcaagaccaaaatcgcaaaccttgagatcacagttggcgttgaggaggaggttggagggcttcaagtctcggtgcagcacgttggctgagtgcatggctttgagggcgcggagggtctggtagatgaagtactggcagtggtcgtcagaaaggtcctgggtgcggatgactcggtgcatatccgtctccatcagctcctggatcaagtagacttcattaaatgactcgtagtttcggggcttctggatatcgagaatggagatgatgttctcgtggttgaa

SEQ ID NO: 420 - DNA, 352 bp, Cicer arietinum
gattaccggtcatttaaggcaattccagccttggcatcaaagatacttgacctagtatcaccaatgaagtcggtggagaccacatcatcttcagtgtatccgagaatgcctttcaacttgccctcagactcctccttgatagcagccttgatttcgtcgtaggtagcggccttctcaagcttcactgtaaggtcaacaactgagacatcaacagttgggacacggaatgccattccggtcaattttccattcaaaacaggaagcactttgccaacagccttagcagctccggtactgctaggaatgatgttaaatgaggcagctcttccacctctccagtctttggctgatg

SEQ ID NO: 421 - DNA, 202 bp, Cicer arietinum
cccgggcaggttacactcttcactcgcgtagcagcggcatcaactagtctcaggaggagaaaaatgtctcacaggaagttcgagcacccaaggcacggatcattgggatttctcccaaggaagcgtgctgctcgtcacagaggaaaagtgaaggcattccctaaggatgacccaacaaaggcacccaagcttactgccttct

SEQ ID NO: 422 - DNA, 438 bp, Cicer arietinum
actattggtgttatgcagtgctttggagagttccatggcagaaagactccatgatctagcaaggaactccattgattctgtgggcgtatcaggcggggggcaagatgatgcaggcccatctgcaggaacattctcatcaatgttctctatttgatgagccgagcatttagagacagaggtgttggagctcattgtaaagatgaatgaatattccaagtccctaaagcttcaataaccaaagacttagttacatatgatgagagaactgaggaccaacagttagatatttaaaagaaaatgtgatgttgtttcaaagtgcttgttatttaaaatgatgaagaaaaaaattaacttcaagtattcatagtgatgaacaaaaggaccctaattgaaaacgccattatatttgtctccacttaagttgtatacctcggccgc

SEQ ID NO: 423 - DNA, 403 bp, Cicer arietinum
accaccattaacctgaatctccataatgtgggctttcttctgcttcaatcccttcatcttcttgatctgagtgtgagccagaacacggataacagttgcatacttcttcagtttctcaagctgggtctgaatgttcttctttccttcatcggtttcatactgctttgaatacttagtgaaagccttcttcttggacttgcaccaattcttgtagaacctacgcttgatttcttcactcaaatgctgagtccaaacagtattcaaagtccgaagaccgcggggagttttcacataaccaacaacaccaacaacaatcattggaggggtctcaatgattgtaactggctcacaggtctccttcttgtgaagcttggatcctggtttctcgacttctctgacaatg

SEQ ID NO: 424 - DNA, 334 bp, Cicer arietinum
acttgttagcgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgcctcgatagagttgaggttattgctgaaaacaa

SEQ ID NO: 425 - DNA, 378 bp, Cicer arietinum
ttaaccaaagaggactttcagggctccaagtggttggtgttgagatatgcaatacttaatttggaagttattcaagcagccattcttttagccaaacaggaaggtctttttgtttccttggatttggctagttttgagatggttagaaatttcaaacagccacttctgaagctattggagtctggaaacatagacctttgctttgctaatgaggatgaggcaacagagcttctaagaggcgaacagaatgctgatccagtagctgctgtagaatgtctggccaaatactgtcaatgggctgtagtaacattgggttctaatggatgcatagctaaacataaaaatgagattgtatgcgttccagcgataggtgaagca

SEQ ID NO: 426 - DNA, 406 bp, Cicer arietinum
actgcaaaaataacccatgagtatgcacggattaccaaaatagctaacggaagacaccacaacagagtttaaaaggatggcaacaaaaataacataaataacgatttccaacatttcaaagcagcagccataactaagctttgaggcgtccatagaacttctgtttctcttgtgttgtctggaagcgaccatgcccaaactttgaagaggtatcgataaacttaagtttgatatcctccaaggcattgcgagaagtctgcttgagtagagactgacgcaaagtaataacccttttcttgggaccaacaacacctcccttgatcatcagataatcctccttcacaacaccatggtgggggaatccacccattggggtgatgtctttctcagtcctatcataatcagt

SEQ ID NO: 427 - DNA, 283 bp, Cicer arietinum
accctgactctcaagtggaatgtatcctttccggcaaatttagacatatacttgttgcaagcaatcctagcagcttcaagtgcctcacttgaaacattttccttctcccaactaaccagatgaacacagaagggaaactcatcaactcccttcttcttcataccgacatcataaattctgatcttgggatcaggaacaccacggcaaaaccgtgacttagggtatggctgtttttaatttgtctgtaacacctggcaggtctccttcccatggctgcgtcgcg

SEQ ID NO: 428 - DNA, 308 bp, Cicer arietinum
acaaagttcatcatcagtccatgtcatgcagtcctcagtggcggggaaaccaatatcaccccatctcccctaacaaacaggaaaggaactgtcctctttgtagtcctaacaatttcttcatatgtttcatcatcaatttcaacagtggtaacaatttcttcaacatcaccaagaatcatattaagatgctgatcataagcgtgaagcttgccacgaagttctcgatcagaacggagtttaacgtagatacgttcgtcgagactgagtcttatgagatccaaaggctccttcactgcgctttcttcttc

SEQ ID NO: 429 - DNA, 365 bp, Cicer arietinum
acctcaagtttccccctgtggaggagcttgatgccgccttgggcacaaagaagtggatggtcaagaagggcgaggccggtgaggcgcctcttgctaagcttgacagcaagatcaagtttgttgggttgaggggaaagaagccatatgtcaagccgactggtggtgcgaagatgaccactaagccacttgaccttatgatggcagcgaatggttgtggcggcggtgcgccggaatggtagagaaaagaaacatagaggatagacgtgcttaagatatcatggttcggcgttggggatataccggaatggtttgggtcattatgagttatgttatgtagagcatatataaatacctctttttatgct

SEQ ID NO: 430 - DNA, 316 bp, Cicer arietinum
gcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctac

SEQ ID NO: 431 - DNA, 142 bp, Cicer arietinum
acatccattgccaattttctaatgtcacctcaccaccaagagaacgaataacagacccaccactgcatgttcctactttgcagcattcttcaagtgataagcctttgatcactccatacaaaaatccacttgcaaaaaggtc

SEQ ID NO: 432 - DNA, 407 bp, Cicer arietinum
acaacagaggctgaatatctgatctctgctcatagagatgcctttgccttcaaggcaccatccagcaccacatcaagccatttcgtgatatgttggttcacggcctcagaagcctgccataacgcccagtgagacgctttgacttcctcccgagttaagttggtaaaggctgagtccattcccttggacatagacggtgggagagccgaatcgtcagttgcagtgatgaacaaagctggcatctcgaacttgtggccacccttcttggctacctctgcatcgtcgcggtggttgagctcctgcatgcggtaatagtttagagggccacgcagctcagggggttctttcgaggcatattctttggcgtagtagtccacctcttccttgctaacaagtggcgagggacc

SEQ ID NO: 433 - DNA, 341 bp, Cicer arietinum; identical to SEQ ID NO: 202

SEQ ID NO: 434 - DNA, 406 bp, Cicer arietinum
acaacagaggctgaatatctgatctctgctcatagagatgcctttgccttcaaggcaccatccagcaccacatcaagccatttcgtgatatgttggttcacggcctcagaagcctgccataacgcccagtgagacgctttgacttcctcccgagttaagttggtaaaggctgagtccattcccttggacatagacggtgggagagccgaatcgtcagttgcagtgatgaacaaagctggcatctcgaacttgtggccacccttcttggctacctctgcatcgtcgcggtggttgagctcctgcatgcggtaatagtttagagggccacgcagctcagggggttctttcgaggcatattctttggcgtagtagtccacctcttccttgctaacaagtggcgagggac

SEQ ID NO: 435 - DNA, 407 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgtcgcggcggcagggaaaaacctcgggaagggatcagaggccggcggtgcggcttgccttcaaaggagaaaaacccatcgcaatcggcgtcgttgatcgggaggatgtcgctaccgatgccataggcatcgtcctccgatatctaaggcgttctggttctgaggtgccgccattagatccgacaaagttgttgtcagagaaggcgaactct

SEQ ID NO: 436 - DNA, 243 bp, Cicer arietinum
cgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgt

SEQ ID NO: 437 - DNA, 365 bp, Cicer arietinum
agcataaaaagaggtatttatatatgctctacataacataactcataatgacccaaaccattccggtatatccccaacgccgaaccatgatatcttaagcacgtctatcctctatgtttcttttctctaccattccggcgcaccgccgccacaaccattcgctgccatcataaggtcaagtggcttagtggtcatcttcgcaccaccagtcggcttgacatatggcttctttcccctcaacccaacaaacttgatcttgctgtcaagcttagcaagaggcgcctcaccggcctcgcccttcttgaccatccacttctttgtgcccaaggcggcatcaagctcctccacagggggaagcttgaggt

SEQ ID NO: 438 - DNA, 466 bp, Cicer arietinum
gggagtctttcttctactcaatcattcatcatgggtcgtatgcgcagtcgcggtaagggtatttcaagttcagctcttccttataagaggactcctccaagttggctcaagatctctactcaagatgttgaggagaccatctgcaagtttgcaaagaaaggtctaactccatctcaaattggtgttattcttcgtgactctcacggaattgctcaggtcaagagtatcaccggaagcaagattttgcgcatattgaaggctcatggtcttgctcctgaaattcccgaagatctttatcacctgatcaagaaggcagtgtcaattaggaagcatttggagaggaataggaaggacaaggattctaagttcaggttaattttggttgagagcaggatccaccgtcttgcgcgctactataagaagacaaagaagcttccacctgtttggaaatatgaatcaacaactg

SEQ ID NO: 439 - DNA, 407 bp, Cicer arietinum
acaacctctgacattcgtggcctaagttttgcggtttcttgaacacaaagtaaacccactttgaggaattttatggcttcttcttctaaatagtctgtattaagcacaggatctaccattcttaatagatcatttgcctcataagctgtccacgccttttctacaatgaaacgttcgatatctgtataggcatctacaaccgccaaaccactgataatttgtaaaagcaacactccaaagctataaacatctgattttcttcttagttgtccagaactagcatactctggagccaaataacccaatgtccctgcaactctagtgctaatgtaagatgtttcatctctcattaatttggccaaaccaaagtctgcaagtttaggagtaaaatttcgatcaataagtat

SEQ ID NO: 440 - DNA, 403 bp, Cicer arietinum
acctctcaccagaagcaacagtgcaatgacagacacaggaaattgtccctaaaggttcgggagtcagattctgctgatacttttgtgattccagcttcattgaaagttgaccatgatgactgcaaatacccaggagatccatctattttcagttcctcggacgtgccatctttaactaacatggttatgtgtaggtgactccatgttgttttctatagaatggtgtctacttttcgggttatctagttttttcattccatttagcacaaacactatttatatttaatctttaaaccttgtgcatccattcgatgcctctgttttttttttcaccttttcctcatgatttcttctacagtgttttttctaacttagaaattgtatcttaggttctagtcttttg

SEQ ID NO: 441 - DNA, 359 bp, Cicer arietinum
gttgaaatccataaagcctccgacaacaaacaagaactattcgacggcgaggttgtatctgaactgacaacttctctcagtcctaaccgaacgaaaacagcaactgttgctctaaaggtcagaggaagtggcaagtttggagtttactcttctcagcatccacttcaatgtgcagtcgatggcattgataccgatttcaactatgactcagaaaccgggttgacaaccttctccatcccagttcctcaagaggggatgtatagatggtcgatagagattcaaatttgagtcatgaacacatggcatttaagtgaattgtgtaggtaaaggggttttgttgtaatatctacacatttggt

SEQ ID NO: 442 - DNA, 410 bp, Cicer arietinum
accgacgaaatggtgtatgggctgtcccttgatagagaatcttgactggttatcattgatcatgacacccctatccgtgttgatcctaagaagatcacacaagttgctttcctcagacttacaatgtggacattccccacactccccagtgaatacaggcagagcatgatcccctggttccagatgagtcacaccctcccctacgctctccacaatccctccagcttcatgaccaaatatacgaggaaacagtggagtctgacccttagcttcccagaagtaaacatcagtgtgacaaagggaggtgaagagtatcttaagacggacttcaccggcttgtggtggcgccacctccacttcttctatcaccagcggcttccccgcctcccatgcaatcgcagctttgcatt

SEQ ID NO: 443 - DNA, 407 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggcgaaaaccccaaagcggccagaacgctgctctgtggacgaggtagtcgcctcattccacggtctccagg

SEQ ID NO: 444 - DNA, 196 bp, Cicer arietinum
acttccaacacgcccccattcacctcaacatcatgggtcagccgtcgtgggctcttgagtgttccataggagacgtccaccttcttcagtagggctttggctaactcgtagcgcttccaggaatttatcatgactcgcagcaggtaatggcttcgtaagaccatctgctatttgctcatgggatctgacatattgt

SEQ ID NO: 445 - DNA, 196 bp, Cicer arietinum
acaatatgtcagatcccatgagcaaatagcagatggtcttacgaagccattacctgctgcgagtcatgataaattcctggaagcgctacgagttagccaaagccctactgaagaaggtggacgtctcctatggaacactcaagagcccacgacggctgacccatgatgttgaggtgaatgggggcgtgttggaagt

SEQ ID NO: 446 - DNA, 310 bp, Cicer arietinum
acatagcttacctggagaccgtggaatgaggcgactacctcgtccacagagcagcgttctggccgctttggggttttctcctgcaagggttttccccaaggatgcacggtcctaggttgcagctactggcgatcttaggggatcatggacttcctgcctcagggtatggaaagctacttgatctatcagtgcaagagaattctaggctggagaggaatagttcccgctgacgggatgacctcttgaaagtaaagcgcctttgtgccgatgatatgctggatgaactagatagaagcgttgctggagggaa

SEQ ID NO: 447 - DNA, 410 bp, Cicer arietinum
acagctaatgacatcactggctcaggaacattcatagaagtcatggtgtatttaactgacccatcggtaaaagtatcacctgatgcacaatcaacaccaaatacagcaactatttggccagcatgggcctcttgaatgtcctccatctcatcagaatgcatccgaaccaaacgaggaaccttgatcttcttgccagtgttaacattaataataaaatcacccttccgaatgataccctcgtaaattcttagatatgttaactgaccaaaccgcccttcctctaacttgaaagccaatgctacaagtggcccatcaggacttccagatagctcaaccttctcctcattcttagattggtcgagagcataactactaacttccattggacatggcaaataactaagtacctg

SEQ ID NO: 448 - DNA, 258 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccatgttgtagctcgtagtcgtatgtcgtggcggcagggaaaaaccttgggaaggaatcagaggccggcggtgcggcttgccttc

SEQ ID NO: 449 - DNA, 165 bp, Cicer arietinum
acggttcgctgcaaggctctaacggtgtgctcagcaacaacctcgggtgcaacctttggtgaatcggatcctggtgtcaccatgttaggcttcaagagagttccttcgaggaggacatggtggtcactcaaggccttgtaggttgctgcaaggacacgctcggtg

SEQ ID NO: 450 - DNA, 308 bp, Cicer arietinum
cgattttgcagccgcgccccaatctcgtttctcacttcttccctccgagccacccaaaatgactaagagaaccaagaaggccggtattgttggcaaatacggcacacgatatggtgccagtttaaggaagcagattaagaagatggaagtcagtcagcacagtaaattcttctgcgagttctgtggaaagtatgctgttaagaggaaggctgttggtatctggggctgcaaagattgtggaaaagtgaaagctggtggtgcatacacattgaatactgccagtgctgcaactgtgcgaagcaccatcc

SEQ ID NO: 451 - DNA, 407 bp, Cicer arietinum
acaaatagctccaacaccactaagactccacttccataaattaaaaccattattgtccttttcttcccaacttgattcctcttctttttcaccaaacacatctttctcaataatcattcttggtgaactagtaacctcttttccactatttgactttggtgattcaattttcatgtcaacaaattcattttccttaatcttaaaaaacacttgtgacacactttcttcttgatcaacctcaaaagattgattctttgtcatgtctttcaacaaaacaacatcatttgaagtgttaccaatttttatttccaatggaatttgtaaagggacaagttggttgtgttttcttggtggtgatgatggatacaaataatcctccatgtctaaaatattttctgacccttttg

SEQ ID NO: 452 - DNA, 406 bp, Cicer arietinum
acatgttatcgatcacactctgatagtgtttaagcaactgaggcctcttcttcttatatgttggagtgataaggtcacgttccatatcaaatggaactgggtcaagatgaactgcttttataaactcgaagcctttcaacttcttttcctttccaatcttcgagagctcttcaagtatgtaaccttttgccctagaatcttcacacagagaattgaagtccattgatataccattttgctctgcccaatgttcaagtgcctgctttctggggttaacaacagcaacaaggaaggcctcaaaactgtttccgtaaacccatatagattcaatagaaggaacttggccgaaaatattctccaggttttcaacggcaacatattctccttgtgaaagcttgaatatgtt

SEQ ID NO: 453 - DNA, 343 bp, Cicer arietinum
acacttgtggtcttctagtaggcggtgcttgccgcagaaatgaccttgggaaaaggtgcagtcgccgacgatgcgttgagcggactcacggcacgaagcagcggtgcagcgaattcgcttaggaggcatggcgttgtttgttttgttgaatttatggaaaaagtagacctctgagagatgaactgaacacgttcttgagtctttgagagtttatgctggaagcggtaagaagttgaaccaagaaaggtggtctttataggaaatcggatgcagtgacggcgtttcgagaaatccgtggaaagcaagaaccaaatcaaagattcattcacacaacgacagtgac

SEQ ID NO: 454 - DNA, 388 bp, Cicer arietinum
caaaaaagtcggtccccaatcttaatttcttcattcatcttgtcttctcatatcactttttttctgagattgatttatatattcgatcgaaatcgcttcttaattctgattccgattctcaattcttcttcttcttattctattttgacagttaaggttgaaagtaaagggtttgacttcatctgaggcggagagacatggctaacaatgcagctgcctgtgctgagagagcaaccagtgacatgctcattggtccagattgggcaatcaatatagaattgtgtgatatcattaatatggatcctaggcaagcaaaggatgcattaaagatacttaagaagcgtctgggcagtaaaaatcccaaaatacagctgctggctctttttgt

SEQ ID NO: 455 - DNA, 296 bp, Cicer arietinum
acccttgtcaaccttgataccgggaagaacaccagcttcgttcaagacatcgaccaaaggcttgcctgcagctgggctctggtacagggtctcctcaaagagaataactccactgagatactgaaggacattgggggcagtgaaaagaagctcacgaagagcacgcctgttggtttcgacgttctcgacattgatgctggctagacacttacctcttattcttaacctaacacctcttttcctttccaaatcaaataccttttcttcctcgatcatgtcgaacttcaagagcaagt

SEQ ID NO: 456 - DNA, 411 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccc

SEQ ID NO: 457 - DNA, 442 bp, Cicer arietinum
accgggacgtatttccagcagaaattctgggattgccaccagtaagggaagtggaatttttcattgatttgcagccagtaaccggacctatttcaacgcacgagttcttactcaatcgacacaaccaacccacactttttccaacctcttcatctttcgaaatggctcccaaggctgctgacaagaagcccgcctccaaggctcccgctactgcctccaaggctcctgagaagaaggatgctggcaagaagactgccgcctctggtgacaagaagaagcgctccaagacccgcaaggagacctactcttcttacatctacaaggtcctcaagcaggtccaccctgacactggtatctccaaccgtgccatgtccatcctgaactcttttgtcaacgacatcttcgagcgcgtcgcttctgaggcttccaagcttgccgccta

SEQ ID NO: 458 - DNA, 215 bp, Cicer arietinum
actgtaatctcaccaagcgcccccaatagcctcaattttcgtttgtgacagactgaaaccaagcagttgtcgtttctcaatcgtgacctgttcccagtggttgttcgtaagatattgactaaaaaaatatatggttgaaaatcggcggttcaagaagaaaggcgaatccaatggtttgtgactgtatagcgttggcaataatggatggaaagatc

SEQ ID NO: 459 - DNA, 139 bp, Cicer arietinum
acatgatccctctcggattgattgtaatgaatgccgtgacccaagcaatgaatatgcctgaggaacaggctggtgggcaagctggggcaccgccgcagccaggatctgcagttcagaggggagcaaattctggtgtacc

SEQ ID NO: 460 - DNA, 396 bp, Cicer arietinum
actggaattaatccaaaggctaaatcttattatctatttgatggttacgcacatctttcttctggtctcgcttgtggtcttgctggtctctccgctggtatggccatcggcatcgtcggtgatgccggcgttagagcaaatgctcaacagccaaagctttttgttggaatgattctcatcctcatttttgctgaggcgttggcattatacggactcattgtcggcatcatcttatcttcccgtgctggccaatccagggctgaataaatgttatctttctcattggtggtggtttacatagccacatattgtgaatgtcactgcggagttggctttggtaatgtcagtagactgattgctgctttttattattcatgttattctatttatttatgt

SEQ ID NO: 461 - DNA, 405 bp, Cicer arietinum
acatccattgccaattttctaatgtcacctcaccaccaagagaacgaataacagacccaccactgcatgttcctactttgcagcattcttcaagtgataagcctttgatcactccatacaaaaatccacttgcaaaaaggtcccctgcacctgtagcatcaattgcctttgcttcacctatcgctggaacgcatacaatctcatttttatgtttagctatgcatccattagaacccaatgttactacagcccattgacagtatttggccagacattctacagcagctactggatcagcattctgttcacctcttagaagctctgttgcctcatcctcattagcaaagcaaaggtctatgtttccagactccaatagcttcagaagtggctgtttgaaatttctaa

SEQ ID NO: 462 - DNA, 458 bp, Cicer arietinum
gattttcgagcgggccgcccgggcaggtacttatcgtcaaacttatcaacattaactgaagaaacatctactttggttgatgtcccgataacataagactgattcacacgcctcaatgggactccattgatcttaaaaggaccagtaacaagaagaaggccagaaggaagctgtttcaaaaacacaaccctctttcccttgaatctaccggcaagaagaatcaacactgtccctggagtaatgttagccctgagcttagtaggcttaggtttgtgcttgttgcgaagtggcttcttgacatcatcggcggggtagaatttaggagccttctcagcgggagcttcaggcttaggtttgggatcatgtttagggaaagcgccgccgtgtttggccttgatggcccagagacctctcttgtggtacatggcagattttgagtattttccgattcccctgat

SEQ ID NO: 463 - DNA, 359 bp, Cicer arietinum; identical to SEQ ID NO: 441

SEQ ID NO: 464 - DNA, 408 bp, Cicer arietinum
actgcattaatttcttcttgataagctttagcttcagcagtttcatccataagtttctgaacatcctcaatgtttatctcactttgtatggctttcattgcttcattaccggccttcaaactttcaaacacagatttctgcttgcttgccagttcaatatctgctaattgttgctcaacatttataagccaggcgtcaacttgcttcaacaattcttcttgtgtcttttttttctttaatgccagcaaggccctatctttcttcttttcacgaatcaagtctcgtgcagcttgcttttctgcttcaataatagcatcaagcttttgttgatattgggcaagtttacgtctctgggttttgagtgcaagaattgcacgatcgacatccgtcaccttgggtttcttgacg

SEQ ID NO: 465 - DNA, 450 bp, Cicer arietinum
cgggaccccaagccgtggaactttgaagatataaagaaccatgttgagaaatctgaccagggcgatgtagtcctcatcgacgtccgagaaccagtcgagcttttcgagacgggcaagatccccggtgcgatcaatattcctatcacatcggcagctcagagcttccacatctccgacgaggattttgaggacatgtatggcttccagagaccggcaaagaacaaagagcttgtgttttattgcaaagcaggagtgcgtgcaggggcggctgcgcaactggctcatcatgctggctggaacaagatcggcgactatgcaggcagctggctggactgggaagctcagaaaggaccagttgagaaggttaagaaaccatattgaacagacagagcttgatgaagacatccattggcagaatggttggtcaaataaaagcgccttctaacttat

SEQ ID NO: 466 - DNA, 411 bp, Cicer arietinum
acatgccattttgcccagacggccacgatgctgtgctccatgaattgacaaacttgcacgaggtatttccggctctaaacatgcactgccatagatatccatggctctgagaatttttcaatagatttactcttttccaaaatcagcattgtaatgtgcactggattcaagtttctttgcctcattcagtttcctaacagcctccataaaatcttcgtggatcacataatcacgctctgcacgaattgctgacattccagcttcggtgcacacatttcggagatcagccccattaaacccctctgcaagcttcacaaccgcttcatagtctatttcaccatgcttagcaattccagctgcatggatcttaagaatttccatccttgattgttcatttggcaatggaatttc

SEQ ID NO: 467 - DNA, 342 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctacctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaatctctgctgagatcaactgtattgatgtc

SEQ ID NO: 468 - DNA, 132 bp, Cicer arietinum
ctttagtatttctttgaattcatcatagagcctcatggatagtgataagaagttaccctgagaactcttcaataatttgaactgcaacaccatctcaatgattccaaggcactagcccgagaggctgttgat

SEQ ID NO: 469 - DNA, 404 bp, Cicer arietinum
actcattacccccaagaggcacctctctactcgtagctcgccctacagtagttgtcggtgaagcacgtcccattggacatcaatacagttgatcctcgcagagcttccctccagcagcgtctcccatctagttcatccagcatatcatcggcacaaaggcgcatttactttcaagaggtcatcccgtcagcgggatctattcctctccagcctagaattctcttgcacagatagatcaagtagctttccataccctgaggcaggaagtccatgatcccctaagatcgccagtagctgcaacctaggaccatacatccttggggaaacccctcgcagggaaaaacccaaggcggctagaacgctgctctgtggacgaggtagtcgcctcgttccacggtctccag

SEQ ID NO: 470 - DNA, 361 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgagg

SEQ ID NO: 471 - DNA, 405 bp, Cicer arietinum
accagcaacaatataaagcataaaataaaataaaataaaatttaacaataggtcaagcaaatcaaattatatcagacacttgacactactaaaatgtctcaattgaaaaggaaaatccaacagaacctaatacaagtaataactcaaaattaacaaaatgttgtgtttcaactacaactctaacaggaattgcaaattttccggcaaaaagatcagaccttttagtcgaacaaactgaagcccatgtcatcatcagattcttctttttcttcaaccttcttttcttccttggcttcagcagcaggtgcagcagctgctgcagcacctccaccaggtgcagcagaaacagcaacagcacctccaccagatggcactgaagacaacttttctcttccactagcaatt

SEQ ID NO: 472 - DNA, 288 bp, Cicer arietinum
actgttgaacaactttgtttgtgaaaaacggcaccgtcatgattcttctcattttccgccaatgttcaccgtaaacggtgaaaaccatatccttccttttccggtgaagatatcgaaaacaacgttccttgttcgggaaccgaattcgacaccttgagtgtggagaacctcttttgcgagttcaggtgatgaaactacgacgaggtttctttgacccatacgaaggaggaagatatcgccgaaccgttttgctaagtcggtgagattacggtggttgagatcatcgcc

SEQ ID NO: 473 - DNA, 407 bp, Cicer arietinum
agttcccaaatttccttcacgtgactgtgggtggcatcgccatcatcctctcgccgcgttcatcgaccaccgtcactctctggtgaggactgtctatcggtttattcattgatcaaaatagtctttgtatgaatggctatgtcgttattaagaggtcgcgccgcatcgtcggtgctcaatttgttcactaatgccattcgccgttactcttccgccgccgagattgcgaatgcgattcctcaagaggcacgtgagaggatgatgtattctgacattaactctcagattgggagttgtatgcctctctcagcaatgcgaattggaacaatcattcataacattgaactgaaccccgggcaaggtggaaagcttgttcgagcggctggaaccaatgcaaagatcttgaa

SEQ ID NO: 474 - DNA, 407 bp, Cicer arietinum
gattcagatccaaaccatagattagatctaaaatggcaacaaccacctttgcaaccgtcgtaggaatgggtggcgcatcacgtctcgcctcagggtttgtgaaaccacaagtgatggccaggaatcgcttgaggcaagctatggcacggggaaatggtgggagggttacatgcttccagagggattggctgcggagggatttcaatgtgattgggtttgggttaattggttggttggcaccgtctagcataccggctatcgacggtaaaagtctgactggacttttctttgatagcattggaactgaacttgctcacttcccaacccctcctgctctcacttcacagttttggttatggctgatctgttggcatttgggactgttcatctccctcacttttggccaa

SEQ ID NO: 475 - DNA, 368 bp, Cicer arietinum
tttttttttagaataagaggtccaataatttaattaaaagaaaaaaggtgtgatgataataaagaaataagaggaaaagaagtgtataatatttaaaagattacatactgtagaagtagaatggttggtcaacaattcaggccaaattagcaacctaattttgtatgcttttaattgacgtcactttcatcctccgcctccgcatgcgaccatagaaaaagaaaagaaaagaaaaccggtaaccctgttcctaccacttcaagatgaagaactgcttggaaagtaaccatttcctccttctccattaatgtcaccattattaatattattgtttgcggctcttggattgttcattagtctctgaaaaa

SEQ ID NO: 476 - DNA, 112 bp, Cicer arietinum
acaaggagcgaatgaccaagccaggcctacaatgctatttcatgctaacaaacttcccaacaccgatccatgcaatgctaaagtcgtaaagatgagtcattactgatcttga

SEQ ID NO: 477 - DNA, 405 bp, Cicer arietinum
accaatgctatttatggtgatattcacagcccttctatcagcttcaaaagctagaaggtcagacattatctcagcagtagcaccaccaagtttctgacaaaatctgtaaaaatcttcaaggtatgccttgtaaagagtgttcctcatgatttcgatgttcatgtcatccaagtcctctgatgtaatgcactcagagaagtatggagccagaggagtgtcaacgagaaccagcctgtaaagctcccgcatattctgagcaacagccagagtggcaatactgtcaaacatgcccagtggatggcatttttctagtagttcctgaacatctctctcatgcaaggtgccagtaacaatcaaaacaacattgtctatcatgtgaccatatgtgatatactctaaaaaggt

SEQ ID NO: 478 - DNA, 407 bp, Cicer arietinum
accacagttaggtaggtttccgttctcatcagagaaagtgagacctaactgaatcagcttcaacatatcaacgttatccttcaaagtctggtagttataatcgttgatgtttttgaaattccctacaggacgaagaacaactccaggaaactcagtatccatagctataaagttgaattggtcaacgatttcacggatcaatgcaaattcttcatcgagattatcgttccaaacctctctaatttgaaccgaatctcctttcgatgaaaccgacatttcacgaacgacaaaatgaaaatcgaaaacaaatccaccagatctgaagaaggttcgatttcagtgatttgagcttcgaatcgaaagtttgaggttaagattcaactagatcttatagtgaagaaaataaa

SEQ ID NO: 479 - DNA, 368 bp, Cicer arietinum
acaattgcatttcttcgaagcatttctcttgaagctgttgcacttggagttcacctagctgctggagcccacgactttcttctccaagcagaatatagtctttcaagcataccttctccagttgctctgcctgtaaacgataaatcaaggacaggtgttcgatctaatcaacccaaggatgcccaacaaggaattcaacaggcttgtgagagtctcagtgatggcctgggaaaatctgctgcagtgttagttcagaaccctttgaaaaagttccagcgcggttcaggtgcaggacctgccttggccgctgctgttcgagcagttcctgcagctgccatagctcctgcttcggcttgtgcaagtgctgt

SEQ ID NO: 480 - DNA, 410 bp, Cicer arietinum
actggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctatggtttcgctggatagtagacagggacagtgggaatct

SEQ ID NO: 481 - DNA, 133 bp, Cicer arietinum
aaatattctcccttggcacgcactgttagtgcactgttaggagcgggattttctacgggctactcggccacacaatactgcggggacgccatcggttccctaacagcagttttcagagaaggaattttggaga

SEQ ID NO: 482 - DNA, 431 bp, Cicer arietinum
acctacagtagccctgcatcgagaatcaatcaattttttaacaccagatgggagttgaactaaacagtatgttgatgttggctctttcaagatctttgcattggttccagccgctcgaacaagctttccaccttgcccggggttcagttcaatgttatgaatgattgttccaattcgcattgctgagagaggcatacaactcccaatctgagagttaatgtcagaatacatcatcctctcacgtgcctcttgaggaatcgcattcgcaatctcggcggcggaagagtaacggcgaatggcattagtgaacaaattgagcaccgacgatgcggcgcgacctcttaataacgacatagccattcatacaaagactattttgatcaatgaataaaccgatagacagtcctcaccagagagtgacggtggtcgat

SEQ ID NO: 483 - DNA, 407 bp, Cicer arietinum
agttcccaaatttccttcacgtgactgtgggtggcatcgccatcatcctctcgccgcgttcatcgaccaccgtcactctctggtgaggactgtctatcggtttattcattgatcaaaatagtctttgtatgaatggctatgtcgttattaagaggtcgcgccgcatcgtcggtgctcaatttgttcactaatgccattcgccgttactcttccgccgccgagattgcgaatgcgattcctcaagaggcacgtgagaggatgatgtattctgacattaactctcagattgggagttgtatgcctctctcagcaatgcgaattggaacaatattcataacattgaactgaaccccgggcaaggtggaaagcttgttcgagcggctggaaccaatgcaaagatcttgaaa

SEQ ID NO: 484 - DNA, 407 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactc

SEQ ID NO: 485 - DNA, 407 bp, Cicer arietinum
actcaacaatggcataattggaaaatcttcctgtgctggaacatgatgaattcccactacgtgccacaaaacaatgtccttgttctcaatgtctctattcttttgagtccaaacagctaaagtatcatctccacgactatgatcaacataaagtccaccagcccatttctcagttctattataaggtgtgacccaaacattataattggtaaatgcgccacgtatttgtgggtaatcatcttccgttaaaagtggatgagctggaattgctggaatcaaacggtatccgacctcgcttccaaccgcagtttttttgtttggattcacaacaacaagctcagctgggctcagcccaattgtaatttttgcatctgattcggttttagcagtttgggtctccgtggtcc

SEQ ID NO: 486 - DNA, 373 bp, Cicer arietinum
cttgtttgtttcaatcatcatccatgtcgactactgctggtcaagtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaagggtcagactcctatgtttcctcgtatatttggtcatgaagctggagggattgtggagagcgtaggggagggtgtgactaatctgaaaccaggggatcatgctctgcctgtattcactggggagtgtggggaatgtccacattgtaagtctgatgaaagcaacatgtgtgatcttct

SEQ ID NO: 487 - DNA, 409 bp, Cicer arietinum
cactgacccaattccgttaccgttatcctcacccttctcttaatttattattaacccttatttctctttctctaacagtaaatcagaacaacacctctttgttcttttcacacccccttcttctcctttcaccaagattccaactttttcgttgcaaggaaaagaaaagggtgaagcgttccaattccaattcagaaatgaagcgttcactttcatcggcaacgaacgaagacagaaaaatgaaaagagtgaaggagtcagaacccaacgatgaaaactgcgaagaaattgatggggtttgtgagaagaatcgcgggctagcgagtttcgacgaaaacatgctgttcgaagttctgaaacacgttgatgcaaaaactttagctatgtctggttgtgtgaacaaacagtg

SEQ ID NO: 488 - DNA, 324 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggc

SEQ ID NO: 489 - DNA, 282 bp, Cicer arietinum
acatgagtgagccggttttcgagctatagtcttctcgctcttctggagaagccgagtcgccatcgtctcttggtcgcagtgtcgagagcgaatttcgctccataggggtcttgactggtcggcagttttctaagccgaatctcttcagtattctagtgaaatatgcatcctgggaaagatagattagccttgcgttcctgtcgcgggttattcttacgccgaggaagtgtttggcgggtccgagatcagtcattgtgaagatctctcccaggcgggctttgt

SEQ ID NO: 490 - DNA, 341 bp, Cicer arietinum
actggctcaccgagcgcaccttcggcgagttctctcgcagcttcaacttccccactcgtgtcgaccaggacaacgtctctgccaagtttaaggacggtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgtaggcctggcttggccattcgctccttgt

SEQ ID NO: 491 - DNA, 400 bp, Cicer arietinum
gatttcgagcgggccgcccgggcaggtacacgttatctccctccgacgaaaacgtgaaggacgatgattgttcctcttcagcggtggccacggagcccaaacgccggacgatccggtggactgacaacgtggccagaaaattagggttaattgattgaatggaatttcttattaatgagtgagccattttgtttgtttattttttcctcttgtggagaaaaaaaacagtaatgtttcttctgttttgccgtctcacctttcgcgacctcgcctcaccttgccgccacaccctcaaaccaaataaaacgagatcgaaaacttcacctcagctgtccctatcgccgtttccgtcgacgtcaccgttgcagatttcgagtgtgcgagagacgcaagagtaaga

SEQ ID NO: 492 - DNA, 172 bp, Cicer arietinum
tttttttttacagaaacgaacgtcaatgagcacctacatataataaagtctaatcttaatgagaaaacaaatgcctgctctcccattgacaaaaatcactacgaatttagcacagaagaaacataaaataaaataatcctattaaataatctctataactcatttagagtca

SEQ ID NO: 493 - DNA, 409 bp, Cicer arietinum
accggttcaggtttgggttccctattgttggaacgtctctccgttgattatggcaaaaagtccaaactcggattcaccatctatccttcccctcaggtttctactgctgttgtggaaccatacaacagtgttctctccacacattctctccttgagcacaccgatgtcgctgtgcttttggacaatgaggcgatctatgacatttgtaggagatctcttgatattgaaaggcctacttacacaaacttgaacaggttgatatctcaaatcatatcctcactcacaacctcattgaggtttgatggggcgattaatgttgatatcactgagttccagaccaaccttgtgccttatccccgtatccacttcatgctttcgtcctacgcacctgtgatctctgctgccaagg

SEQ ID NO: 494 - DNA, 233 bp, Cicer arietinum
acaaggatcgacacgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggacttgggaacaaca

SEQ ID NO: 495 - DNA, 246 bp, Cicer arietinum
cccaaatccattttcgatttcaatcggagagcaaaagaagaagaagaatccatttcatggcggctacaaagcttcaagccttttggaatcatcctgctgggcccaaaaccattcacttctgggcacctacatttaagtggggtatcagcattgccaacattgctgatttcgcaaaaccacctgagaagctttcttatcctcaacaaatagctgtcacagctactggaattgtctggtcgcgttaca

SEQ ID NO: 496 - DNA, 414 bp, Cicer arietinum
acaaaaaaagaacaacaaacacccaaaagctgccgcgaaacaagggtgattcagcgtctatcagaagccactgattcagcagagaagagatacttcactcgtgaaagaactgaatcatgcgcgggatcataagggtggtctttggatgggatttcaagtattgcaggaacaggcttgttataactatcaaccaaaaaccttatcatatttgcaacaaattggctaatcagcacaatagcaatatcctcccttgttgtgaattctttgaatgcatcctcgatttgtttgacagttgtttttgaatccacaatgaggtaatttgtcttcctacgtatgtcaacgtttcccactccagccaaaagaaacccaactatggtatcctcatctgcaatcatagcaataagtgatgaattg

SEQ ID NO: 497 - DNA, 407 bp, Cicer arietinum
actgtcaccagaaggatttaggccagtttcatcagaatgcatttcatttgaagcaacttctctgtccaaatgtaaattattttccccctcatatgcaacttcaccattcaaatcagattttacctgcaaggaactctcaccagcatgattaagaacagaacaagagacatctacgttttcattaccctctttggtattgttcccttgagacaaattcactaaaggaccagcttcaagaacctcaacatgggcatcatttatatcaaactctttgaaagacaaagcattatccgccacttgagaatccaacacagtgtttcggccaagccctggtgaatcacagttcatatcagtgaaagcatggggttttgggtcaggaacaggttcaaccaggtcttttgctgtac

SEQ ID NO: 498 - DNA, 291 bp, Cicer arietinum
acatttccaatcaaagcattgaaccaataatgccaaagtcatgctaattgttcgaagagccaaagcttctccaggacacactcttcttcccatcccaaatgcaatcaccttttcaatctccccttttttgtcaaacctctccggcttgaagcttgtggcctcactccatgatttaggatctctgtgaatggcccatgcattaatcaatactatggtgtctcttggtactttatatcctccaataatgcaatcatctgaagttgagtgtggtaataacaaaggagcgggagc

SEQ ID NO: 499 - DNA, 436 bp, Cicer arietinum
tgcagctcgtgattctgtcgttctgagtggtggactgagctggcaagtgcctactggacgccgagatggacacgtgtcacaagcttctgatgtagcaaataacttgcttagtcctactgattcacttgatgtccaaaaacaaaggtttgcatctaagggtctcaacactcaagatcttgtcactctagttggtaagtcatcaacttttcacaatatactattatttattataataatctttaaaaaaaactactattactcttaatttatttatgaaagacatttgagttataattttgtcaacaatcattgatctatctaatatattttgtagacaaaattaaggttggactttagtgctcttgacaaattaaactgatctaaaattttatactattattccaattccaaattcaattatacatgacttagtctc

SEQ ID NO: 500 - DNA, 362 bp, Cicer arietinum
acaacgcaaacggtgtttccacttgtcatcatctacctgggctgatgaatagcccgtgggcttactctgggcttaacaatcttcggagccttttccgcatacctaggaacttcggcccatccatcacatcctctccatttcaaatctcgcaacctcaccatttctttcccgtctcctccttcatcttcgtgttgtggctcgatttgatggaaaagatcatcttcatcgatctcgaaatcagagaagtaggaagcgtcgttatgattttggggatcttggaagcgttcacgaagccagtaatcacgaaaccaaggggatgattgaacgagggcccaccattcatcggagaaatcgtccaccgt

SEQ ID NO: 501 - DNA, 435 bp, Cicer arietinum
acttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgcctcgatagagttgaggttattgctgaaaacaaagataaatgggatatgcatcgttgctgttagctactagtatggtgattatcacagcttctttgagttgtcttgtaactttgttgttgtttatagtggataa

SEQ ID NO: 502 - DNA, 269 bp, Cicer arietinum
acaggatacccctcttccttcactgtccagcataccaaggcacaaaaggcgctgtttttgtcaagcccgtcacccgtcagcgggttcggtggcaatttgtcgaatttttccaccgaccagaattctctcacgcatcgctacatctgctgacgcagtccacaatctccagtaaccaagttgtagctcgtagtcgactgtcgtggcggcagggaaaaaccttgggaaggaatcagaggccggcggtgcggcttgccttcaaaggggaaaaa

SEQ ID NO: 503 - DNA, 356 bp, Cicer arietinum
taccgtgggcccgcccgaggtacaccttgtttactctaaatggaatatctcgcaagggttgatcaatgtctctatctccactttccaatttccaatcaaaggagttaatcattgatcctaacatagtatgcaacattctaattgcaagtggcatgccaggacatattcttctcccactaccaaatggtgtcagttgaaaattttgtcccttgaaattaatttcggaccccaaaaatctttcaggtgaaaacaaagttggattgacccaaatttttgggttccttcccatggcccattgattgactagaatttgtgcaccttgtggaatagtgtatccatgaattgtaacatttgtt

SEQ ID NO: 504 - DNA, 324 bp, Cicer arietinum
acttcggaacatctcaggcaacacgctagattgaacagtctccgcaatttcttcggtagatggccagatattcctcaggaagacattcttgccatccttccccgtcccaattggctccttctcaaagtcaatgtcaaccgtgccagcaagagcataagcaacaaccagaggaggtgaggcaagataattagctcttgtcaagggatgaacccggccctcaaaattacgattcccagacaacacggcagctgctacaatgtcattttctgagatggcagaagcaacagattcatccagatcccctgaattgccaatacatgttgt

SEQ ID NO: 505 - DNA, 250 bp, Cicer arietinum
acttggttctagcaccacatgatccaatgcaatcaagccttctcaattccacattggaggataagaatctatctgagattccaaactttaagctacttttgaagcagctggtcaccatggaagtcatccaatggacaaatctttgggatacatataagaatgagtttgagaatgagatggtctccggaaagtttttgagtgaaaaagcagcacaagatctgaaacaaagaattattgaacataatattct

SEQ ID NO: 506 - DNA, 200 bp, Cicer arietinum
acggaaccgctcctgaccggctgtatcccatatttgcaatttgattcgcttgccatcaagctcaatggtccttattttgaaatcaatgccgatggttgtgataaaactagttgtaaaagacccatcagagaaacgcaatagaagacaactcttacccacaccgttatcaccgataaggagaagtttaattaggtaatcgt

SEQ ID NO: 507 - DNA, 164 bp, Cicer arietinum
cgaattatggttttcagccaatttcagtgaagaagaatgaaggagaaacgatggaaaagttggagcaagttcaatgtttcggccgcaagaagaacgcggtggctgtcacctactgcaagcgcggccgtggtttgatcaagatcaacggtgcccccatcgagttg

SEQ ID NO: 508 - DNA, 294 bp, Cicer arietinum
ggttggagatggtgatgttgatggcatgatggctccaaagtcgctcactcggatcttcgtggttgtgctaatagatagtgtcaagtatgtgacttactcgtgtggccttcctcgtgcctctccattggtgactgcttatgtttgacaaccctccccattttgatacacaagcttatctaaccctatagttatagtttctttacaagggatgtgggggaactgagaaggaaagaaacgaggctcaagttttgtacataacaacatatatatttaaaatagcaggccttgttgtgt

SEQ ID NO: 509 - DNA, 312 bp, Cicer arietinum
tagcgtgggcacggccgaggtacatttccaatcaaagcattgaaccaataatgccaaagtcatgctaattgttcgaagagccaaagcttctccaggacacactcttcttcccatcccaaatgcaatcaccttttcaatctccccttttttgtcaaacctctccggcttgaagcttgtggcctcactccatgatttaggatctctgtgaatggcccatgcattaatcaatactatggtgtctcttggtactttatatcctccaataatgcaatcatctgaagttgagtgtggtaataacaaaggagcgggagc

SEQ ID NO: 510 - DNA, 407 bp, Cicer arietinum
acccatcacctccaccgccaccatacaaatatccatcaccaccacctccagtttacaagtataagtcccctcctccacctgtttattcaccacctccaccacattatgtttatgcttcacctcctcctccggtctattcccctcctccaccgcattacatctatgcatcacctcctcctccttaccattaatagagagtggtttaccatatcatccatggatttgaggaatatatcgaaaataaagcgaagatagtgcacatagggaatatgcattgtgcaattatacaaaggaaaaatagtggaagcaaagtttctgaagatgtatcgcacaattattaatttgtctcataaaaagaaaaaagtgtcactctttttctcttcgtgtgttttatttaggaataaatt

SEQ ID NO: 511 - DNA, 370 bp, Cicer arietinum
cagctgctgtgtctaaaactgctgctgctccaattgaacgaattaagcttttgatccagaaccaagatgagatgattaaagccggtagactttctgagccctacaagggaatcggtgactgttttaagcgaacaatggctgatgaaggtgttgttgccctatggagaggtaacaccgcaaatgtcatccgttatttcccgactcaggctttgaactttgcattcaaggactacttcaagaggctcttcaatttcaagaaggacaaggatggttactggaaatggtttgctggtaacttggcctcaggaggtgctgctggtgcatcatcccttttctttgtctactctcttgactatgctcgtacctcggc

SEQ ID NO: 512 - DNA, 387 bp, Cicer arietinum
ttggtcgaacaaagcaggtaatcttgcagccaaacagcgctttaaatcaggagaaacagcatgttcaccaatcatagtctccaacactgccgatgaaactgccttgttctcaataactgcatcctccttttctgggatacttgcatctttagagaaactaagccctaatactccatcaggtgattgcctataaaaaacagaggcaccaggtggaaaattcacattcttgaaggcttcagcaaatttttgcatagcttcaacttcttcatcgccataagttccaatagatttcaagtgtgccacacaattctccattaccttccttgagtactcaggaccactcagttcccgaatcttagaccctcgaattaacttttcaaatgggcc

SEQ ID NO: 513 - DNA, 343 bp, Cicer arietinum
accttagagatggtaagcgcagggctccactgttccttcaggatatcaagacgaatgctaccattgctattgatgttggggtgaaagaccttaatcctgaatgcaaccttaggaggcttgaaaggataatctggaggaaaatgaatagtgaccagaaatacacctccagcatatggactatcagccggacccataattgttgcttgtcaatggaacatgtcttcagcaaccggaccagcgctgcaagaagtaggtgggtctttctgcaaatccttcagctccttgagaatacgcttggaagccatggatggaacttcggagtttcagatcttagggtgaggct

SEQ ID NO: 514 - DNA, 454 bp, Cicer arietinum
gtttttgttggttagagtggtttcgctggtcttccaacttcctctgccaacatggttcttcagaatgatattgatttgttaaaccctccagctgagcttgagaagaggaagcacaagctcaaacgacttgttcagtcaccaaactctttcttcatggatgtaaaatgtcagggttgcttcaatataaccactgtctttagccactctcaaactgttgtcgtatgcggtaactgtcagactgtgctgtgccagccaactggtggacgagcaagactaacagagggatgctcttttaggaagaagggagattaaatggtgtgtaattttactttgtccatggatggagagtttttcttgtgaggcttaaaaatggaatcaatgttttttcatattttagtttccaatgtattaaattgtaagacttgatcccacaatctttttccaagaccttaat

SEQ ID NO: 515 - DNA, 441 bp, Cicer arietinum
acctcatttacatatctaaacaacccagcttatacgcaaattactcgaagttttgattcaaaaattaaactaagcaggcattcatcttctgcttctgacagtcttccatttgaatactgctatggaattagatcaaaccagactgttgaagttccaattattaatctgacaatgaaaggtggagacaattattttgtcatagacccaatagtattgattagtggtgggggtgctaacaatgttctttgtttgggtgtcttgaaaagcaacaatgtgaatatcattggacaaaacttcatgacaggttaccgtatagtctttgaccgcgaaatcaacatgctgggttggcaggaatctaactgttatggtgatgaaatcttcaatttaccggttaaccgatcaaacgctcacgccccggctgttgctcctgctatggctgca

SEQ ID NO: 516 - DNA, 311 bp, Cicer arietinum
acatacatatacatacccatacagaagaaaagtatttttttttacagaaaaaacaaaagaagcaaattatatattgtcttctccagcggttgattttggtttcttcactatcaaaacagggcacttcacattctgtgcgcagtgattgctcacgcttccaaggaaagccctcttgatgacaccatagccgtgacttcccatgaccaaaatatcaacacccaatttttgaaccgcatgacatatcacgtccctcggatcgccattctctatcttggtctccacattttggaggtctttacaaactctcttgg

SEQ ID NO: 517 - DNA, 322 bp, Cicer arietinum
ttcctgttttgaatggaaaattgaccggaatggcattccgtgtcccaactgttgatgtctcagttgttgaccttacagtgaagcttgagaaggccgctacctacgacgaaatcaaggctgctatcaaggaggagtctgagggcaagttgaaaggcattctcggatacactgaagatgatgtggtctccaccgacttcattggtgatactaggtcaagtatctttgatgccaaggctggaattgccttaaatgaccggtttgttaagcttgtctcatggtatgacaacgagttgggctacagtacctcggccggaccacgcta

SEQ ID NO: 518 - DNA, 152 bp, Cicer arietinum
acaaaatcattgaaaattttcctaactatacacaatctctctgtccataatcatctcactcagttgtttttctctctcactaactagattataatgaaaaaataagtgagtgccggcctatacaaatttgcctcaaataatctatgtcagct

SEQ ID NO: 519 - DNA, 408 bp, Cicer arietinum
gttgttagctggaaaatacatcttttacaactataccaccttaggttcctcttcttacggagaccattggcgtaacctacgtcgtataacagctattgatgttctctcaaacaatcgtcttaactccttcttaggagttcgaacagacgaaacaaatagacttatacaaaagcttctaaacgacactgtttctgatcaaggttttacaaaagtggaactaagacatagactaacggagatgacgtttaatggtatgatgatgatgatatctggaaaaaggtattatggagatgacagagacgtgacggatgttgaagaagcaaaacaatttagagatataataagtgagataatgtctttgttaggtgctaataagagtgaatttttgccttttttgaggttgtttga

SEQ ID NO: 520 - DNA, 405 bp, Cicer arietinum
actcattacctccaagaggcacctctctactcgtagccagctctacagtagttgtcggtgaagcacgtcccattggacatcaatacagctgatctcagcagagcttccctccagcaacgcttctatctagttcatccagcatatcatcggcacaaaggcgctttactttcaagaggtcatcccgtcagcgggaactattcctctccagcctagaattctcttgcactgatagatcaagtagctttccataccctgaggcaggaagtccatgatcccctaagatcgccagtagctgcaaccctagaactatgcatccttagggaaacccctcgcaggggaaaaacccaaggtggccagaacgctgctctgtagacgaggcaattgcccccttccacggtctccagg

SEQ ID NO: 521 - DNA, 214 bp, Cicer arietinum
acgatttatgctccttaattgctagctcaaaaaccctggctgcatcatataaagcttgcacaagtccatcataaaagttttcatcttcgagtgaactattcagtttcatcctcattttttcaaggttagcactagtgtcagcttgtggactcccattgacagtcataccatcatcagaggtggcaaatgggaacatgcgtagattccttaaggg

SEQ ID NO: 522 - DNA, 177 bp, Cicer arietinum
acatcgaaaacacactctgaatcggagtctcgaggatcggtcggataaggatcagaaggaacactgggagaagaactggaaggattttctggctcattagaagacttagaaggaacaagggatactttcttttgcttgctgtgaagatggttccttccttccacatttatcacatta

SEQ ID NO: 523 - DNA, 346 bp, Cicer arietinum
acatttctaaaaagaaagtttgacatacaagtattaacagttttcttgtccctgcagttcattaaggatgtttcaatcacatctcatcctaaacagcatctctcaccctaaaccgcattatctaattaattgtctataaggtccaaacaagaagaatgtgaaaacagcaagttttatgaagaaaaaaaccgttgttatgagtcttcaaaatgatgatctgtctcatcaaagatctcctcctgtaaaagctcttcaatgacatcttccattgtaattattccaacagcttcttcttcttcaggaatatttggaagggggctaccatctatctctaaaatatccgagt

SEQ ID NO: 524 - DNA, 409 bp, Cicer arietinum
actactgcttccaaatctctattcctagttgctggatttgttttattcttcattataacacattagaagttgcaaattattccaacaagttactcaacaacattaaccagttcatattcgataagggaaaggttattgtcttccttaacggtgcaatcagcgggttctgtgacttcgacacgaccccatttgtccacggcaagcctcattgatcctttaaacatgtcaattttagcgtttcgcaaaatgacagtagagccctctttcatcagatccacttgatcatttcgggcggtaaatataatcatccctgtctcatcacccaccaaagattcagcaattcgcatttgacgaggttgaggaccatcgggacgacccttctgcatcaccatcttcgaatcaaccacct

SEQ ID NO: 525 - DNA, 332 bp, Cicer arietinum
accaagccaaacacgaaccccttttctcggatcgcgtatttctgcagcccattttccccatggacgttgtcggattcctctgtagaggtttttcctctgttttttcaccggtttctctacttgctcactaactgtgggagtgtaggatcttttgagagtgggtgctggtggtggttgttgatcaccacctgtttgagaaaaatcgaaatctgagtctttctgttgaccgaaggaggaaggccagagttcagaggccgtgagacggcggcctccacggcgaggtatgaagtcagcgatgatagcaccgccacacatattatgttacgaggatg

SEQ ID NO: 526 - DNA, 341 bp, Cicer arietinum
actggctcaccgagcgcaccttcggcgagttctctcgcagcttcaacttccccactcgtgtcgaccaggacaacgtctctgccaagtttaaggacggtatcctgagcattgttgttcccaaggccaagaagcgcgagtctcgccgcatcaacgtcgagtaaacgcgacaacacaccacaacccggaatcttgacgactttattatccagctctcagatttcacgacaagtcaagatcagtaatgactcatctttacgactttagcattgcatggatcggtgttgggaagtttcttagcatgaaatagcattgtaggcctggcttggtcattcgctccttgt

SEQ ID NO: 527 - DNA, 488 bp, Cicer arietinum
aagcgagtcgcatgctcccttccgccatggcggaagcgggaattcgatttcgagcggccgcccgggcaggtacagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 528 - DNA, 192 bp, Cicer arietinum
cacgaaaccaaccttcgaagcctcccagaactctcattaaccgacatcaaaatgcctctcatcaacgccaagaaccccgttccccaggaccagcgattctaccagaacgcttacaagaaccacacccgtctttggaagattggccctcgcagccgcatcctcatgactccctacctcatccttctctggggt

SEQ ID NO: 529 - DNA, 322 bp, Cicer arietinum; identical to SEQ ID NO: 517

SEQ ID NO: 530 - DNA, 408 bp, Cicer arietinum
acttgggttctgttctctcaaaaggcaatatccccaagcgtatggaccatcaggtgcacttgaccatccacctgtcgtttcgtgagatgtttgtcccaagaaagccgcaatctctcttttcttagttgcagtatctccgttattacccaaatcagggaaatacttagcagctgcaatgaaagcttcgtaggtgtagaatcctttcccctcacaaccactatcgtctcgatgcttcagcatctggttgaaggtgtccctcgatatgatgctaccaacaccaccaccaccgcttccacattgactctggcaaccatcaccgcaatagtcactggttgaaccacaccaaccaaatttgctgcagcataatccaccggggcacaacgcaccaccagcttgttttccacattg

SEQ ID NO: 531 - DNA, 253 bp, Cicer arietinum
acaaggagcgaatgaccaagccaggcctacaatgctatttcatgctaagaaacttcccaacaccgatccatgcaaggcaaaagccataaagatgagtcattactgatcttttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtcct

SEQ ID NO: 532 - DNA, 335 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacgagtggggaagttgaagctgcgagagaactcgccgaaggtgcgctcggtga

SEQ ID NO: 533 - DNA, 313 bp, Cicer arietinum
acctctaccaagctaacctatgaatatgcagctccagaatacctagccaatggtaatcacactactaagagtgatgtctataattttggagttgttctactggaaatattatcaggaaggagagttattgacaagaatagaccacacaaacaacacaatttggtggaatgggctaggccttatctatccaacaagcgtaaggttttgcgcgtgttggataatcgccttgaaggccaatatgaattagatgatgcctacaaggttgccacactgtccgtaaggtgcatttcaatagaagcaaagttgagaccaa

SEQ ID NO: 534 - DNA, 408 bp, Cicer arietinum
actactgcttccaaatctctattcctagttgctggatttgttttattcttcattataacacattagaagttgcaaattattccaacaagttactcaacaacattaaccagttcatattcgataagggaaaggttattgtcttccttaacggtgcaatcagcgggttctgtgacttcgacacgaccccatttgtccacggcaagcctcattgatcctttaaacatgtcaattttagcgtttcgcaaaatgacagtagagccctctttcatcagatccacttgatcatttcgggcggtaaatataatcatccctgtctcatcacccaccaaagattcagcaattcgcatttgacgaggttgaggaccatcgggacgacccttctgcatcaccatcttcgaatcaaccacc

SEQ ID NO: 535 - DNA, 376 bp, Cicer arietinum
actgcgttcaagtgcatgctaaacggggctgttgattttctcattaaacctgttcggaggaatgagcttaggaacttgtggcagcatgtgtggagaaggcatactattagcaggccttctcaaaatataacatctccacagactaaacttgacgttgctccagaaagcaatgctccaagcaataattctagtggttctgtggcttccacgcaaaaaaataatgaatgcatcgaaaaaactagtgagactcaagatatgtcccagctaaagagttctttaagtttgagcaataccgacaaggtgaagcaggaaagttctatcaaatttgaaagggagtctgctgagtataacaatgaaactggagagaaatcaacta

SEQ ID NO: 536 - DNA, 313 bp, Cicer arietinum
acatcgtccctattcctatttcacacaggcccgaagccgcggtataacaaattcatcatgaaaaccccatcccgatcatggggagattaaaaaaccttggtcaagagaggatttactcaaaagggttggttcgggttccccaccaggtgaggaagacggagagaccgagggtctcaacgagcttggtagccaggctgacgccgacggtgtcgagaggtcgcttctcaacgaagatctgagcaatgtagccgggagcagaggtagcgaagaagatgagggatccgaggtaagcagcgcccttgtagctcagcgt

SEQ ID NO: 537 - DNA, 341 bp, Cicer arietinum
actggctcaccgagcgcaccttcggcgagttctctcgcagcttcaacttccccactcgtgtcgaccaggacaacgtctctgccaagtttaaggacggtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgtaggcctggcttggtcattcgctccttgt

SEQ ID NO: 538 - DNA, 437 bp, Cicer arietinum
gttgttagctggaaaatacatcttttacaactataccaccttaggttcctcttcttacggagaccattggcgtaacctacgtcgtataacagctattgatgttctctcaaacaatcgtcttaactccttcttaggagttcgaacagacgaaacaaatagacttatacaaaagcttctaaacgacactgtttctgatcaaggttttacaaaagtggaactaagacatagactaacggagatgacgtttaatggtatgatgatgatgatatctggaaaaaggtattatggagatgacagagacgtgacggatgttgaagaagcaaaacaatttagagatataataagtgagataatgtctttgttaggtgctaataagagtgaatttttgccttttttgaggttgtttgatcttgatgatttgacgaagaggtacctgc

SEQ ID NO: 539 - DNA, 341 bp, Cicer arietinum; identical to SEQ ID NO: 202

SEQ ID NO: 540 - DNA, 405 bp, Cicer arietinum
taccgtggtcccggccgaggtacaggataccccgcttccttcaccatccaccataccaaggcacaaaaggcgctgtattttctcgagcccgtcacccgtcaccgggttcgggggcatactgtcgactttttccaccgaccagaattctctcacgcatcgctacatctgctgacgcggaccacaatctccagtagccaagttgtatctcgtactcatatgtcgtggcggcagggaaaaaccttgggaaggaatcataggccggcggtgcggcttgccttcaaaggggaaaaacccatcgcaatcggcatccttgatcggaaagatgtcgctaccgatgccacgggacacgtcctccgatatctaaggcgttctggttctgaggtgccgccattagatacctgcccg

SEQ ID NO: 541 - DNA, 341 bp, Cicer arietinum; identical to SEQ ID NO: 202

SEQ ID NO: 542 - DNA, 436 bp, Cicer arietinum
aagacgaccagcgccttaggcaactaaattaaggcctgatcaaattccccatttaccttgtcattagcaggaatcctgcaatatacacctgatattccttcttggaacttttccagatcctcaaccaccatataatgaaagtggatgagacatagactacaatatcacacagaacgtctgtctatattcgccttacgtcgagcaaaacgttgccgcctcatcgatgcaaaagtatcgcgttagaaaaaacactaccgacgataagatagttgagaaatgcaacacagtgaccaaacagtcttgctccccaccaatgtggcattcctataacaacgcggacattccaaatgataattacctcgccctcgtcgtggacatggaccgttcgagtggctcggtgtggtttgtggaacgaacgactagagaatatctggat

SEQ ID NO: 543 - DNA, 433 bp, Cicer arietinum
acaagtctcttcaggatatcattgccattctgggtatggatgagttgtctgaggccgacaagcttactgtcgagcgtgcccgtaagatccagcgtttcctgagccagcctttcactgtcgcccaggttttcactggtatcgagggtaagctcgtcgaccttaaggagaccatcaactccttcaaggccatccttaacggtgagggtgacagccttcctgagggtgccttctacatggttggtgacttcgcctccgccaaggccaagggtgagaagattcttgctgagcttgagggtcagtaaggggtttaagtattgaagttaatgccgcgggagacgggaggagagaaataaaggacctgtgtatagagaagaggaacaaaggtcccgggaggtttctcataagctccaccaagtctcttttgtgagctgtg

SEQ ID NO: 544 - DNA, 291 bp, Cicer arietinum
tttctcccatgtctcgcgctctctctaaactctcccccaaatctttattctccaaatcgttctaactcactataactaagattactgctagcctatcgcctagagccaagcttcgaccgcgactgctcgtcacttttgggcgccttcttccatcactcgagaaagtcagcaccgtcaaagatctcttgattcctcgcggccgggtcggcttggaagcaagctacatgtcgcctatctcaacccgtttcttattattagtaagataggttgccccttgctctttgctccagt

SEQ ID NO: 545 - DNA, 305 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgtcgcggcggcagggaaaaacctcgggaagggatcagaggccggcggtgcggcttgccttcaaaggagaaaaacccatcgcaatcggcgtcgttgatcggaaggatgtc

SEQ ID NO: 546 - DNA, 403 bp, Cicer arietinum
acaacctctgacattcgtggcctaagttttgcggtttcttgaacacaaagtaaacccactttgaggaattttatggcttcttcttctaaatagtctgtattaagcacaggatctaccattcttaatagatcatttgcctcataagctgtccacgccttttctacaatgaaacgttcgatatctgtataggcatctacaaccgccaaaccactgataatttgtaaaagcaacactccaaagctataaacatctgattttcttcttagttgtccagaactagcatactctggagccaaataacccaatgtccctgcaactctagtgctaatgtaagatgtttcatctctcattaatttggccaaaccaaagtctgcaagtttaggagtaaaatttcgatcaataa

SEQ ID NO: 547 - DNA, 288 bp, Cicer arietinum
acatcacgaaatttttctcataaatgataatatcttcatagttcttacatattatttttaattattttgtgatgtcttctgcaagtatcttcaacgaactctgcgatctctgtcttcctgtcctatgcccatggatttctgggcagctgcaatgccttcgggatcaaagaattgagtgaaaatgcgcgtgaagaagttcaagttgcgagagacattgtaagccatgacgggtgggagaggtttcaccacggtgtcaatgctaaaaactctatgaagaaactgaaaatt

SEQ ID NO: 548 - DNA, 184 bp, Cicer arietinum
actgcaacggatgcatttgagaaaaaccgctcacaagacctaatcttcttagatttcactggataaggctcttcctgattaatgttccatagatatacattagagtcctcgccagccgataaaatatgtttcccgtccgaagtaaacgatgcacaccttgggcttcctgtgtaaagacttttgt

SEQ ID NO: 549 - DNA, 364 bp, Cicer arietinum
cgaaaatcattcaccggaattcctcattcagaaaatggctttaggtggaggaggtccccaaagaggaagtgcagcagctaccgcaagcatgaggagaaggaaaacagcaggtggtggggcatctggcggagcagctggaactatgcttcaattttacactgatgatgcccctggactcaaaatctcccctaatgtggttcttgtaatgagcattggctttattgcttttgttgctgtccttcatgtgatgggaaagctttattttgttcgcagggaggcttaagggatataagtcaagaagttgggtttataacacttactctgttaatgaacttagatttctgttgctagacccacataaccc

SEQ ID NO: 550 - DNA, 338 bp, Cicer arietinum
cgccaagagaacagaatctagtagaatgggctagaccagtgttaaacgatccacgaaaacttagtagaataatggatccaaggcttgaaggacagtattcagagatgggggcaagaaaagcagctgcattagcctatcaatgcttaagtcacaggccaaggaatagacctacaatgtctaatgtggttaacactcttgagcctctacaagattttgatgatattccaattggaccctttgtttacacggttccaaatgatgttaacaatgaggttcaaaaagagtgtgttattgagacaccaaaagagagaagaagggaaagtagtgggagtagtagt

SEQ ID NO: 551 - DNA, 382 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcatggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaa

SEQ ID NO: 552 - DNA, 431 bp, Cicer arietinum
cgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccc

SEQ ID NO: 553 - DNA, 387 bp, Cicer arietinum
acatcttggaggatgaccttgataagcgtgagccgcagaggaacgcgtatggaaaggcctacaccctgaaaatgaaggatgatggctttgagaagcgagaccctcagaatacttatggcaaggcctataccctgaagatgaaggacgatggtttcgagaagcgtgagcctcagaggaacacgtatggaaaggcctatactctgaagatgaaagatgatggctttgaaaagcgagaccctcagaatacatatggcaaggcttacactttaaagatggaggatgacggctttgagaagcgtgaggctgaaagtcgggcttgaatgtttgtccatattataaatatctaggccatagacacgtgcaatgttggtttcatctaaaaaaaaa

SEQ ID NO: 554 - DNA, 459 bp, Cicer arietinum
acacgaagcagttgtggacccatcaaaggagcccttcgagagggcaaatggagaggcagcttatgattactaccttaaaaaaccagaaatgaacgagttaatgttgaaggccatgtcgggtgtgtcagtgcccttcatgaaggccttgttggcgagctacaatggtttccaaggtgtggaaaagttagtggatgttggtggtagtggtggagattgtcttcgtatgatcttacataaatacccctctattaaagaggcgataaactttgatcttcctcaagtggttgccaaagcaccacaaattccaggtgtaactcatgtgggtggtgacatgttcaaatatgttccccaaggagatgcaatctttatgaagtgggtgctaataacgtggacagacaaagaaatcaagcacataatgcaaaactgttacaaggcactaccagctggtggaaaactaat

SEQ ID NO: 555 - DNA, 188 bp, Cicer arietinum; identical to SEQ ID NO: 24

SEQ ID NO: 556 - DNA, 406 bp, Cicer arietinum
aataatacaatttttcttactttccccaccatgtattattccgcgtggtccaagatcgcccttgcgggtctttttgcttcggccgctgctcagacctacagcgagtgcaaccctatgaagaagacatgcgatcccaacaaaggtcttgcttcttcatcatactcggtcgacttcacgaaaggtgctgatgacgacaattgggagggaaccggccatggcactgttaagtatacttctgatggtgctgagttcactgtcgctaagcagggtgagtcacctactattcagagcaagtggtacatgtttttcggtcgcatggaggttcacttgaaggctgcgcccggaactggtatcgtttcatctgtcgttcttctttctgatgttctcgacgaggttgattgggagt

SEQ ID NO: 557 - DNA, 434 bp, Cicer arietinum
tttcattagcgtgggcgaagccgaggtactcataccatacttagtaaccattttcctggccatactagttgcctgtgaaagatctgaggatgcaccagaagtaacttcattatctccaaaaattagctcttcagcaaccttacctcccatacaaacatcaagactcgcaagcaactctttacgggagacactgttctgatctttgtctggcaactgagaaaccatgccaagagccgccccacgaggaactatagtcgccttgtgaataggaagcgcaccatcagaataaattgccactaacgcatggccaccctcatggaaagcggtcatcttttttgactcatcagatagaacagctgacttgcgttcacttcccattgtaatcttgtccattgcaaactcaaaatcatgcatgttcacggctttggcaccat

SEQ ID NO: 558 - DNA, 392 bp, Cicer arietinum
gttgttagctggaaaatacatcttttacaactataccaccttaggttcctcttcttacggagaccattggcgtaacctacgtcgtataacagctattgatgttctctcaaacaatcgtcttaactccttcttaggagttcgaacagacgaaacaaatagacttatacaaaagcttctaaacgacactgtttctgatcaaggttttacaaaagtggaactaagacatagactaacggagatgacgtttaatggtatgatgatgatgatatctggaaaaaggtattatggagatgacagagacgtgacggatgttgaagaagcaaaacaatttagagatataataagtgagataatgtctttgttaggtgctaataagagtgaatttttgcctt

SEQ ID NO: 559 - DNA, 436 bp, Cicer arietinum
acttggaggatgttcttgcacacaaacaggccattccattcaggcgtttctgtcgtggtgttgggaggacagctcaggccaagaatagacactctaatggacaaggaaggtggcctgccaaatctgccaagttcattctagatttgctcaagaacgcagagagtaatgctgaagtgaaaggtttggatattgatgctctttacgtttctcatatccaagttaatcaagcacagaagcaaagacgtcgaacatacagagcccatggaagaattaacccttacatgtcatctccatgccacatagagttggtattatctgaaaaggaagaggcgatcaagaaagagcctgagactcagttggcaccaagcaagaagaaggcttaagctcttcatgcctgcgcatgttaattttaaatccattatttgtatcagatatt

SEQ ID NO: 560 - DNA, 390 bp, Cicer arietinum
gatatattctggctacgatggtgaaccgatgcgactataaacacttgactgtacaatactatagacttgtttacggccatctttacgtcaaaatttgtcacgcggcacggtgtttatcgggattcaatttttctgggctttcatttcttgtttgggtttatacccttgggggtttggtgttaaaaggcacggtttcacctcacacttgtgaggttcggtgcggcgttgtatgttttccgactgccgacgggatatgggaatacttgtacaaagctccccagctcgacgccacgacaggacaggatagggcagggcaacgtggtgatttggagattgcatgatacaaagaagatggatgtggaatgacaaccacgagcacgatcatggcac

SEQ ID NO: 561 - DNA, 259 bp, Cicer arietinum
actgaatctggcttcaaagtcacttcacagcttaatgctattgacccaaatgcaacaaagtgcttttacttcacaattttgtatgctactgctattgttaacaaatttggtcctacagatgttggaacagctggttgtatacttggtttgccactttcaacaaaagggtcatcaaataaagatcaaattttgaaacttgtttttgggttattaggtgcttttgttggtgttgttttagcttttgtgcttatagttatgt

SEQ ID NO: 562 - DNA, 228 bp, Cicer arietinum
acaacgtcatcgtctctaattacacccacaattcagcattggtgccttcagatgatcaatagcgctcatagacaacagtgccactgtttcgtgggctgtggctgtaggaccgtctagagacactggtgtagcttgctcggggagagcgtgagtgatggtggtgatggtggtggtggtgatgatgacctgtgtatcgtctagaaggcgtaatctcttcgtgatagtagt

SEQ ID NO: 563 - DNA, 309 bp, Cicer arietinum
acggtcctaggttgcagctactggcgatcttaggggatcatggacttcctgcctcagggtatggaaagctacttgatctatcagtgcaagagaattctaggctggagaggaatagttcccgctgacgggatgacctcttgaaagtaaagcgcctttgtgccgatgatatgctggatgaactagatagaagcgttgctggagggaagctctgctgagatcagctgtattgatgtccaatgggacgtgcttcaccgacaactactgtagagctggctacgagtagagaggtgcctcttggaggtaatgagt

SEQ ID NO: 564 - DNA, 415 bp, Cicer arietinum
acagagcttacctggagaccgtggaacgaggcgactacctcgtccacagagcagcgttctaaccgccttgggtttttccctgcgaggggtttccccaaggatgtatggtcctaggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctacgggtagagaggtgcctcttgggggtaatgagt

SEQ ID NO: 565 - DNA, 377 bp, Cicer arietinum
acttcgaagataatgctggtgttattgtcaatccaaagggtgaaatgaaaggttctgctattactggtcctattggtaaggaatgtgctgatctatggccaaggattgcaagtgcagccaatgcaattgtatgagtggggcgtttcttgttccatgagcttatgtttctgcatgtaggatttatgtttatcttagattttgtttttgcttaactttgttaccaattatctttttgaagagatgttattgttttcttaacaatagagatgacaagttgtttggtgattttttccggtttctgaaaccattttagctattatgatataatttttacattagttaatgcgaattattggttttgcgataattcattattg

SEQ ID NO: 566 - DNA, 346 bp, Cicer arietinum
acagagcttacctggagaccgtggaacgaggcgactacctcgtccacagagcagcgttctaaccgccttgggtttttccctgcgaggggtttccccaaggatgtatggtcctaggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactaaatgggagacgctgctggagggaagctctgcgaggatcaactgtattgatgtccaatgg

SEQ ID NO: 567 - DNA, 248 bp, Cicer arietinum
actgccgcccccgatcagaaggtgctcggcgccatggagcgagtgctcaatgtcaagttgcgaggcagcgacattggcgctcccaagttccccaacaagaagaaatgagcaattgcgtccaatgcttagacaaaagaaattgtgagagggcttcagagccgagtcgagcgttagcgaatgatgatgacatcttggttgggaaattcgggagtttcgtgtgggccgtcatgatgctttatgacatgggt

SEQ ID NO: 568 - DNA, 413 bp, Cicer arietinum
cagtgctgctgctgcaatggatgctaaagctgttcaaacgttgaatccctcgggttcaatccgacccgaaaagtttgggataagacccgctttttcattgagtcggcccggaaatattcggtttattcggcgcaggattgctcctatggaggtttcctgttcttataacaacattccagcttcgatattgaaatctgaagggcgcaatgttccccttgaggaagagttgattctgaagaataggtcgcaacagatccagccttatttaaatggacgctgtatatatgttgttggaatgatgggctctgggaagacaactgtggggaagattatatcgcaagtgcttagctattcattttgtgattgtgatacattggtggaggaagaggttggtgcaaactccgtagctgata

SEQ ID NO: 569 - DNA, 443 bp, Cicer arietinum
acgacatcggctgggcgcccggggctgaccccatccaagactctccctgtgttatcatgatggagtttgacaaatacaacggaccggtgttcctgaccacccccgatggcaagaagattgtcccgattctctcagttgagagggacttcctcatcggagccactttctgcgctcgcacgcagtttcccctgatcgtatgctacgccattaccgtgcacaagtcacaaagcatcacagaagatatgatcgttacggatctctcctgccaggactttcagactggtttaagctacgtggctgtctctcgcgtggaaacgctcgagggcttgatgttggaggctccatttgatcgtaatcacctggtctacgggtctcccccggatggcatgaagatgaagatgagggatcaggagcttaggaaacgacaggtgctcacacagaat

SEQ ID NO: 570 - DNA, 280 bp, Cicer arietinum
ccgctgttagcgctctgctagggtagagaatttttgcaggctaaaatggcagcaaaagcagctgtggggctaacgggaccctaacagctgcctgaagaaagggattcagagagttgacctttcttcgtgacatgtgtctccaacgacactgagctccgcgagctctcgacatcgccttcgggcaccatttcctatgtgacatctgcggcttcttctcacctcgacattacggcttcgcgagcctttgacattctgggctctgcgcccctcgacttcccgt

SEQ ID NO: 571 - DNA, 254 bp, Cicer arietinum
acagagcttacctggagaccgcggaaggacgcgaccggcttctcccgcaaagcagcgttctggccgccttgggtttttctcctgcgagggttttccccaaggatgcacgactctagggttgcagctactggcgatcttaggggatcatggacttcctgcctcggggtatggaaagctacttgatctatctgtgcaagagaattctaggctggagaggaatagttcccgctgacgggatgacctcttgaaagtaa

SEQ ID NO: 572 - DNA, 435 bp, Cicer arietinum
gattcatccaatgctggttttagaaaacattctaattatagagtagtgtatcttaggcgctatgattctatttttgttgcattgaggaaaattggtctggaaaataacttggtggattcttcaccaaagaggaggctctgtcagtttgctacagtggccaagaaagctgctttaaagggtcttgaagatgcactccttgagccaccaaggctggctttttccaaatcaaacaagaacttcaagatcaagtacctgcctgagttgttgggcgattctcttgaaggttacaagcgaagaatcttcattggtgcgggtttgcacgaggaaaacaaagctgcaattgaatggtttgagagaaactacccaaagaagggtacaaagtttcaaattaacaatctactggttgggccagaagagtcggatgtgccccgaacc

SEQ ID NO: 573 - DNA, 280 bp, Cicer arietinum
acgggaagtcgaggggcgcagagcccagaatgtcaaaggctcgcgaagccgtaatgtcgaggtgagaagaagccgcagatgtcacataggaaatggtgcccgaaggcgatgtcgagagctcgcggagctcagtgtcgttggagacacatgtcacgaagaaaggtcaactctctgaatccctttcttcaggcagctgttagggtcccgttagccccacagctgcttttgctgccattttagcctgcaaaaattctctaccctagcagagcgctaacagcgg

SEQ ID NO: 574 - DNA, 290 bp, Cicer arietinum
gcaacgaccacgaaccattacgaagcacgactccgaaacgatcgatcaactaatacctttgaaaattcaagaaaacatcactaaattgtcataatggagttcggtaacgctggagtattgaacgaggatggtatccatgttgatatggatcgcctgaagaagggagaggtcaacctgggaacctcgattatggcggttactttcaaggacggtgtcattcttggtgcggattcgcgaacaacgaccggtgcctatatcgcaaaccgagtgacagacaagttgacgagagt

SEQ ID NO: 575 - DNA, 362 bp, Cicer arietinum
acaccgtgtatgctactgccgttgacccaaagaagggtaatattggaattattgcaccaattgcaattggtttcattgttggtgctaacattttggttggaggagccttcaccggagcatccatgaacccagccgtgtcattcggcccagctgttgtaagctggagctggtccaaccactggatctactgggctgggccacttatcggtggtgggcttgctgggcttatctacgaggtcgtcttcattagccacacccacgagcaactccctaccactgactactagatgggaaatgaaattgtgtattttattgaatttctctgatttcttcttttgtgcatgttttttctttccttgtgt

SEQ ID NO: 576 - DNA, 278 bp, Cicer arietinum
ccgggcaggtacgagaggctacttctgacctgcaagccaacctacgacagttgaagtttgaggttcccaccgacggccaggatgtgatctccaagagatacgaggagattcaacagaagatgacagacaagtttgcggctgtcatggacgagtaatgtaatactaatgttgcactactggttgtttctgtgttgaagctatagataggtcatactgggggataggtcagaagatgaccggtattcgattactgtttgcgccgccccatagtctagtgt

SEQ ID NO: 577 - DNA, 438 bp, Cicer arietinum
agaaactccatttcttttctctttgttacaaggagaagagatccgctttcatccaatatcgctctcttcctcaagaatacttgaaaatggggctgtcattcacgaaactatttagtcggctatttgccaagaaagagatgcgtattcttatggtaggtctcgatgcggccggtaagaccaccattctttacaagctcaagcttggagagatcgtcactaccattcctacaatcgggttcaatgtggaaacagtggaatataagaacatcagcttcactgtctgggatgtcgggggtcaggacaagattcgtcctctatggagacattacttccaaaatacacaaggacttatttttgtggttgatagcaatgacagggatcgtgttgttgaagctagagatgagctgcataggatgttgaatgaggatgaattgagag

SEQ ID NO: 578 - DNA, 377 bp, Cicer arietinum
caataatgaattatcgcaaaaccaataattcgcattaactaatgtaaaaattatatcataatagctaaaatggtttcagaaaccggaaaaaatcaccaaacaacttgtcatctctattgttaagaaaacaataacatctcttcaaaaagataattggtaacaaagttaagcaaaaacaaaatctaagataaacataaatcctacatgcagaaacataagctcatggaacaagaaacgccccactcatacaattgcattggctgcacttgcaatccttggccatagatcagcacattccttaccaataggaccagtaatagcagaacctttcatttcaccctttggattgacaataacaccagcattatcttcgaagt

SEQ ID NO: 579 - DNA, 367 bp, Cicer arietinum
actaccttgatccagaattccaagatcttggtaaggaagccaattaaaggacaagaaaacgttgtggtggaagatgactcatttcaaaaggacaccgcacactcgaataattctccaaaattgttccatcatgtcaatcattgagctatatccttatcgatttacagtgaagacttacttggcaaggcaatagatggctttttgagaggtggattcattaataattattttgattattttattcaacgagatggatatatgatatggaaaattaatgaaacaaacactgaaaactcttacttcgctcagttttacaacattggatatggtgtcaatgctacaacaagaattaaatggacgaacgatg

SEQ ID NO: 580 - DNA, 437 bp, Cicer arietinum
actattaattaacagcagaacagactgctttacaactgtcaaaataaataaaaagctaaaatacataacagcttaaagaaattagagaaaaaaaaacacaataacaatcttatcaccatataatagaaaaattaacgccttttctttcctgaagacaaaacgcggaaactttgcttcccttttttctctttcgatgtatcttccttccatcactttctttattttcatatattcttcataatctttcatagagagctatggtaataaaccactattattgtttactatctaatagtggtaaggaggaggaggtgaggaatagaggtaaggcttcttggttggagttggtggtggagagtggtaaactggatgtggaatgtatgggggagaagtatgaactggtggtggaggtgagtgataaactgggtgtggaatgt

SEQ ID NO: 581 - DNA, 291 bp, Cicer arietinum
actggagcaaagagcaaggggcaacctatcttactaataataagaaacgggttgagataggcgacatgtagcttgcttccaagccgacccggccgcgaggaatcaagagatctttgacggtgctgactttctcgagtgatggaagaaggcgcccaaaagtgacgagcagtcgcggtcgaagcttggctctaggcgataggctagcagtaatcttagttatagtgagttagaacgatttggagaataaagatttgggggagagtttagagagagcgcgagacatgggagaaa

SEQ ID NO: 582 - DNA, 395 bp, Cicer arietinum
aaaaaaagaaaagaaaagaagaatgtttggaattggaggaacaaccacagccacgacatgcacaggcacatcagtgagatgtcaacctctccttccatttcgccgtcgccgccaaactgtaatactcagtttcaagaacaacaacaacaacaaacaaaacgatatggatagggttttcaaacaagcgtggcaaactgctaacgataattttgagcgttttctcttcgaagctaagaaaactgccgaacgtatcgaccgtcgttattccgtcaaacaccgtctctcttccgttgcttctgccgccgccgaccgtgctcgtgaatttggtcgtgatttcgaaattggtattaaataccgtaatttcacctccgattttgcgttaaactggcctaagt

SEQ ID NO: 583 - DNA, 435 bp, Cicer arietinum
gcttaaaactggtgaagaagcatggcctggagatttcacagccgggtttagaacctaataaaggtttgacatggcaaatgacaaaaagaagaggagataaagaagttcacaaagtgacggaggagaaaccaggatggtgttctgaccctcatttacctccttgtgccgcgtttgttgagattatggctccagtcttctcacgagaagcttggcgctgtgtgtggcatatgattcagaatgacttggtccatgggtggggtcttgattttgctgttagaagatgtgctgagcctgcgcatgagaagattggagtagttgatgctcaatggattgtccaccaaggtgtccccacactagggaatcagggtgtaacagaaactgggaaagcaccatggcaaggggtaagggagagatgtaggaaggagtggactatgt

SEQ ID NO: 584 - DNA, 455 bp, Cicer arietinum
acccggatttttggggaaaaacggtgtggccacaagtgatttgagacggatactacgacttgatttggaatgattaattgatttcgtttgttaggtgttttgattactttcttccgaagtagacgatgaaaattggtggttgtttgtctgtttgttcgtatggtccctaacgtgcatcctttattttttcaagaggatttgccgtagggtgcgaacgcatgaagaagcgttgaaagttgaaagtcaagtgaaggtttgttgtttcagtgttcagttcgtgatagaagaaataatcaagttaggttttgtggttagttcatacgttgatgaccgaagggatgtaacttttgtaatttcctctagtctgatatacgtgaatctatagtgtttggatttagagtatttctttgtgtagtgtgtgtgatttttttccatatggaagaattaagtacctc

SEQ ID NO: 585 - DNA, 243 bp, Cicer arietinum
actagaagaagatgttggagatgttgctgaagattgtggagatacagctccagcaggagcagaagcaggtgcttcagtcaatccacaattagtagcagaaggagcagagactttgcatgcagctggaagagaagtagctttggtgacattcaagacaacaccaaactgagcactgcttttaaatgcttcacatagacaagctggggcagttttgagaacagatttcaaaccagaacaacaagt

SEQ ID NO: 586 - DNA, 432 bp, Cicer arietinum
aaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaa

SEQ ID NO: 587 - DNA, 280 bp, Cicer arietinum; identical to SEQ ID NO: 573

SEQ ID NO: 588 - DNA, 280 bp, Cicer arietinum
acgggaagtcgaggggcgcagagcccagaatgtcaaaggctcgcgaagccgtaatgtcgaggtgagaagaagccgcagatgtcacataggaaatggtgcccgaaggcgatgtcgagagctcgcggagctcagtgtcgttggagacacatgtcacgaagaaaggtcaactctctgaatccctttcttcaggcagctgttagggtcccgttagccccacagctgcttttgctgccattttagcctgcaaaaattctctaccctagcagagcgctaaccgcgg

SEQ ID NO: 589 - DNA, 171 bp, Cicer arietinum
gcgccgttctctttgcaaccctaaggtaggcagtccctcttgttttgttggcttagttttagagaactgtgaacttccatgtgccaatcatggccacgtcatacttggagatccttcgccaattcttttctatcctataagtagttcagaaattcgttgtctggttgatgt

SEQ ID NO: 590 - DNA, 453 bp, Cicer arietinum
accagagtttctaaccccgaggctacctactaggttccatcatttctcctttccgatcgttctcctccgcggacccacgctactacgaccccggagcttttcagcactgtctcaattcaacatacctacctaatacgtttgtcccaggagaataaacgaatactacagccaaaatgtcgccaaccgaggagaagagtgacgatatcgatttcggtgacaacatcgatatgactactttcgagcagatcctcgaaatggacgagccaggcgattgtgaattcagctcttctattgtatttggcttcttcgagcaagcggaagaaacgtttgaacagataaaggaggcattggaagaggaagatcttgataagctctcgtctcttggacacttcctcaagggctcatcagcgaccctcggactcatcaaaatcagggatggttgcgaaaagattc

SEQ ID NO: 591 - DNA, 435 bp, Cicer arietinum
aaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtc

SEQ ID NO: 592 - DNA, 574 bp, Cicer arietinum
aaaaaagaagaaggaaacctcgattttactttgaaaatgagacctgctgtagccgctcttattttcctcttccttttcttgtttgcagctacaatagaatcgagaaatgatctaaaggagtattggaaaactattatgaaagatgaagagatgccagtgggaattgaagggcttcttcaactgaaacctgagatagaacctgtgaagaaccacaagatcaaagaagaacatgctaaaggtaaatgtgatcagcatcccataacaaacaccttaagatttcgagcggccgcccgggcaggtaaaaaagaagaaggaaacctcgattttactttgaaaatgagacctgctgtagccgctcttattttcctcttccttttcttgtttgcagctacaatagaatcgagaaatgatctaaaggagtattggaaaactattatgaaagatgaagagatgccagtgggaattgaagggcttcttcaactgaaacctgagatagaacctgtgaagaaccacaagatcaaagaagaacatgctaaaggtaaatgtgatcagcatcccataacaaacaccttaa

SEQ ID NO: 593 - DNA, 431 bp, Cicer arietinum
acgcatactgcccagagaacctcttcttctttgcagcctcggctgccgcccggaacacgaccgggcttcgacaatatgtctcactggctaagaccactagacaaaaccgctgggtcgaaatggtatagagcttacctggagaccgtggaatgaggcgactacctcgtccacagagcagcgttctagtcgccttggggttttctcctgcgagggttttccccaaggatgcacggttctagggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggacactgctggag

SEQ ID NO: 594 - DNA, 437 bp, Cicer arietinum
acgttattcaatctacattccagataagggggatgcatacattgattcgtgacagagaaatatcaaagcatgattttgtattttattctgatcgacttatacgcctggttgttgagcatggtttaggtcatctgccttttactgaaaaacaagttgttactccaacaggatctgtctatactggtgttgatttctgcaagaaattatgtggtgtttcaattattcgaagtggtgagagcatggaaaatgcacttcgtgcatgttgtaaaggcattaaaattggaaaaattctgattcaccgggatggagacaatggaaaacagcttatatatgagaagcttcccaaggatatctcagaacgtcatgtcttgcttctcgaccctgtcctcgctacaggtaactcagccaaccaagcaattgaattactcattcaaaaa

SEQ ID NO: 595 - DNA, 184 bp, Cicer arietinum
acaaaagtctttacacaggaagcccaaggtgtgcatcgtttacttcggacgggaaacatattttatcggctggcgaggactctaatgtatatctatggaacattaatcaggaagagccttatccagtgaaatctaagaagattaggtcttgtgagcggtttttctcaaatgcatccgttgcagt

SEQ ID NO: 596 - DNA, 184 bp, Cicer arietinum; identical to SEQ ID NO: 595

SEQ ID NO: 597 - DNA, 240 bp, Cicer arietinum
acacagggccagcgagaccaacagaaaaagtagcggaaggtctggcatgaaccagaacaagcctgaaagcagaactattgttgttgaaaaagtgatccagagtccatttcagagcgtatgcactgtgctcactctcatcgattgcaaccaacatcactggttgtggcttctctgactcatctgaattttttgaactcgccattccaaaaacccaattactctcttttctcttacctgccc

SEQ ID NO: 598 - DNA, 321 bp, Cicer arietinum
ttcttggcacgcactgttagtgcactgttaggagcgggattttctacgggctactcggccacacaatactgcggggacgccatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtctttccct

SEQ ID NO: 599 - DNA, 372 bp, Cicer arietinum
ggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgacaatagattgcccccgaacccgctgacgggtgacgggcttgagaaatacagcaccttttgtgccattggtatgctggatggtgaaggaagcggggtttcctgt

SEQ ID NO: 600 - DNA, 235 bp, Cicer arietinum
acctgcccttacaagggactgcctgccttcaaaatgggcgagaaggttacactgtccagtaatttccttgctgcacacatatgatagataatgttgtaatgtttgtcattggaatggtataataaaatttctatatagtatgggattgtatcggttatgttaccatttctttgagatatgtcatttgatacagtttaaagcatgactctgatatatgtgtgatttgatacagttt

SEQ ID NO: 601 - DNA, 223 bp, Cicer arietinum
gattccatgagacaacatttaactccatcatgaagtgtgatgtcgacattaggaaggatctgtatggtaacattgtcttgagtggtggttctactatgttccccggaattgctgatagaatgagcaaagagattacagcattggcacccagcagcatgaaaatcaaggttgtagcaccaccagataggaaatacagtgtctggattggaggctccattttggc

SEQ ID NO: 602 - DNA, 405 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggtttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaac

SEQ ID NO: 603 - DNA, 439 bp, Cicer arietinum
ctacttcccctgcatcatctatctctatggctagtgaaactgttttggttgatgaaatcccttacccttccaagatcactactaccaagcctctatctctccttggtcatgggattaccgacatggaaatccattttctgcaagtaaaattctattcaattggggtttatttggaccctgaagtagtaggtcacttgcaacaatggaaaggtaaacctgccaaggagttggaaaataatgatgacttctttgatgctctcatatctgctcctgtggagaaggtaattagacttgtggtgattaaagagattaagggttctcagtatggtgttcagattgagactgctgttagggacagattggcagctgatgacaaatatgaggaggaagaagaagaagctttggaaaaagttgtggaatttttccagtctaagtacct

SEQ ID NO: 604 - DNA, 329 bp, Cicer arietinum
acgataaatgagagaactacggttagttcaggtcatagatttcctgttccagttaatccaatgcatccaccacctcttcctggattacatggaagacaacattgtaggagctcttcagatgatgacactccatcaccttagctatatcacccatgtaagtcacttattggctttccaaaaaaaaacctggaaccagttgattttgacatggtctggccataattgttcttttcagaatgtaaaagatttctgtttatgtagattatatagagaaaaagagagagtaggagattttctttggagaaatatatactatgagtaggatatgt

SEQ ID NO: 605 - DNA, 413 bp, Cicer arietinum
ttcttggcacgcactgttagtgcactgttaggagcgggattttctacgggctactcggccacacaatactgcggggacgccatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggt

SEQ ID NO: 606 - DNA, 380 bp, Cicer arietinum
agacaaccttgctatggaggggaagtatagggaagcactgggtaaatgggaaactgctattacattggcacctgatgttgcagttttgcatgaacaaaaggcccaagttttactagaaattggagatgcttggaattccttaaaggctgcaactcgagctactgaattgaaaccatcgtgggctgaggcatgggtcacacttggccgagcacagctgaattatggtgagccagataatgctattgaaagttttgacagagctttagctctcaagcctgattatgaggaagcacaagatgatagaaaaactgcattacggcttgtaaagaagagaaagcaacttcaatcatcaggcttgagtgccatccaaaatcgttata

SEQ ID NO: 607 - DNA, 417 bp, Cicer arietinum
gtttctacggcaacgtggcttcgctaccttgtttccaaaactcaattcaccctcgccaccggcttcaagaactataaaggaggtcatctcaaagacaatgagctatcagattttatctggaagcacttccttcatggaaaaatgaccttcttgcactggaataaaggagaggagatggcccctactattgctggaaatggagcaactcttcttgttcggagaataccaattccagacccaacacatgtttatgtaggagatgttgtggtcttgaagaaccctgaaaagccagatgactacctagtcagaagattagctgcgactgaaggttatgaaatggcttctactgatgaaaaggatgaaccatttgttcttgagaaagatcaatgttgggtagtggctgaaaatgaaaaattg

SEQ ID NO: 608 - DNA, 171 bp, Cicer arietinum; identical to SEQ ID NO: 589

SEQ ID NO: 609 - DNA, 286 bp, Cicer arietinum
acaggcgacaaaaattctcacgaaaacgtttatctaaatggaaattataaaaagatctagatagtccatcacttgggctgcaaacacaaagcttttcactcatcatcctcatcctcatcctcgtcatcaacagcagcgttaagtgcttgcaaacgtgcaatcaacttagctttcctctcctcataggtaagcttcttcagattaaacctcttgtgctctttacgggggggcttctctgatttcttaatagaaggatcagcacgaatggcagcatgaaccttcttgt

SEQ ID NO: 610 - DNA, 414 bp, Cicer arietinum
ttcttggcacgcactgttagtgcactgttaggagcgggattttctacgggctactcggccacacaatactgcggggacgccatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtc

SEQ ID NO: 611 - DNA, 434 bp, Cicer arietinum
acaagaacaccatggatgctgcccgccagatcgtcgccaaggagggtgttaagtctctcttcaagggtgctggtgccaacattctccgtggtgttgccggtgctggtgtcctctccatctacgatcagctccaggtcctcctcttcggcaaggccttcaaataagcgctttgtataacataccctgtatagacgagtgtgtgggggataaggaattcggggggatcttaatctgcgggcttgacatggtgtccgctggttgaaactaaaaggcgagatcgaagtgcaggttgagggaagttgtcacagatacccgacgtggtcctctgaaacagcagctctttgcgggttagagtggcataggcacggcgtctttttctaatcttgctttgccttccgttctaggccgctgtaatttatacaccaatgcaattt

SEQ ID NO: 612 - DNA, 213 bp, Cicer arietinum
acacgtgtcattgtcgtttactgtttcggaagaagttgttgttgtttcttttgtgtcatggaaatgaccttcaccccatgttaagaagatgttatctctttcgtcttttgttgtttgccaaaatatggcgtagacccaatggtttggttgggcttggagtaaaaattgaagtttttgttcaagggttggtatttgtggtggtggtggtgacgg

SEQ ID NO: 613 - DNA, 400 bp, Cicer arietinum
caaaacttcgtctttcagatccggatccacgcgccgccatcatggtgaacgttccaaagacgaagaagacatactgcaagagcaaggagtgcaagaagcacacactccacaaagtgactcaatacaagaagggtaaggatagcatcgccgctcaaggtaagcgtcgttacgatcgcaaacagtccggttatggtggtcagactaagcccgtcttccacaagaaggctaaaaccactaagaaaattgttctgaggctgcaatgccaaggttgcaagcatgtttcccaacatgctatcaagaggtgcaagcactttgagattggtggtgacaagaagggcaagggaacttctcttttctaggtggagaattaggatttattactgttttgatgtgttatttt

SEQ ID NO: 614 - DNA, 445 bp, Cicer arietinum
acagagaagtatttaaggattacatacaggcaaagaggaacgatggtaacatagccataaaacaaaccagcagaccaagtcaccagatttatgtcatagtcccattccttatccttcaacttgtgtgctatatatgtcacaaatgttccaatagacgctgctacaaatattaatgtagtgcaaatccagaatggtccatacaaatcagggttggtagaagtcttttcattaaaagttcctctgaatggaaaaagtgagtctataatcctctccaaaacatctgaagtgtcaacgtcaaagtatggtttgtaagcagcaactgcaaaattccgaagccaaccaccctgctggggttcattagaaccagatacaggttttgaaaatgaatcatctgcatcacgaggtggcctagaaccaccggtaatcttcccctgagcttgggatg

SEQ ID NO: 615 - DNA, 402 bp, Cicer arietinum
actcattacccccaagaggcacctctctactcgtagctcgccctacagtagttgtcggtgaagcacgtcccattggacatcaatacagttgatcctcgcagagcttccctccagcagtgtcccatctagttcatccagcatatcatcggcacaaaggcgcatttactttcaagaggtcatcccgtcagcgggatctattcctctccagcctagaattctcttgcacagatagatcaagtagctttccataccctgaggcaggaagtccatgatcccctaagatcgccagtagctgcaaccctagaaccgtgcatccttggggaaaaccctcgcaggagaaaaccccaaggcgactagaacgctgctctgtggacgaggtagtcgcctcattccacggtctcc

SEQ ID NO: 616 - DNA, 246 bp, Cicer arietinum
acttccgacttgctcattgatctcgcattgatgatctcgcatcgagatgtcctcctgtatcgtgtcatggaagcatggtccttgaaggcctgcgagtgtggttgtcattgccgagggtcgctggtgatggaagaaggaatttagtgcttgcagcaagagcaggtttggccgcaggcagaggcctcgtggttacagcaagagcagggagacatgttgatagttgttggtgaagaaggtcttcgaaaa

SEQ ID NO: 617 - DNA, 316 bp, Cicer arietinum
actcttatatttttgaaccaaataagatataagattggtgtctattatggaaatccagaagtgacaagtggtggaattgcattgaagttttttgcttcagttcggttagaagttcgccctatagggaagataaaatctgccaaaggagatgaagaaattggccttaaagttcgggtaagagtgcaaaagagcaaggcgtcaaggccttacaaagtagctgaatttgatatttcatttggggagggtgtcaataagctgggctgtattttagattgtgcagaaatgatgaatatcgtcttaaagaagggctcttggt

SEQ ID NO: 618 - DNA, 247 bp, Cicer arietinum
acttccgacttgctcattgatctcgcattgatgatctcgcatcgagatgtcctcctgtatcgtgtcatggaagcatggtccttgaaggcctgcgagtgtggttgtcattgccgagggtcgctggtgatggaagaaggaatttagtgcttgcagcaagagcaggtttggccgcaggcagaggcctcgtggttacagcaagagcagggagacatgttgatagttgttggtgaagaaggtcttcgaaaag

SEQ ID NO: 619 - DNA, 247 bp, Cicer arietinum
acttccgacttgctcattgatctcgcattgatgatctcgcatcgagatgtcctcctgtatcgtgtcatggaagcatggtccttgaaggcctgcgagtgtggttgtcattgccgagggtcgctggtgatggaagaaggaatttagtgcttgcagcaagagcaggtttggccgcaggcagaggcctcgtggttacagcaagagcagggagacatgttgatagttgttggtgaagaaggtcttcgaaaaa

SEQ ID NO: 620 - DNA, 329 bp, Cicer arietinum; identical to SEQ ID NO: 604

SEQ ID NO: 621 - DNA, 322 bp, Cicer arietinum
tctttcttggcacccactgttagtgcggtgctaggagcgggattttctacgggctatgcgactacacaaaactgcggggacgccatcggctccctaacagcagttttcagagaagggattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttcaaggcaaaccgcaccgccggcctctgattccttcccaaggtttttcc

SEQ ID NO: 622 - DNA, 334 bp, Cicer arietinum
gattcagatccaaaccatagattagatctaaaatggcaacaaccacctttgcaaccgtcgtaggaatgggtggcgcatcacgtctcgcctcagggtttgtgaaaccacaagtgatggccaggaatcgcttgaggcaagctatggcacggggaaatggtgggagggttacatgcttccagagggattggctgcggagggatttcaatgtgattgggtttgggttaattggttggttggcaccgtctagcataccggctatcggcggtaaaagtctgactggacttttctttgatagcattggaactgaacttgctcacttcccaacccctcctgc

SEQ ID NO: 623 - DNA, 381 bp, Cicer arietinum
ttcttggcacgcactgttagtgcactgttaggagcgggattttctacgggctactcggccacacaatactgcggggacgccatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtca

SEQ ID NO: 624 - DNA, 190 bp, Cicer arietinum
acgtatttcagcgagcctctattcgaaggtgtaggcgaacctggatcgacggagatctcgtcagcgggattgtcgcagagtcagggatatttgagtgcgttggcaacgagggctatcattctgattgaggctgatgagccggcgatcggactccttgcgtttgttggtattggaatggacgaggttagta

SEQ ID NO: 625 - DNA, 404 bp, Cicer arietinum
acttgcgcgtgaaagacccctacagaggttgagaggagagcctgttgatagaaacaggcaacatgatagagattcaacggacgaggatcaagaaagtgagttatcaagtgacgttccaaccgttgactctttagttactgatttgacttctcaaatggcaaggtctctgctcttgcaagaaccatccaaaaagccacccggactcactcaggaggccctggactgtttgcaccttgaagtttttagaagcagcgatatgaaatcagaatccaggatactgcaggattgtgggatatgcttggaatctttcagggatggagatgaactgatccatttgcaatgtggacataaatttcactctgcttgtttggatccttggattcgcagttgtggagactgtccgt

SEQ ID NO: 626 - DNA, 404 bp, Cicer arietinum
actcaggcgactgacaatgtaaattaaattactacacctattaaaaaggtcaaacaaggtttaaaaacagaaatacaacaaatggggcaaaaagggggaacattacataacacttatctcagaaaccaactttcctctagtatgatggaagaaaaaatctcatcacagaagttccgcaacatttgaaggcagctcctcaattatcacattgtagaacttctggatgtcacccagcattctttcatcgtcctttgtgacaaagttgatggcaacacctttcctaccaaaccttccactacgaccaatacgatgaagatagttctcgggctgtgttgggagatcataatttataactaatgacacttgctgcacgtcaataccacgagctagaagatcagtagtta

SEQ ID NO: 627 - DNA, 320 bp, Cicer arietinum
acaggacatcttctcaacaaatccactgcagtcacctattgagaagatgtcctggaaaaccaacgcttccggctctagcccaagtagcagagaggcaaggtaaatacttagcaggcttattaaacaaaataggtaaaaccaatggaggccacgcaaacagcatgaaagacattgacttgggggatcagtttgtttacaagcaccttggaagcatggcgactgtcggcagttacaaggctctagtggaccttagacagaacaaggaagcaaaggggttgtctctggcaggtttcatcagttggtttgtttggcgttcggcg

SEQ ID NO: 628 - DNA, 341 bp, Cicer arietinum; identical to SEQ ID NO: 202

SEQ ID NO: 629 - DNA, 152 bp, Cicer arietinum
cccgttgccgtcgccgccactgcaattccaggtgagccaatggacatcatgactgctttgcaacttgtgcttaggaagtcacttgcatacggtggtcttgcacgtggccttcacgaaggtgcaaaagtaattgagaaacatgcaggacaact

SEQ ID NO: 630 - DNA, 210 bp, Cicer arietinum
acctgtagtgagcaggtttgtatggaccctcaactggaacactgatgtaatcagcctgggattgggaaagcttggtgagcttagcaccaagcttgttaagatgaagtgcagccaccttctcatcaaggtgcttgggcaaaacgtaaaccttcttttcatacttgccggaattcctctcattccacaactcaagttgagcaataacctggt

SEQ ID NO: 631 - DNA, 454 bp, Cicer arietinum
acgaggggagtgtgtgtagtgtggaaattaattattttagatggagtcatacagaaaggttatgattgtggggataatgttgttggccgttgccaatgcaatgttgttggttaatggtcagtcctattgtcacatgacaaaatcagggcttaattcatgcaagccttatgtgagtggtgacaattctgttgatgatcaaattccatccaatgcttgttgctctgctatttccaaagctgatcttcaatgtttgtgtcgttacatggattcagggttgctttctttctatggtgttgatccaaaacaagccatggaactacctgttaagtgtaagcttatggactcgttccattgctaagactatatccatctacaattactatgcaaaagctctaactactagattaataatgtaatggtttcttttgcacttgtttttaccctgtttatgttt

SEQ ID NO: 632 - DNA, 202 bp, Cicer arietinum
actaccccagatgatccaatatttccccttattattcctcattgttttgtggggtttcattttgtaaatacctagttttttttacaataaaaataaaatcaaaaaaaaaaaaaaaaaaaaaaaaaaaaagtacctcggccgcgaccacgctaatcactagtgaattcgcggccgcctgcaggtcgaccatatgggagagctc

SEQ ID NO: 633 - DNA, 244 bp, Cicer arietinum
actaggataaattgattgatttattattattattattgttttttccttttggggtttgtctttggtccatgcactgttttaagggcattgcaagttatatatccgaaaaaatgatgaaaatacaacaggaaaaatgagatagcagtgggaagtgtccacggatgaatgaattgtattatttattgtaattaggttagctgctgctagccgtttttatttatcagaaatttaaaatttctgcacc

SEQ ID NO: 634 - DNA, 172 bp, Cicer arietinum
gaacaaaaatcaggatcatcaaatatattaactcaacttactatataatttttacaataatactatcaagacactcaaattaaatataatttttcagcccctgatccatatataaaagcatctaattattaagcaaaaaagagcatctaaatcatataacttgaactgcggt

SEQ ID NO: 635 - DNA, 362 bp, Cicer arietinum
ggagaataggcaaataaaaacaccatatattaaccatttttaggatggatacttttacaaggaacatttgaaaataatgataaattataaacactgaagcaaagcagaagaaaagaacattataagtttacaaggtttgctgttaaatgtgttcagaacaaaccacctcagtctaggtgggcagacaatactctcattaaatatcaaccatgataccatccacccatccatccatccatccatccaataatcaataaatccgtttcagcagaattgggcattcaatagtaggggctgtagcgcatccccattctgaaccttggaaccttaccatatccataaggagcaggagcaaaggcaaa

SEQ ID NO: 636 - DNA, 144 bp, Cicer arietinum
acatataaaagaagagtcgcataacgagtagaaaaaaaataacaagacttatgatttcagatttttcttttccttttttattttgtttgttgactggcttggttgttctagtttcacaaactcaataataacataatttctttc

SEQ ID NO: 637 - DNA, 258 bp, Cicer arietinum
acatcctccattacattcggtaaatcaataactgaaatagaaaagatccttaataaaaaactagcctagtagaagaatccaaggaccttaccaccaacattctttctcctggcctcttcatgatccataatgccagctgaggtagtcaagacaatatacccaaactgtcttgaagggagaagcctagcagtccaaccttcaatctccttaacaccaacatcaaaacgtggactaataacaccacatttattcccgcgt

SEQ ID NO: 638 - DNA, 390 bp, Cicer arietinum
acatgatgatatgcttctagccgcctcggaatccttggccaagcaagtgacagagaaggactacgcaaagggtttgacttacccacctttctctgatatcagaaaaatttcagccaacatagctgcaaatgttgctgcaaaggcatatgaactaggcttggctacacatcttcctcgtcctgagaatcttgtcaagtatgctgagagttgcatgtatacccctctataccgcaactataggtgaataggagcaatttacaatggactaggcttttgaatataataaggatgttttttgtgtatggtgtcctttaatgcttgtgcaagtataaacgattttatgtttttgcttgaaccaatgttttttccaatatgatatattcttatttc

SEQ ID NO: 639 - DNA, 436 bp, Cicer arietinum
acttttgagtttgagacacgccgtgcttcatattattggttgttacacgcattaggtatctaccaaccttatgtatgggaatattcaaggttaaatatctctaacgctgttatgtcaaagcgcaagcttaatcgcctagttactgaaaagtgggttgatgggtgggatgatcctcgcctgatgacattagccggattgcggcgtagaggcatggcttcaacagcaatcaattcttttgttcgaggaattggaatcactagaagtgatggcactttgatatctgtggctcgccttgaatatcatgttagggaagaattgaacaaaacagctcctcggacaatggttgtcctagatccactcaaggttgttattactaatcttgaagccaactcagccattgaggttgatgcaaaaaatggcctgatgctcaagctga

SEQ ID NO: 640 - DNA, 438 bp, Cicer arietinum
acaagaacatcaccttcactgtgtgggatgtcgggggtcaggacaagatccgcccattgtggaggcactacttccagaacacccagggtctcattttcgtggttgatagcaatgatagagaccgagtggttgaggcaagggacgagttgcacaggatgttgaatgaggatgaacttcgagatgctgttttgcttgtttttgccaacaaacaagatcttcccaatgcaatgaacgctgcagaaataactgacaagcttggacttcattcactccgccaacgccactggtatattcagagcacttgtgcaacttctggagagggtctttacgaaggtttggattggctttctaacaacattgctagcaaggcataatgagacatctggaaaattttgggtgtgatctgataatttcctgtgagtctggcggttcttgaag

SEQ ID NO: 641 - DNA, 148 bp, Cicer arietinum
accattgtttcctttattgtgtcattaaaaaagggttgccacactcttatcatgtgaaactcccttgactaaaacatcaaaggtagtttagttactgcatttttcttcacatgcaatggtttaggtctagatattataatgtttggca

SEQ ID NO: 642 - DNA, 368 bp, Cicer arietinum
acgcaaaatgttcatcgaaatggatgcagaattgtttgaagagtgtcagaggcatcatacagagaaacgggcaaaagccaaagatgtggcagagcagcgggaattgaactggaagagactggcagaagcggctgcacagaacggcgtggcagatatggtcacagattagtcttgctagttttaatgcctcagctctggaagtgtgaattaaataggtggaggatgatgaatatgctcctctttttcattttggtgcaattatttattggtttctttttttttttgtcagcctaattcttttctcctcttccttctcctaattatatcagttggataattagcattttgaagaaagcagtgattaatgt

SEQ ID NO: 643 - DNA, 312 bp, Cicer arietinum
  misc_feature (252)..(252): n is a, c, g, or t
accctttgttctatattatgatagttgttcaaacatgaaagaatcaatgcaatagtgggcgaggcattttcattgatggttaaattatctccccatcaagtcagcaggatcatgtttcatttcaccctagggtcatgatctataggttgtttgatgtcgaactccactggataagcttattcgttaattagattttgatattataaggttctgtgaattaaggtataatttgtggcttagtggggttcttanaggtttaatatttgtgggccatgatctcataggttgtttcatttccccacttgaaaatat

SEQ ID NO: 644 - DNA, 135 bp, Cicer arietinum
acttgtatttaaaaggggaacaaatagaaaaggaataggagtattaggaaagaaagtgacacaaaaaatgatacttagatgccaatttaaacaaatatttgagatgttttgagagtattaaactgagtggaaaaa

SEQ ID NO: 645 - DNA, 409 bp, Cicer arietinum
accacacaaatccgtccttttccaagccttttagcaatacaatccgtgacgagggttttccatccttccctacagttgacaagcccatagcatttggttccttcaaacccgcagccaatgcatcatcaaaccatttacgaaactgattattggggtctgcctccacctggtcttcatgaaattctggagagatatagttttctcgtagagttgaaatatcaatttgaggaggctttccaattcggacacacatggatgttccaggatatggtggaagtataagcttatacttttcagcaatagcaggtgggacaaatctacctcctaaaaagtggtgagggccgccaaacttctttgcacataattttggtgctgtcaaagagaccaacaaatcaggtttaatgcctgt

SEQ ID NO: 646 - DNA, 205 bp, Cicer arietinum
acgcgggggatccggaggagcctaaaaatttccggaagactattcataggattttgaaagtccaatactcaattcctgactatgttcaaatatctcccgagtgccgtcatctgatatcaagaatcttcgttgcagaccctgctcagagaataagtattcccgagattagaaaccatgagtggtttttgaagaaccttctagctga

SEQ ID NO: 647 - DNA, 380 bp, Cicer arietinum
actcatttagacgtctctggaattgagccaactgcgtctgcaattgaaatattcctgcagccttttgagacaaaatggtattcaatttggtaatataatcatccagctgatttccaggttggtcagctttaacgagtaaattcatctcctctttaacaatgtctattgtttcctccacttgtctacggtgagcagttactagatcttcctcatccttcagcaaagcatttaaatcatcatcgggatcagaatgagtattctcaacatgtgatagatttacacttttggcatgagagcctatcttccttttgtcttccacagtagataactggttgttatccaccctgttgctcacttttcttgttctgtcttgtcttggt

SEQ ID NO: 648 - DNA, 359 bp, Cicer arietinum
acaatgagtgcaccatctactcctgcttcctccatacactggagcagaaaatctacatgtccaggtaaattaggctcttgtccaggtgagtaagggaatttaccagcctcttgagaagaagcccacacgtgtagatgtgaatcaatgactttaaaggttgaaggggtttcactcaacgccattctaattctaattgtagcaccacctcttctcaaattgaacgtggctttcctcaaacaattattgggacttaccactgaagctgatccccgcgtacaaccttttaagttccaaacatagcttccacaatgtattcaaatttagttcactgaaatgcaatgaattcaagataatactgt

SEQ ID NO: 649 - DNA, 405 bp, Cicer arietinum
accgtcttctgcccaaacaaacactaaattcaaaatattcccactctcttcatccccgcgtacagcaacttaagtatatacttgtatgacaaactattcatattgagttaataactgacaaatattttgggatagaaagcaagcagcattaagtgctacaaaacttgaagtaacatgctaccgactaatgttttgaaacccagtccaaatgcaaaatgcagttcagatcagaacttcagtggtttcaaacctagtgatgctcgaagcctgtttgcttcagcaatctcgggatctggatggtcagtgccgtcatccttcttttccttattttccttcttctttttcttctttggctcaccatcctcagctccatctccattccttctaggacttacgctactccga

SEQ ID NO: 650 - DNA, 212 bp, Cicer arietinum
acctctgcccacctttatccttcagcaaatgctccccatcctcttccttaggtgtatcttcatgatgctcgtgtgaaccatgattctcctcatctctagtttgctcagctacatggcttgagctattcttctcagtatttgatcccttccaagcttgttttttgtgtccattcttccccattcgattgagaaatttaacccgcattccattc

SEQ ID NO: 651 - DNA, 240 bp, Cicer arietinum
  misc_feature (138)..(139): n is a, c, g, or t
caaaatcaatctgatgacttctatacattagcagtttcaaatatctttacagccttaaatttctaaagaatactttaaaatttagataagataaaataaaaagaaattgagtaatattaaattaagtaaagttccccnnccaactttatatgcatggaaaaactccatatttcatatgagaagttagaaaactaacatttttcctaatcaatcaacatttccccaccatttgtggtttgg

SEQ ID NO: 652 - DNA, 294 bp, Cicer arietinum
acatactgtcaaccaagctctgaatacccatgtgcttctggtaagcaatactacggtcgtggtccaatacagttatcttggaattataactacggacagtgtggtagagcaattggtgttgatttgcttaataacccagaccttgttgctaccgaccctgttatttccttcaagaccgctatatggttctggatgaccccacagtcacccaagccatcctgtcatgatgttatcaccggacgatggaatccttctacttctgatcgtgcggctggtaggcttcctggttatggt

SEQ ID NO: 653 - DNA, 407 bp, Cicer arietinum
acatcagcacctattgttgtttgtagaaaagtaatgaagaacactacatatactcctcttattaaggagcctcattcagcatgtgaattattgttggcgttttcacaagcaaccagcagagaatcataacatttttgtgaaggcaaaaggccgtgcttatccttgatttctgaaagcaacaccatgcaagtatgcaaatgattggactctgactcctcaattagagaaaataccttatcaaatagaactttcataaccagttcatcatcttgtaacttatccttgaggagcttacacaagtcaatagcagaacttaaatgctcattccaaatacaacacaagatgattctgcagcaagcatcattccaatagactgtatcatttagttcctcaagtagtagaagcaa

SEQ ID NO: 654 - DNA, 403 bp, Cicer arietinum
acataacttcctcctggaccctggtcagcagtccagttataaaacttatttagagtctagcattacgaagttgttgctttaacatcggtcgaacatactcttcaaagccatctggcacaactgaatcattcaatggatccttccatgcctcctcatatagctttggatacacatttccatcataacggccaagaactgaactgaggtaatgatccgtgtagttaaacgaatcaacaagtgcaattgcattaggacgaacctgtgaatacaaggacctgagctggtcattggcaagtgaaccctgtttgggagtgatgcagccagttgaaagaaaatcacccaaatgcttatgaagatgaaacaaagcataaatactacaaagaatttctaattgctgtttcac

SEQ ID NO: 655 - DNA, 259 bp, Cicer arietinum
acgccttgatcgacacctacaagctgaatggacaattccgatggatttcgtctcagatgaaccgtgttagaaacggagagctgtacgcgggctaataagattgaacaattgaacgctgctatagatgaaatttcttctcagcttcgatcaggggagaccccaaatggggtagcagtgaactctgatgaaattgaagctaccacatgagactgttactgtgatgttggccattacattgttcattggaaatatcggtggt

SEQ ID NO: 656 - DNA, 440 bp, Cicer arietinum
aaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgaca

SEQ ID NO: 657 - DNA, 313 bp, Cicer arietinum
gggggtgcttgcttataaaacacaaagcaagcaattgtatccaattttctctaagactctccattttacttgagaatttgatcaaccacatacacaaagaaagcccaagatttttcattaaatgtaaacttaatttctcccttgttatagagtttgaaaaatcttgtttatttgtcactaaaactcaaccttttatattttattttggcactcttttttttataaatcacacaacatatttactattacaccacatgtgtagatagataaagattttaattaaaatcatggtgtcattgtaattttattaaaa

SEQ ID NO: 658 - DNA, 412 bp, Cicer arietinum
acttattcactgacaaaatcttcttagactattaatatgtcagtctcaaaaaaagatgaagtcattgctctcacatcctagaatgtcccccaatctcgttgctagtctcagtctcaattttagctacccttgaacgctgctgttggaatttcttcttagctctataaagtatattatgcatttcgtcaaagtgtggatttgttgcagcttttgtatctttaatccatcgaagaacttttttgtatggagataatattcgatcccgatccttctcatccaaaacctcaagttgcgtgagttcacaaaccaggctgagatctgctatagacggttgaaaggcgccaagaaggaatcgtccatctccattgagccaaatatcctctagttttgataaagaagataataacacttt

SEQ ID NO: 659 - DNA, 298 bp, Cicer arietinum
actaagttacatgctcttgtggaatatgagactattgaggcggctgagaaagctgtggcaatgttaaataatgaacaagactggaggaatggaatgcgggttaaatttctcaatcgaatggggaagaatggacacaaaaaacaagcttggaagggatcaaatactgagaagaatagctcaagccatgtagctgagcaaactagagatgaggagaatcatggttcacacgagcatcatgaagatacacctaaggaagaggatggggagcatttgccgaaggataaaggtgggcagaggt

SEQ ID NO: 660 - DNA, 407 bp, Cicer arietinum
acgcgggggcccaaattacaatggttggaagcccgaaaccgtgaaaatctatggatatgattcagagcccattacatttacttttaacacctccatccctagtgacacttggtatggatataatttgtgtgatgctcctcctccttcatcttccatccaactatccattcacaaattgattgtgtttgtaatgattcttggatctgcttttagtatttggatgtaatttgtaatttttgtatatttggtttttcgtttggattaacaaaatcgtggcgagttattgtgattttgtagaagctatactttatagttattgcaaaattataatgattcatcatgattttgctattttcgcgtaaaatcaaatatgcacttacatatttttctcgtatgtgcacttaaat

SEQ ID NO: 661 - DNA, 431 bp, Cicer arietinum
actgatccagatgacgcaggtaaaatttcacgagaagacttccttgagggtgttatcgatctcctcgatgctgaatcacttcgtggcatttttatttggaatgctaatgactctgcaacccctccacccaacggaaaacctttctcctttgagataaaggcacaagaactcctcactaaatcaggataattaattactatctagctatctagctacctagtagttatttaaaacgcattctacgggtcattaataaataatagctagatcttgtcatgataaagtttgtttcttatatcttctaaataagacctgtctggcttgaatggatgattttactattgcatgggtgtttgtgtatcgcacaattttcttattttatttcattatgtatttgtatgatatctcctgtcatatgtggatttttttat

SEQ ID NO: 662 - DNA, 334 bp, Cicer arietinum
acaaagttttcccggtctaagatttaaaatgaagaaaatctaggaaattatgaaaacttttccgttgttggggagctaaaaaagataccagagaaaaatgcgaaacagaaagaaaccactcagatttctaaaaaaccggataccgaggctgtttcttcatcgggaaaatctgttgccactaccaccactcttgttcctcccgctggccttggatctgcagctccattattgaaatctgctccacgggtagtgcagcagccgcgggtcaataatactgtatctaatttgcagtcccaaaaattggacgagtcctcatctggggaggctgaggagt

SEQ ID NO: 663 - DNA, 408 bp, Cicer arietinum
acctaaagtcatttccattagcctcgacatgagactcttcctctaagaacctctcgggcctaaattcctcgggctttttccattgggccgggttgtttgcgagccaccacgcattgaccaatatcttgctctcggccgggatgtcaaaaccactgagctttgcatcgtgaaggttcatgtgtgggacgaggagtggaatcgccattcgaagacgaagtgtttctttgattacggcttgtaggtaaggtagcttttggagatctggttcagttacttggtgtcctggtccaagaactctatcaatttcttcccttactttgttttggatcttttggtgattcactagctcagcaatgccccattcaattgaccataatgttgtttcaattgcagcaacattgatgttct

SEQ ID NO: 664 - DNA, 409 bp, Cicer arietinum
acttgctaatgcaagttagttgcttatcttattgatagtttcatgattcacatatccacccatgtcctacaaattctaaattgaaaaccatactgaaaccaggcaaactgactcaaatagaaaaaaatgcaaactaactcgaaatagatgacaatattttatttatatgacccttcaagcatgcttggctattgtcgattgcagcttctccttctgagcacccacaaccttgtccactagttttccttctttcaagaacaagaatgttggcatagcttcaacaccccactcctcagcaacagtcttcaattcatccacgtcaaccttaaggaaggtgacattcggcagctttttagcaatctctgctagaattggagcaatgaaacggcatgggccgcaccaagaagca

SEQ ID NO: 665 - DNA, 408 bp, Cicer arietinum
caagtatccttcaccaccacctccaccagtttatacttcacctccttacattccacacccagtttatcactcacctccaccaccagttcatacttctcccccatacattccacatccagtttaccactctccaccaccaactccaaccaagaagccttacctctattcctcacctcctcctccttaccactattagatagtaaacaataatagtggtttattaccatagctctctatgaaagattatgaagaatatatgaaaataaagaaagtgatggaaggaagatacatcgaaagagaaaaaagggaagcaaagtttccgcgttttgtcttcaggaaagaaaaggcgttaatttttctattatatggtgataagattgttattgtgtttttttttctctaatttct

SEQ ID NO: 666 - DNA, 435 bp, Cicer arietinum
aaatgaaatggttactcttttaccctttgttgttcgggtgaaattcgtgatcgccttctttgtttcttcgttgcttctctctcttctctcactcgctcacttcctcaacctaaaaccaaaaccctaatcctcttagatcacaattacacaacacaaaccatggactctgattcctcttggactgctcgtctctcttctgcctccagacgctatcaatccgctcttcaatctcgatcagatatgtttatgggttttgatgaaaacgacggggaggaagatataagggaagagtttctgtgcccattttgttccgagtattttgatattgttggattgtgctgccacattgacgaagagcacccaatggaggcaaaaaatggggtatgtccagtttgtgcattgagggtgggggttgatatggttgcgcacataacc

SEQ ID NO: 667 - DNA, 407 bp, Cicer arietinum
acatcagcataggctaagtgataaagtggaaccgttggttgagctaatatcacttcctcgtagcaaaatgctgcttgtttatacatttgcagagataagtaaatttcagccagttccctccatgcatcatgatctgccatgaatatttccagatatttattaagccattcgatagctccagaaatattgccttgtgcctttgccatagccaccctccttttatggatgatctgatctagaggattatcttccaaaaggcttgtgtaagccttttctgccatgtcccatgatccttttgcttcgagcaacattgcctccagcctgccaactcttttgctctcgggaaacctcttccgaagagcctttgtacagtcctgagcaacatcaagactttgacaatccatagc

SEQ ID NO: 668 - DNA, 321 bp, Cicer arietinum
actacaccactatccatatgtatacaaacataaccaagcatcctccccgcccaaaaaaaatgtcagattaaatactaaaaaaagaaaacacctatgtaacaccaactcttcacattgaagggttaagacacatactgtaattatattcaatcacttatattttctcatattattatcaatatgaacattgtgtctggtgtgtgtttcatagaataaaaaaaccacatcaaggttgaatataatcagcactaacccatttccaataatgtttcttaacagaaacagctttgtgtgcaactttcttatcatcagaatcagcgt

SEQ ID NO: 669 - DNA, 285 bp, Cicer arietinum
gggccttcaaaacttattagtaggctttcaaaaaaggaaaatttgggggggggggatagtttggttttggagcccaaagggttggctttgtattacaaaagtcaaaattcacctaggccaattctttattggttttcatctgattggttttcaattgaaaaggggtcattggaaaatgtcacactcaaatctgatttagacacttttgagattggatttgatttttttgttgccaattcttcaacttttggtaatagaattattggtaggccagtgaataatagt

SEQ ID NO: 670 - DNA, 401 bp, Cicer arietinum
actcttgcttcacttgctgcaaacatctgaggcaagcatctatgttttgttcctcgcagaagttgcgaaaagcaatgcaggagtttttcaccctctgtgcacctatgcttgcactgctacccttaaattggtgaacatgagcatcaacttttttgaagtcaacactttgctgatccaaagaaaaggagagatctttgagaatcctctcagaatcttcaaagaaaagagaaaccacttcaacaacaaactcagggttattctcatcttgtagctgctgaagttgcagaaattgaccatccaaaaactcctcggtgaacaaggatttgatgtagtccacccattgtctccgcatctgacccacctccatgtttctgtagaaacaaataagttgttattgttat

SEQ ID NO: 671 - DNA, 293 bp, Cicer arietinum
acgaatacgaaccgtgaaagcgtggcctatcgatcctttagtccttcggaatttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgacagtgtcgcaatagtaattcaacctagt

SEQ ID NO: 672 - DNA, 407 bp, Cicer arietinum
acgtctctgaaaagagagtgaatatccgctgtagtaagataacccctcccttgaagatcaagacagcgaaacaagtatgtcaagccttctggggtgtctttattttctaaagccagaacaaagtccaagaaactatcaaaatccatctcccggacatttccaccaccactctttccacggcgaacatgttcatcgtatactctctcaataaaaatctcagtcagggttccatctgcatattcgcgcagctcttgtttacccaatgacccgtttgaatccttatcaagagcaagaaacatatcacatatacgttgggcagaagtcaaagagaaccagttttcagcttgttctgtgtctgtgacttcttcttcactttcctggtgaagctccattagttcctgaagaca

SEQ ID NO: 673 - DNA, 407 bp, Cicer arietinum
acattttaattacaattacaaacattttttaaaatgcatgcaaaaatcgaatactcatttttgatacaatatattgtttttattttattttatataatatgcatctcattttggtctcacttcaatgccttcaacaataagccctcccttcaactgataaccaagttctgtaagagtcatcttaatctcttcatcactctcaccactaaaaaactctccaatctcaatctccatccagccatctaatctcttagctggcacatgaatattccctctatcttcttgtgcttgaaccactctgtttcttctattcccataaaatagtgtctccatattacacttgttctcatctttattgcacaaatatgctttccctcttttcactttgtttcccatctcaattgtta

SEQ ID NO: 674 - DNA, 433 bp, Cicer arietinum
atagaaggcacaatcagatcacaaaatttaacagcaaacacattatgggcagcggatcttgtaatgaaagtctctgatggagcgtatggacttgactcaggtccttcagatgtaacaattgagatgggaaacaaagtgaaaagagggaaagcatatttgtgcaataaagatgagaacaagtgtaatatggagacactattttatgggaatagaagaaacagagtggttcaagcacaagaagatagagggaatattcgtgtgccagctaacagattagatggctggatggagattgagattggagagttttttagtggtgagagtgatgaagagattaagatgactcttacagaacttggttatcagttgaagggagggcttattgttgaaggcattgaagtgagaccaaaatgagatgcatattatataaaat

SEQ ID NO: 675 - DNA, 378 bp, Cicer arietinum
acatttcttgttattagtctgactccacaaaatccagatgaagcaaattgtcaagacaattataatctaaatatttaaaatacaaaaatctagtcacattttattacagaacatgcttcttcactaaaggactctcacatattgctgatttgcatcatgcaaccccggtgcccctaattggaggtggcgggggcgtgtttttcggcgtaattagggggagagtagacgagagcagccaccatggcacctggtaacacaccataactcgctaaagctgccactttggtaatcactgcctttcccttcatgaacgccatagtcgaaacttctcagactcggatagatcgcgttttgcgttttgatggttgaacaccgaat

SEQ ID NO: 676 - DNA, 112 bp, Cicer arietinum
acagcatacgaccgaatcagtgacatacacaaccacccaaacacatcctacttgtgttgctgaagctgacgtggatgcaagaacacacgtagaccatacttcatgaaaagtg

SEQ ID NO: 677 - DNA, 409 bp, Cicer arietinum
actcacgggtgaagttacaaacgctgacatgcacacagcgccacacacgcaatgaaacaaagagacaaaaacaaaatataattttaaattaaaaataaaaaaggtatgtcataattaatgcatgaccatgactactaacttggtgaagatcagaaaattttatattcttccccatcaccatctactaatactactattatactactacgttcttcgccttaatttctggtatccaacaacttgaacgagactacatctctttcatcttgttaaccttattccaagcaagctttaattaattcatgcaattcctcaaaaagataaatatatatgataattaggatgcacacttaaatccttcaggtggatttttgccacagtcaatgagaagctgaagagcaatggggat

SEQ ID NO: 678 - DNA, 425 bp, Cicer arietinum
acaagaacatcagcttcactgtgtgggatgtcgggggtcaggacaagatccgcccattgtggaggcactacttccagaacacccagggtctcattttcgtggttgatagcaatgatagagaccgagtggttgaggcaagggacgagttgcacaggatgttgaatgaggatgaacttcgagatgctgttttgcttgtttttgccatcatacaagatcttcccaatgcaatgaatgctgcagaaataactgacaagcttggacttcattcactccgccaacgccactggtatattcagagcacttgtgcaacttctggagagggtctttacgaaggtttggattggctttctaacaacattgctagcaaggcacaatgagacatctggaaaattttgggtgtgatctgataatttcctgtgagtctg

SEQ ID NO: 679 - DNA, 359 bp, Cicer arietinum
  misc_feature (293)..(293): n is a, c, g, or t
actccactttacaacatcaaggcataccttcctgtcgtcgagtcctttggattctccagtcaattgagggctgcaacatcaggacaggctttcccacagtgtgtgtttgatcactgggatatgatgtcatcagatccattggaggctggatcacaagctgcaacacttgttactgatattcgtaagaggaagggtttgaaggagcagatgactccactctccgagttcgaagacaagctttaaattatttaaactgttttatttttatttatcaacttagcttatgttctggncattgaaactgttacctgagcttttaaagttcagttttttgtgtcattgtgttgtacctgcccggg

SEQ ID NO: 680 - DNA, 426 bp, Cicer arietinum
accaagagtattagcatagtcaaaaagccattaattaattagcatcttaattattccaaatggcttcaaaatttgctattattcttctttccctcaacatcctatttttcactatggttacctccaattatgttccatgtcctccaccaccccccaagggtcacaaaccccaccacccaccttcctcaaaatctccaacttgtcctagagacacaattaagtttggtgtgtgtgctgatttattgggtttgattaatgttcaacttggtaagccaccaaagacaccatgttgttcactcattgatggtcttgctaatcttgaagctgctgtgtgcctttgcactgcccttaaagctaatgtgttgggaatcaaccttgatcttcctattaacttgagcttgatacttaactattgtggaaagggtg

SEQ ID NO: 681 - DNA, 443 bp, Cicer arietinum
cattttctacagaacctctagcaagaagaaacgcattgagaaatagacagtgacagagtgatagagagagagagatttcgcaatttcacaaaccctaatttcaaagagatcggcgatggcttcttctaaggatcgtgaaaacttcgtctacatcgccaagctcgccgagcaagctgagcgatacgaagagatggtggattcaatgaagagtgttgcaaatctagatgttgaactgactgttgaagaaaggaatttgctttctgttggttataagaatgtgattggtgctcgcagagcatcgtggaggattctgtcttccattgagcaaaaggaagagacaaagggaaacgatgtaaatgcaaaacggattaaggagtataggcataaggttgaatcagagctttcaaacatctgtaatgatgttatgagagtgattgatgaac

SEQ ID NO: 682 - DNA, 379 bp, Cicer arietinum
actttgcctttgtcacctcttctacgttgtgtgtagtgaatgcgaaattgaaaactaggacgtctccaactttgaaagacttgccagaagcccaagttgtataagcagaagcaccgttagcaggaattgtccaaccattgatatcaccaactgtataattaacgcctccactaacatcagctggagaaggtgctggtgctggtgtcgctgttggtgtttgtgttggtgctagtgctggtgcttttgatggtgctggaacaggacttgactttggtggagaagaggaagcacttggttgaggagcagaaacaggtggtgaagtagtagaagcttttttaacaacgttaattgacaatttctgaccaagtgaacagtgagt

SEQ ID NO: 683 - DNA, 383 bp, Cicer arietinum
gccgcgccccaatctcgtttctcacttcttccctccgagccacccaaaatgactaagagaaccaagaaggccggtattgttggcaaatacggcacacgatatggtgccagtttaaggaagcagattaagaagatggaagtcagtcagcacagtaaattcttctgcgagttctgtggaaagtatgctgttaagaggaaggctgttggtatctggggctgcaaagattgtggaaaggtgaaagctggtggtgcatacacattgaatactgccagtgctgtaactgtgcgaagcaccatccgaaggctgagggagcagaccgagagttagacaaccagtttacattattctcattttgttttctaagtcattgcagaaacttttgt

SEQ ID NO: 684 - DNA, 410 bp, Cicer arietinum
actgtatccccattcgttgtcataccaagaaacaacctttacaaagttatcattcaaagcaattcctgccttggcatcaaatatactagacctgctatcaccaacaaagtcagtagataccacatcatcttcagtgtaacccaaaattcccttcaacttgccctctgattcctccttgatagcagccttgatttgttcataggttgctttcttctcaagccttacagtgaggtcaacaactgaaacatcgacggtagggactcggaaagacattccggtcaatttaccattcagttctggaagaacctttcctacagccttggcagctccagtgctgctgggaataatattgaaggaagcagctcttccacctctccagtccttgcttgatggaccgtcaacagtcttct

SEQ ID NO: 685 - DNA, 426 bp, Cicer arietinum
acactatggaatattgacatgaatggaaaagtaattgcaggagttgggacttgtcaggaaggtgaaacttcatttcgcaagatggatatgttcataaacttctcagatccattcattgcaaagaggtttgatgtcaatgcttgcacatgggcatttgggatgaacttgtttgatttacagcagtggaagagacataacttaactggtgtctatcacaaatatttgcaaaggggctccaatatgccattgttgaacagcggcagtctgcctttaggctggctcaccttctataacaagataatgtatttggacagacggtggcacattcttggccttggttatgactcgggcatcgacagtaataagattgagcaggctgctgttatacactatgatggaattaggaagccatggttggatattgga

SEQ ID NO: 686 - DNA, 144 bp, Cicer arietinum; identical to SEQ ID NO: 636

SEQ ID NO: 687 - DNA, 131 bp, Cicer arietinum
gattcgcttccttcaccatccagcataccaaggcacaaaaggcgctgtattttctcgagcccggcacccgtcagcgggttcgggggcatactgtcgactttttccaccgaccagaattctctcacgcatcg

SEQ ID NO: 688 - DNA, 229 bp, Cicer arietinum
accacactacccataacaaacatcagcagcctcttcagataataatcttgttggccttgacctgtgtgaagaggatatctatgaacatggccaccatgaaatgaattataaaacccataagggaaaccagcggctccaccatacatggccccaccgtgaaatccatgcaactgaaagttaaataaggatggtataaaaccaccaaatcctgcagaaaatgtgaaattcc

SEQ ID NO: 689 - DNA, 240 bp, Cicer arietinum
acatacaacatcttgatctttgacttcagatacctctagccatacagaagtagtttcacttcctgtgaacaagtattgaccaataaaaatagtgtctccctccttcactgcctgtgccagtccattgaagtttattggcaatatctccgaagaagcttcttgatcctggtcaggagttagcacaacctgaccatctgccttaagggagatagctgtctcacttttgttaacaacctgcat

SEQ ID NO: 690 - DNA, 358 bp, Cicer arietinum
actagctcgatcaatttgacgcaaagtggtgtagctatgacgacggcagcatccatcactgggatgaaggttgagtttcttgaatttccgccggtggtcacatctccggcaaccgccaagtcctatttcctcggtggcgcaggggagagaggtttgactattgagggtaacttcatcaagttcactgccattggagtctatttagaagacatagcagtggcttcacttgccactaaatggaagggtaaaacctctcaacagttgctccagacccttgatttctacagagacatcatttcaggcccatttgaaaagttaattcgagggtctaagattcgggaactgagtggtcctgagt

SEQ ID NO: 691 - DNA, 268 bp, Cicer arietinum
acccaagtgtcccctgagcacaagttgagatatgactcatatccgtttgagccaaccgtgataacccgaaatctgaaaccttagcattcatcttaaaatcaagaagaatgttgcttgatttaacatctctatggtaaataggaggaacagccatgaagtgaagataagcaagaccttccgaagtgtcgcgtgcgacatgaagccgatgattccaagtaagtgaagcacgaccctttggcatttgacctgttaaatgatcaagaagtgt

SEQ ID NO: 692 - DNA, 461 bp, Cicer arietinum
tctgcattggttcatctctctgcttatgtcccagcaatcaaggagacgcttgaagatgctgatgagaggctaggagctgacattgtgcaaaaggcacttgtagcacctgcatcattgatcgctcaaaatgctggaatagagggtgaagtggttgtggagaaaatcaagaatggtgaatgggaggttggttacaatgccatgacagacacctatgagaatttagttgagtctggagttatcgaccctgccaaggtaacaaggtgtgctttgcagaatgctgcttcagtcgctgggatggtcttgaccacacaggccattgtggttgaaaagcctaaacccagggcacctattgctggttccccacaaggccttactgtttaagttttagatcaataattgttgtaggttaactattacggcagcaacggttttgatcagaaaagtattagagtatttgttcg

SEQ ID NO: 693 - DNA, 235 bp, Cicer arietinum
taccaggggccgccccgacaggtacacttcttgatcatttaacaggtcaaatgccaaagggtcgtgcttcacttacttggaatcatcggcttcatgtcgcacgcgacacttcggaaggtcttgcttatcttcacttcatggctgttcctcctatttaccatagagatgttaaatcaagcaacattcttcttgattttaagatgaatgctaaggtttcagatttcgggttatcacg

SEQ ID NO: 694 - DNA, 192 bp, Cicer arietinum
accgttttggatgggaatttgaagctcagagtgttgtcgacgatgttaagaaaaatccagaggcgtgttcgagtggaattgttcttcggagaagattgcaacttatgatgtataatattatgtataggattatgtttgatagaagatttgagagtgaagaggatcctttgtttgtgaagcttaaagctttga

SEQ ID NO: 695 - DNA, 430 bp, Cicer arietinum
actatctattgagcaaccaaaagacaatggagccaataagaaactatggaagaatattacataagaggaccagttcaatatgtggtagttaaaactcaatgttcaaattgcagcattttaagagcaacaaccaccatcttgtgatgcttgaggttcctgtttttgctttaaaatattccttttcactgatgttgatccttcttccaaaagactaggaacttccattatctttagtgcaagttcttcgaaacacttgtctacattttctcgagttttggcactgcattcaaaaaacaaacatccaaactctttggctagagctaaaccctcttctgtgctcacaaccctttcagagtctctatcaactttatttccaactagcatcttcacacaattctgattagttgaataaagttccacttctttggac

SEQ ID NO: 696 - DNA, 214 bp, Cicer arietinum
acttttttgtaaatataactgcagttaacttcttttgggagcaaatcccatcctacttcagtgattgtaacaaaataaaaaccggtgaccaaaaacaatatctccactgcaaatttccaaatatctaggccactcaaaatttttatatcaactcaaaattcaacataatattcaacaaagtaaactacccgatcagttttcaagaacttttcgt

SEQ ID NO: 697 - DNA, 432 bp, Cicer arietinum
ctcgttagcctccgccggtggaagctgttcctagtaaagattagatcagaatggatgcgcagcagaagcagaaaaacaaatacagtataattgttcccacatataatgagcgactcaacataagcctcattatctaccttatattcaagcaccttcgggatgttgattttgaagttattattgtggacgatgggagtcctgatggcactcaagatgttgtaaaacaactgcagcaggtttatggagaagataaaattctgttaagagccagacctaggaagatgggtttaggaacggcttacattcatggcatgaagcatgcatctggaaattttgttgttattatggatgctgatttatcacatcatccaaaatatttgccaggcttcattagaaagcagttggaaactagtgctgatatagttacaggga

SEQ ID NO: 698 - DNA, 311 bp, Cicer arietinum
  misc_feature (215)..(215): n is a, c, g, or t
  misc_feature (231)..(231): n is a, c, g, or t
acaaaaagagtgagatttttggccttgagaccccaattgaagtggagggtgtcccttcggaaattctggatcctgtgaatgtgtggtcagacaaagaggcctacaatgaaacactgttgaaactagctggattgttcaagaataattttgagaccttcaccaactacaggattggaaatggtgacactctcacagaagagattcttgcagctggnccaatcttttaaagcnatgactgtgtgttgtaggatgggattgttaggatggtagaataaatgtgaccttagaataattatgtacctcggccgcta

SEQ ID NO: 699 - DNA, 282 bp, Cicer arietinum
actagctcgatcaatttgacgcaaagtggtgtagctatgacgacggcagcatccatcactgggatgaaggttgagtttcttgaatttccgccggtggtcacatctccggcaaccgccaagtcctatttcctcggtggcgcaggggagagaggtttgactattgagggtaacttcatcaagttcactgccattggagtctatttagaagacatattagtggcttcacttgccactaaatggaagggtaaaacctctcaacagttgctccagacccttgatttc

SEQ ID NO: 700 - DNA, 328 bp, Cicer arietinum
actctactaataccccactaaaaaccaagactgatgattcttgttttccttacactaaattatttttctttatttgtttttctccttatttcgccctgcagcataccaactgccaaccaagaatgcctaaaaggaaaaaccaatgaaagtcctgcttaatcattgaacattcattttcttttttattctgtgcatttgatttaggaactcagccaacataaaaatcacagaagacatatcctatgtcatcactgtgtgaatgccactgtcctggtgcttcttgttgagatctttttgcctcttcacaaattcatcctgattcccatca

SEQ ID NO: 701 - DNA, 301 bp, Cicer arietinum
acggtaagccgaggggcacagaggccggaatgtcgcaggctcgcgaagccgaaatgtcgaggtgagaagaagtcgtagataagacaaatgaaatggtgcccggaggcgatgtcaagagctcgcgaagctcaatgtcgttgcagacactcgttgcgaagaaaggtcaactctctgaatccctttcttcaggcagctgttagggtcccgttagccccacagctgcttttgttgccattttagcctgcaaaaattctctaccctagcagagcgctaacagcgggtgccaaggaaaactttttac

SEQ ID NO: 702 - DNA, 293 bp, Cicer arietinum
acgaatacgaaccgtgaaagcgtggcctatcgatcctttagtccttcggaatttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggattagaccgtcgtgagacaggttagttttaccctactgatgacagtgtcgcaatagtaattcaacctagt

SEQ ID NO: 703 - DNA, 184 bp, Cicer arietinum
agttgagattcctttatgaggaaaattttctattgctagttatttaaatatttctgtgaaaattcattccatttttaatgcattattgcttttggattcgggtattatgtatggaaaacacatagcccatgagttaataattgttatattaatcaattgaatggtgatttttttttttgaaaca

SEQ ID NO: 704 - DNA, 238 bp, Cicer arietinum
attaatgtgttaactggatctcaaggagaaattagacaacaatgtaactttattaatggaaactctgttgaccttgctactactgtgactagagagtcgtcagaagatggcatcgttagttcatactaagtaatttaattagcaaaagtaaggaacctaataaagattaaagagtgtggtctatcttctagaggcatatacatgccctgttcttgtggtggatggtgataggttttgt

SEQ ID NO: 705 - DNA, 238 bp, Cicer arietinum; identical to SEQ ID NO: 704

SEQ ID NO: 706 - DNA, 237 bp, Cicer arietinum
acaccaaacctaacgtcaacacgatctccaacaccaaagcgggacccactccaactccagctgaaagtgagaatgctggaacagacaaaccagtagcgaagacgaggagcaaggaagcgacgatggatccgaggagttgagcgataatgtaaacgataccacggaggagggtgatgttaccaccaacgaaggcaccgaaagtgacggcggggttaatatgaccaccggagatattgg

SEQ ID NO: 707 - DNA, 342 bp, Cicer arietinum
actaaatactaattcctttagaacggtatatattctatactaattatttataaacatacaataggaagaaattaaaagccaaaattaaagtaactttaatatgcagttactataactttctatagtatattagcaactaattaactacaacgtaacgtttcctagcttaattagctagctagacatacaatcgatccctcaaccaaaaaatacaatggttgatggggaattttcgatcaatcgatctcttgtgtttttaacaataataatcaacatgctgcagggggattgttgaaatgattgtagaaatgagaattaggagccatggtgaaggcagtgatc

SEQ ID NO: 708 - DNA, 358 bp, Cicer arietinum
acatgttaatttttatgtgtgcgtgcttggaggatcatgcgtccacatcatttaagagtatcacctttcttgaagtggggttggatgttttcttacatgctaaaaaagggtacactagctttggaagaagaccacaaactgctttgtgcagctgctcatcaccaatgttgacttgaattggatttccaagcagattcagggcctgaagtgagttgtagttagctacaagctgccctaatgctttggtcgtcgtgatcttgttaaagctcaagtccagaactgttagcttcaataacctgtgtagcccctcaacatcacttatcttgtttccagcaagatatagctctttgaccagtgt

SEQ ID NO: 709 - DNA, 300 bp, Cicer arietinum
acgaccgcatcatgggttacatcaaggctggtaaggacgagggtgctaccattgagaccggtggtgagcgcctcggcaacaagggttacttcatcaagcccactatcttctctaatgtccgccccgacatgaagatcatgcaggaggagatctttggccctgtctgcgccatttccaagttcaaggacgagaaggaggtcatcgaccttgcccacgacaccgcctacggtcttgctgccgccgtccacaccaagaacctcaacacagctctccgagtttccaacgcattgaaggctggta

SEQ ID NO: 710 - DNA, 436 bp, Cicer arietinum
actgcccagagaacctcttcttctttgcagcctcggctgccgcccggaacacgaccgggcttcgacaatatgtctcactggctaagaccactagacaaaaccgctgggtcgaaatggtatagagcttacctggagaccgtggaatgaggcgactacctcgtccacagagcagcgttctagccgccttggggttttctcctgcgagggttttccccaaggatgcacggttctagggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggacgctgctggagggaagctctgc

SEQ ID NO: 711 - DNA, 343 bp, Cicer arietinum
gattagcgtggtccggccgaggtcaagaacactgttttctcatggctcagaaacattttccatgactgtgctgttcagagttgtgatgcttctttgttgctgacttccacaagaagaagcttatctgaacaagaacatgacagaagctttggtttgaggaatttcagatacattgatacaatcaaagaagctgttgaaagagagtgtcctggagttgtttcttgttctgacatccttgttctttctgctagagatggcattgtttcgctaggaggaccatatattcctctgaaaacaggaagaagggatggtagaaagagcagagtggatttattggaagagt

SEQ ID NO: 712 - DNA, 433 bp, Cicer arietinum
accctagtcctaccaactccataatctttggaagcaaggggactgagttgatggcacctacaagaattgaagataaccaaacagcaactaaagctccaccaccatatacaagcactgtggacttgttttcaactccatcccacttctccttcaaatctgaaaacaactcgttggcatcaagagaagtagatgtttcatctgaagaagaagctctagtctgatgcagagaaaacttccggggctctgaaaagtgtttaaggaaaggggaagaagaagaagaagaagaagaagaatgggtagtggagaggcgaggagggagatatggcaaagcagagcatcgtgtaacgtggttagttttgagaagccgaggaagaggagggactaacaccgtgcttgtgcttgctgccaccgccattctcttctttctttttct

SEQ ID NO: 713 - DNA, 440 bp, Cicer arietinum
cactgttagtgcactgttaggagcgggattttctacgggctactcggccacacgatactgcggggacgccatcggctccctaacagcagttttcagagaaggaattttggagagttcaccttctctgacaacactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctga

SEQ ID NO: 714 - DNA, 445 bp, Cicer arietinum
ccatgttcgctgggagaaggatgaaaccggcaagtttcaatttaaggaaattgagggcagtgaagagattattgaggcagacatagttttactagccatgggattccttggtcctgagtcgaatattgcagagaagttgggtgtggagcgagacaacaggtcaaacttcaaggctgattatggtcgcttcccgaccaatgtgaatggggtgtttgcagcaggtgattgtcgccgcggtcagtcgttagttgtatgggctatttcagagggaaggcaagctgccgcacaagtcgacagctacctcaccaaagaagaccaagaccataatattgatgggaatcaggatgaatttgtgaagaggcaaaaagatctcaacaagaagcaccaggacagtggcattcacacagtgatgacataggatatgtcttctgtgatttttatgttg

SEQ ID NO: 715 - DNA, 391 bp, Cicer arietinum
accattcgttaccgccgtcgatgatgcagtcaccgggctccatatgatcggagagagcggcgatggtttggtcgacgggattgccagctttgacgaggatgatgactgatctaggacgttggagagagaggacaaattcgcgggggctgtattggccggttaacgggagagaaccttcacggtgggcccgatctacggtttcgtcgactttggaggttgtgcggttgtagacggaaatagggaagcctttttcggcgatgtttagggctaagttttggcccatgacggctagtcccgctaagcctatgcgagagagagtggaagaatccattgttgttgaattttgagggaggggtgagagaggggtttggtgaatgcttaattcaatttc

SEQ ID NO: 716 - DNA, 442 bp, Cicer arietinum
atgaacagctggagaagattatgaagaccgaacgctttaagcctgataaaggatttgcaggggtttctgaaagggcaggtccaagggatagaccggttgagtttgagagtgaagaagctgatccgtttggtcttgaccagtttttgactgaggtcaagaagggtaagaaggccatggaaaatgtaggtgggggaggaactatgagagctagtgctggatcttcaatgcgagatggttcggagggaggttctggcaggactcggattggatttgaaagagggcgttaagcggatcagtgtaatggcttattgatatcatgcttaagttggtatgccttgatgtggatggtaaagataacgtggttgagtcatcacataccttttgttgccctccccaagggatcaccttataggtgttgaaatgaacttgtatttttgtttcc

SEQ ID NO: 717 - DNA, 199 bp, Cicer arietinum
actaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatccaaaagcaacgtcgctatgaacgcttggctgccacaagc

SEQ ID NO: 718 - DNA, 441 bp, Cicer arietinum
actacccaaatattaagaattggcacattgatagctatgggaaatcagaagagttccatccaccaaaagttcatttgcattgcaatcctggccaagctatctcttctattaaatttgcaagctttggaactcctctgggaacttgtggaaattatgaacaaggagcttgccattcttctgcatcctatgccatcttagagaagaaatgtataggaaagcaaagatgcatagtaactgtatcaaacagtaactttggtcaagacccgtgtccgaatgtgttgaagcggttatcagttgaagctgtttgcgctccatctactaccaccaattaaagggactgattggttatcaaagcaccatttttaagtgtaatttgaagtcacttattaaccaggaaagttgaaagaaaaataagcggagaataggtaaagtgagtgccat

SEQ ID NO: 719 - DNA, 278 bp, Cicer arietinum
actttgaataagaaataagccagttcacagaaggaaaatgcttcctctgagcaagctttttgtccaatccccagaaaacctgaactatgctgagggttgcagatgtcacgggatctgagaaatctcctccaggtggagaaacagcaccaacaattgttacactacctgtccgttcaggacctccaaggcattttactttcccggcacgttcatagaaagaggctaaacgtgcagcaaggtaagccggatatccactatctgcaggcatttccgccagt

SEQ ID NO: 720 - DNA, 440 bp, Cicer arietinum
cggcagcgagtcaagactcggtctcgtgtgaagcgatcgaacttagccaagccgaagttaacaactgataatgaggaaaaaagtagcaataacaaaggaattgaatccggttctgttgaaccggttgaagaagtgatgaaccggtccgcgagtcatgaatcatcgctaagccaccagtctgaggcggtaaatgcggcggcggtggatggagagagtaaagagagtgatgaaagtatggcttcggttgaaacggctgagacttcgatgaacttatttagagatgaaccggagtcaaccagagatttgaaacgggtggaccgaaccggtgaaagtggagaggaaaatgttggtttagaattgactcttgggtttgaaccggtttcacgtgttcatcacgtggttcctgtgaagaaaagaagagttgaattgaaagattgtgg

SEQ ID NO: 721 - DNA, 429 bp, Cicer arietinum
aaacatctaactcttgttcctattcatcacctcaactaatttcttttgaacccctcaatgcaccacaacaattttacaacttggattattccgatctaaagcctaaaatagagaaaattacaggtttggtttctcaaggttcatatgaagaaaaaatattatcaaattatgataaccgagcgaatcagaccatgagaaactcaactcaagctcaagaacatgtaatggccgaaagaaaacgaagggaaaaacttacccgaagtttcattgctctttcggccctcgttcctggcctcaagaagatggataaggcttcggtgttgggagatgcaataaagtatgtgaaacaactaaaagagcgtttgcagagtctagaagagcaaggaacaaagaaaaaagcgattatagtgaagagatcttttattttac

SEQ ID NO: 722 - DNA, 222 bp, Cicer arietinum
acagagcttacatggagaccgtggaatgaggcgactacctcgtccacagagcagcgttctagccgccttggggttttctcctgcaagggttttccccaaggatgcacggttctagggttgcagctactggcgatcttaggggatcatggacttcctgcctcagggtatggaaagctacttgatctatccgtgcaggagaattctacgctggggaggaatagt

SEQ ID NO: 723 - DNA, 250 bp, Cicer arietinum
cggctccctaacagcagttttcagagaaggaattttggagagttcaccttctctgacaacacctttgtcggatctaatggcggcacctcagaaccagaacgccttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgaca

SEQ ID NO: 724 - DNA, 297 bp, Cicer arietinum
acatttgtcactaactacacttactttgtaaatacaatactagataaatacatggcatacaaaaaggaaatgtgatttactgcatgtttggcagaatcacagtgtcacaatatctcaacaaaaagttacagacattatgaagtttcaacaaaacatgcactaaattactgacagcccatactatgatttcacagcataaaatcagaagcacttttaccaatacttccaaacgcaattcggagaagcaaaactctttgctactcataagttcaccaacaacaatccaaacatccatca

SEQ ID NO: 725 - DNA, 421 bp, Cicer arietinum
acgacactgttcatggtcaatggaagcattttgaccttaaggttaaggactctaaaacccttctctttggtgagaagaccgttactgtttttggaactaggaaccctgaggagattccatggggtgaggttggagctgattatgttgttgagtcaactggtgttttcactgacaaggataaagctgctgctcacctgaagggtggtgccaagaaggttgtcatttcagccccaagcaaagatgcacccatgtttgttgctggtgttaacgaaaatgaatacaagccagagcttaacattgtttccaatgctagctgcacaaccaattgccttgctccccttgccaaggttcttaatgaccgatttggaatcgtcgagggtcttatgaccactgtccactccatcacagctacccagaagac

SEQ ID NO: 726 - DNA, 408 bp, Cicer arietinum
acattgagaagaagaaaaactataagaaaaagaaaggggtcaatcggagtcgccacaataaaaagtgccatttcagtgtcatactgtctttagttatcgttgccaaggaaggcaggcaaaatgcaaaattatatcttgtgaatcatcatcatcaatcatgccagcgttaagctttagcctaatgtggagaatggaagccatcgtccagctcactgacaatatagttacatagctcgagaatgttaattaagccttcccacccttatgaggtggagttccaggtcttgatgtgttattgccaaatccaactttccctttcttatcagaagacttaagtatctggaacgagcatgtcaaggtgtcatctacactcatcatagcaccagcattatcaaattccccacagta

SEQ ID NO: 727 - DNA, 324 bp, Cicer arietinum
gatttcgagacggccgccgggcagggactattaattaacggcagaacagactgctttacaactgtcaaaataaataaaaagctaagatacctaacagcttaaagaaattaaagaaaagaagacaccataacaatcttatcaccatataatagaaaaattaacgccttttctttcctgaagacaaaacgcggaaactttgcttcccttttttctctttcgatgtatcttccttccatcactttctttattttcatatattcttcataatctttcatagagagctatggtaataaaccactattattgtttactatctaatagtgg

SEQ ID NO: 728 - DNA, 169 bp, Cicer arietinum
accaacagcaaggacaacaccgagaaggacggacataccccagagcttggggaggttccacttgacgggagtctgggagaagggagcgttgtcgtaagcaatggcaagagtagcaatatcagcgaagatagcaatgaaaacgacaagctcaatgttcaagctcctgttg

SEQ ID NO: 729 - DNA, 431 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactcctccaaaattccttctctgaaaac

SEQ ID NO: 730 - DNA, 436 bp, Cicer arietinum
cggcagcgagtcaagactcggtctcgtgtgaagcgatcgaacttagccaagccgaagttaacaactgataatgaggaaaaaagtagcaataacaaaggaattgaatccggttctgttgaaccggttgaagaagtgatgaaccggtccgcgagtcatgaatcatcgctaagccaccagtctgaggcggtaaatgcggcggcggtggatggagagagtaaagagagtgatgaaagtatggcttcggttgaaacggctgagacttcgatgaacttatttagagatgaaccggagtcaaccagagatttgaaacgggtggaccgaaccggtgaaagtggagaggaaaatgttggtttagaattgactcttgggtttgaaccggtttcacgtgttcatcacgtggttcctgtgaagaaaagaagagttgaattgaaagatt

SEQ ID NO: 731 - DNA, 317 bp, Cicer arietinum
acatttctaaaaagaaagtttgacatacaagcattaacagttttcttgtccctgcagttcattaaggatgtttcaatcacatctcatcctaaacagcatctctcaccctaaaccgcattatctaattaattgtctataaggtccaaacaagaagaatgtgaaaacagcaagttttatgaagaaaaaaaccgttgttatgagtcttcaaaatgatgatctgtctcatcaaagatctcctcctgtaaaagctcttcaatgacatcttccattgtaattattccaacagcttcttcttcttcaggaatatttggaagggg

SEQ ID NO: 732 - DNA, 437 bp, Cicer arietinum
accctcgcgctatgctgtctcaagaagcctgatcctgcaaccggttgcaccactggaccattttgtccattttgccgaggtgccattcttcagttaatcgttgccaagatcaagactagtagtgatacagaagaagtggaatccagtccaacaacaaaaccgaagaagtcaagaagatcaaatttcagcgaagggagcagcagcttcaagagtttatcagccatgggctcgtttggaaggattgctggccgcaattcaggaaagattgacactgaagagcaatgagggatttgttaagtcttgatgatttctgttggtggcttctttgacatatgaatggtgattttacacgtgctgtggaatatctacctatagtagcatattatttgagctcattttttccattgtccgaaggattgttaagatcatgcaagaca

SEQ ID NO: 733 - DNA, 317 bp, Cicer arietinum
ccaaagtccttgctgtctacaaggaggttattgctgatctcaaggcagctggtgctctatttatccaatttgatgaacccacccttgtcttggatcttgaatctcacaagttgcaagcatttactgatgcatacgcagcactcgcaccttctttctctggtctgcatgtccttgttgagacctactttgctgatgtccctgctgaggcatacaagaccctcacatctttgagtggtgttgccgcatatggatttgatttagtccgtggacctaagactcttgaattgatcaaggctggatttcccagtgacaaatgg

SEQ ID NO: 734 - DNA, 258 bp, Cicer arietinum
  misc_feature (54)..(54): n is a, c, g, or t
  misc_feature (250)..(250): n is a, c, g, or t
acaacactagtagctaacacttcaaacatgccgggtggctgctcgtgaagcttncatttatcgaggaatcactttagctggagtattttagagatatgggttacaatggtcagtatgatggcagattcaacatctcgatgggcagaagcattgcgtgaaatctcaggaagactggcggaaatgcctgcagatagtggatatccggcttaccttgctgcacgtttagcctctttctatgaacgtgccgggnaaagtaaa

SEQ ID NO: 735 - DNA, 196 bp, Cicer arietinum
aaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgcctta

SEQ ID NO: 736 - DNA, 320 bp, Cicer arietinum
gcatgggggactctcacctgaacttaaaaacttagatcagatacggaatattgctcgccccgttgatgtgccagatcatggccttctctgtgaccttctgtgggctgatcctgataaagatcttgagggatggggagaaaatgaccgaggtgtttcattcacatttggagctgataaggttgttgagtttcttgagcagcttgatcttgatctgatttgtagagctcaccaggttgtagaagatggatatgagttttttgccaaacgtaagctggtgactgtattctctgcaccaaattactgtggggaatttgataatg

SEQ ID NO: 737 - DNA, 407 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctccagg

SEQ ID NO: 738 - DNA, 232 bp, Cicer arietinum
ccgggcaggtaccgttgtttccttggtggtctatcctggaccaccgacagcgaggggctaggcgaaaccttctcttcctacggcgaagttactgattccaaggttattaacgaccgtgagactggaaggtcaaggggttttggatttgtgacgttttcaactgatcaatccatgagagacccaattgaagggatgaacggtcaagatgttgacggacttaacattaccgtga

SEQ ID NO: 739 - DNA, 260 bp, Cicer arietinum
acaggatacccctcttccttcaccatccaggataccaaggcacaaaaggcgctgtttttgtcaagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaa

SEQ ID NO: 740 - DNA, 389 bp, Cicer arietinum
ccggcaaggactggagaggtggaagagctgcttccttcaatattattcccagcagcactggagctgccaaggctgtaggaaaggttcttccagaactgaatggtaaattgaccggaatgtctttccgagtccctaccgtcgatgtttcagttgttgacctcactgtaaggcttgagaagaaagcaacctatgaacaaatcaaggctgctatcaaggaggaatcagagggcaagttgaagggaattttgggttacactgaagatgatgtggtatctactgactttgttggtgatagcaggtctagtatatttgatgccaaggcaggaattgctttgaatgataactttgtaaaggttgtttcttggtatgacaacgaatggggatacagt

SEQ ID NO: 741 - DNA, 447 bp, Cicer arietinum
acattcaatagcacgatccacgcctccgttggtcatttcagcaattacttgttgcacgggtttgtcatgctcttttgggtttacaaactcattgaccccaaacttcttagctaattcaaatcggctggaaactaaatcaaccccaatgattcttgatgcaccagaaatccttgccccttcagcagcagcaaggccaacagctccaagtccaaagataacaacagaggaacccggtttcggtttagcaacattgatagtagcaccaagacctgtgcatattacctcggccgcgaccacgctcgagcggccgcccgggcaggtaaaattctttcttggcacccactgttagtgcggtgctaggagcgggattttctacgggctatgcgactacacaaaactgcggggatgctatcggctccctaacagcagctttcggagaaggaattt

SEQ ID NO: 742 - DNA, 245 bp, Cicer arietinum
gccagcaaacactaaattatcaagcaacaagacagtcaggaggatccgtgttcgagggggtaatgtgaagtggagagctcttagattggatactggtaacttctcatggggtagtgaagcagtaactcgcaagactcgtcttctggatgtggtttacaatgcctcaaataacgagcttgtccgaacacagactcttgttaagggtgctattgtccaggtggatgctgcaccattcaagcagtggt

SEQ ID NO: 743 - DNA, 351 bp, Cicer arietinum
actggctcaccgagcgcaccttcggcgagttctctcgcagcttcaacttccccactcgtgtcgaccaggacaacgtctctgccaagtttaaggacggtatcctgagcattgttgttcccaaggccgagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgtaggcctggcttggtcattcgctccttgtacctgcccgg

SEQ ID NO: 744 - DNA, 238 bp, Cicer arietinum
acaaaacctatcaccatccaccacaagaacagggcatgtatatgcctctagaagatagaccacactctttaatctttattaggttccttacttttgctaattaaattacttagtatgaactaacgatgccatcttctgacgactctctagtcacagtagtagcaaggtcaacagagtttccattaataaagttacattgttgtctaatttctccttgagatccagttaacacattaat

SEQ ID NO: 745 - DNA, 399 bp, Cicer arietinum
tcagaaatgtagccaaaggaacaagatgtctcattgggagcaaacaaatacccagagagacaaccaattggtatagcagctcagagccaagacgatggaaaagactacaaggaaccaccacctgcaccattgtttgaaccatctgaactcacatcatggtctttctacagagctgggatagctgagtttgtggccacttttctgtttctttacataaccatcttgacggttatgggtgtgaacagatctgactcaaaatgcaaatctgttggtattcaagggattgcttggtcttttggtggcatgatatttgccctcgtttactgtactgccggaatctctgggggtcacataaacccagcagtgacattcggattgttcttggcgaggaaattgtcg

SEQ ID NO: 746 - DNA, 400 bp, Cicer arietinum
acaaccctcagactattggttgggactattacaaggctagtgtttattgtgctacatgggatggtaaccagcccttgtcttggagacaaaaatatggttggactgccttttgtgggcctgttgggcctcaaggcagagattcttgtggcaagtgcttgagggtgacgaataccgcaactggaagtcaggtaacagtgagaatagttgatcagtgctccaatggtggtttggacttggatgttaatgccttcaatcaacttgatactaatggacagggcaaccaacagggtcaccttactgttaactatacctttgttaattgcggtgattaatttctatattacaacctatctactatcaataaatcaatcgctctttgtgatcaataatttattaatgt

SEQ ID NO: 747 - DNA, 358 bp, Cicer arietinum
acgggagatgtagtgacggttgagctcgaggagaatcgattgatcaatcgcacaaccggaaaggagtataagttgaagcctattggagatgccggtcctgtcattgaagccggtggtatctttgcctatgctaggaaaaccggcatgattcctactcgatgagagaaagtcatgttggcagcagcagatgttttgggaggctgactagaattgtttgttcgcctgcattcaaggattctattcagattctctaatcatgcagcttttataaaaatgagtattgtaatttggagttagaattgttaactattttaggaatataaaatgtcaaggctttctattagaacatttgaaaggt

SEQ ID NO: 748 - DNA, 347 bp, Cicer arietinum
  misc_feature (347)..(347): n is a, c, g, or t
actcggatattttagagatagatggtagcccccttccaatattcctgaagaagaagaagctgttggaataattacaatggaagatgtcattgaagagcttttacaggaggagatctttgatgagacagatcatcattttgaagactcataacaacggtttttttcttcataaaacttgctgttttcacattcttcttgtttggaccttatagacaattaattagataatgcggtttagggtgagagatgctgtttaggatgagatgtgattgaaacatccttaatgaactgcagggacaagaaaactgttaatgcttgtatgtcaaactttctttttagaaatgacn

SEQ ID NO: 749 - DNA, 424 bp, Cicer arietinum
accgttttggatgggaatttgaagctcagagtgttgtcgacgatgttaagaaaaatccagaggcgtgttcgagtggaattgttcttcggagaagattgcaacttatgatgtataatattatgtataggattatgtttgatagaagatttgagagtgaagaggatcctttgtttgtgaagcttaaagctttgaatggtgaaagaagtcgtttggctcaaagctttgagtataattatggtgattttattcctattttgagaccctttttgaaaggttatttgaagctttgtaaagaggttaaggatcgtaggttgcagctcttcaaagactatttcgttgatgagagaaagaaacttggaagcaccaagagcaccaccaatgaaggactgaaatgtgctattgatcacattttggatgctcaaca

SEQ ID NO: 750 - DNA, 427 bp, Cicer arietinum
cagctacggctcctgctcctatatcttcggcgactgctacggaaggttccgatgtctacgggcaggcggcatccaatctagttgccggtagcaacttggaggaaacagttcagcaaatcctagatatgggtggaggaagctgggatagggatactgttgttcgtgctcttcgagctgcctttaacaaccctgagagagctgttgaatatttgtattcaggtatccctgaacaagctgaagctccagcagcgtctcgagtgcctgcaagtgcgcaacctgcaaatcctgcagctgcagctcctcaagcagcacaacctgctcctgttacctcaagtggacctaatgctaatcctctagacctctttccccagggcctcccaaatattggttctggtgctgctggtgccggctctctggattttcttcg

SEQ ID NO: 751 - DNA, 435 bp, Cicer arietinum
gggggatttggttttactaagaagaatgaaataataaacggtaaagcagctgttattggatttcttctgttgttggattttgagcttttaacaggtaaaggtcttttgaagggaactggtttcttggactttatatattctgcctctaatgctctcaattagaggttgatggatgtttggattgttgttggtgaacttatgagtagcaaagagttttgcttctccgaattgcgtttggaagtattggtaaaagtgcttctgattttatgctgtgaaatcatagtatggactgtcagtaatttagtgcatgttttgttgaaacttcataatgtctgtaactttttgttgagatattgtgacactgtgattctgccaaacatgcactaaatcacatttcctttttgtatgccatgtatttatctagtattgtattta

SEQ ID NO: 752 - DNA, 382 bp, Cicer arietinum
accaatccacaggaatatccaatatatgattttacatacgaatttcaaaacaaagaaataaaggaaggtttgatgatttcatgaatgcaaaatgattttgacctaataaaaccaactgacaacaaaacagaaatgcataatgtgaataggaagtagcctctcccatcctgggtcaacaatcacaaatgactccaagaatagaaaagcaactatgcatagaaaaagtaatatagatgataaacagactagggatacacagtgaggtgatggaaaaaaaatgactcaagaagatgcagggttaaaagtcagaaaaaggaagagaatatctagaaacaaagcacttaggtggtgttgatgaaaaccagttgaaccctgggagttc

SEQ ID NO: 753 - DNA, 182 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctca

SEQ ID NO: 754 - DNA, 431 bp, Cicer arietinum
gaaaattcattctcaagtttagtgttacaaaggtaactttagaagagtcacaagaccactgggtggcgttgattgagatagttaatgccaagacatggttttttggctgccaatcttttcaatttttaggttcacagtctgtcattttttgcttccttgaggagcaaatattctatcaaaatgaagtcctattcctaggtttaatctatgtttttattttatttctttttattctggggtagaaaaagaagttacaaaagggtcattggatttaattttcctcaagtctccattttggtccagttttggggatgatacaggatttggatgtgatatttctcatgtaattttgaaccaataattgtggatgccaggggttggttattcagggacatttgaagaccgatcctttgggcatgtaacattcaata

SEQ ID NO: 755 - DNA, 105 bp, Cicer arietinum
acagttttaccgattattacaagagacatatggaaaatccatatggaagattaaacatgaacaaagttcaaagtaaaacgacgacaaccaccaaaaccaatatgc

SEQ ID NO: 756 - DNA, 304 bp, Cicer arietinum
acaaggctagctctaacttctaagctgttagtgtaagcttagagtgttgagttggcgagagttgtgtatcagaattatgtggcgcgttcatgtgctgaagtatttggcggcaagtgtaggttaggcagctggctgctttgactgggaacttgttgatgagatacttgagcactgaaggaccatatcactgaatgacgatgtgagatgggagtatagtttcttcttcaagtaccataccatacacacaattacacatatctgcttcaagctttcatttgttataagcacctcacttgcagttgca

SEQ ID NO: 757 - DNA, 433 bp, Cicer arietinum
actattaattaacagcagaacagactgctttacaactgtcaaaataaataaaaagctaaaatacataacagcttaaagaaattagagaaaaaaaaacacaataacaatcttatcaccatataatagaaaaattaacgccttttctttcctgaagacaaaacgcggaaactttgcttcccttttttctctttcgatgtatcttccttccatcactttctttattttcatatattcttcataatctttcatagagagctatggtaataaaccactattattgtttactatctaatagtggtaaggaggaggaggtgaggaatagaggtaaggcttcttggttggagttggtggtggagagtggtaaactggatgtggaatgtatgggggagaagtatgaactggtggtggaggtgagtgataaactgggtgtgga

SEQ ID NO: 758 - DNA, 380 bp, Cicer arietinum
actgatggaagcagcaagatcatttgcccaaatgttccttccatcaaccactccagcaaagatccatttgtcactgggaaatccagccttgatcaattcaagagtcttaggtccacggactaaatcaaatccatatgcggcaacaccactcaaagatgtgagggtcttgtatgcctcagcagggacatcagcaaagtaggtctcaacaaggacatgcagaccagagaaagaaggtgcgagtgctgcgtatgcatcagtaaatgcttgcaacttgtgagattcaagatccaagacaagggtgggttcatcaaattggataaatagagcaccagctgccttgagatcagcaataacctccttgtagacagaaaggactttgg

SEQ ID NO: 759 - DNA, 313 bp, Cicer arietinum
acagcccaaaatggccctttactaagatatacagcttctctagctgctagagtaagtatatcagcacatgacactgtggatggacaagcattttctaaatctgactttattttatcaattacatcaaaccctcttattgaatttttattaggcaatgcatttttctcccctgttagtgtgtttgtatcatctagcaacacagatgcatcacatccaatgacaaaacaatcatggaaatggagtcgcaagagagaggcagctatccttgtatcattggccatagctgaccagacattgtatctaacaattctag

SEQ ID NO: 760 - DNA, 353 bp, Cicer arietinum
ggtgttggaacatgatgtggtggcagagaaagtgagtaatcacaagggatgctgcaaatcagggccaggttatgcttctcctcttgaagccatgtctggtcccagagagactctcatttatgtcactgctgtctattcaggaacaggaatagagaagcctgattatttggctacagtggatttggatccaaactctccaacttattcaaaagtgatccatagactacctgttcctaatttaggtgatgaattgcatcatactggttggaattcttgtagctcttgctttggagacccatcggcacagaggagatttcttattgcacccggtcttgtatcgggtcgcgtacctg

SEQ ID NO: 761 - DNA, 413 bp, Cicer arietinum
ttcggcggtaccatcttcttcaacaaggaacacaaaaagtagagtcttttttattgaaatccacaatcaaatatgtctggtgaagaaggtgttgttgcagtcgaaccagttgttgctgctgcggctgctattcctggtgagccaatggataccatgactgctgttcagcttgtgctgagaaagtcccgggcttatggtggccttgcacgaggtcttcatgaaagcgcaaaggtgattgagaagcacgctgctcaactctgtgttctagctgaagactgtgaccaacctgattatgtcaagttggtgaaagccctttgcgcagagcacaatgttagcttattgactgttccaaatgcaaagacccttggagagtgggctggtttgtgtaacattgattcagagggtaaagctag

SEQ ID NO: 762 - DNA, 276 bp, Cicer arietinum
gttggatcactgctcctggcatgcctttcaacccgtttcctcgggtaccgggacatccacgggataacaaagactgtcaaccttccagtatggaaattgatcagcctgctgaagttaagcaatcggacgccactggtccggttaattgctgctcagatgatatgattcccagcacaactggtgctaactctgaagacacgaaccttcaatgtgaggatgctaaacatgacgctaagcgattgaagggtgaggagtctgatgatttgggaaagaagt

SEQ ID NO: 763 - DNA, 364 bp, Cicer arietinum
  misc_feature (261)..(261): n is a, c, g, or t
  misc_feature (298)..(298): n is a, c, g, or t
actattaattaacagcagaacagactgctttacaactgtcaaaataaataaaaagctaaaatacataacagcttaaagaaattagagaaaaaaaacacaataacaatcttatcaccatataatagaaaaattaacgccttttctttcctgaagacaaaacgcggaaactttgcttcccttttttctctttcgatgtatcttccttccatcactttctttattttcatatattcttcataatctttcatagagagctatggnaataaaccactattattgtttactatctaatagtggnaaggaggaggaggtgaggaatagaggtaaggcttcttggttggagttggtggtggagagtggtaaa

SEQ ID NO: 764 - DNA, 210 bp, Cicer arietinum
acgacacaagaatcttcttagtctacgtggctattgtgctgaaggccaggaacggctaattgtatatgactatatgccaaacttgagcctgctctctcaccttcatggacagcactcggcagaaagcctccttgattggaatcgacggataaatattgcaattgggtctgccgaaggaattgtatatcttcacaacctagcaacaccgca

SEQ ID NO: 765 - DNA, 282 bp, Cicer arietinum
acttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaa

SEQ ID NO: 766 - DNA, 385 bp, Cicer arietinum
acattgttcaatcatgaccatcaaggactgacgccgcaatcctttccaatgattcagatgccttgtgaagatcagactctgaatgccctgcagaaacaaacaatctaattcctacaggcaatcgacacttgtccaatgttgatcttctggaagccaccacatatacagaatcttctttcaaaacgcgctcggcaatattttcaagcagatgtaggtcatctttcaaagaacccgttgacttctttaatctcaaataaacaattggtgactctggatgacttgcaattgtgaagcctggtattttcaacagccctttccataacacagcaatgttgttcttcaacttagttaacagattggaattttcctcaaggacatcaatagc

SEQ ID NO: 767 - DNA, 216 bp, Cicer arietinum
acataagaagacatcacaaacatgatcctagggataatcagtgttcttctgcacttgtcaaacacataaaagcccctgttcatcttgtttggtctttggttagaagatttgatcagccacagaaatataaaccatttgttagcaggtgtattatgcaaggagaccttggcattggaagtgttagagaagtgaatgttaaatctggtcttccagcta

SEQ ID NO: 768 - DNA, 143 bp, Cicer arietinum
gatgttcaacaccgtttgttcactggaattatacaaaaaagcaattcaatttgaaagctaataaaatatacaaagtttagctgacataaaaagtgtagacaatactagtaaccattaactaaagcattgagttaatggaactt

SEQ ID NO: 769 - DNA, 424 bp, Cicer arietinum
tagcggccgccgggcaggtacccaaatgaagattggttgcacttaactggtcttatccatgatcttggtaaagtgcttctccttcctagttttggaggacttcctcaatgggctgttgtaggtgacacatacccagttggttgtagatttgatgaatccattgttcacaacaagtattttaaggaaaatccagactattacaactctgcatacaatactagatatggaatttactctgagaaatgtggacttaacaatgtgatgatgtcatggggacatgatgattacatgtatctagtggcaaaggagaacaatactactctgccttcagctgctttgttcattataagataccattcattctatgccttacatagagaaggagcctataaacacttgatgaatgatgaggatgttgagaatc

SEQ ID NO: 770 - DNA, 364 bp, Cicer arietinum
acccagttacaaactacaagaatacacactaagccaaaatgtatacatatctattagcatcaacctttcctcaaattctcaagaacgggagaataaagctagctcatcttgaaatgcatttgccgatactcactcttgtgaagccgggggagctctgtaataagctggaacagtggcagggaaaaacatttggcgaattccttcagccttaattatgggtaagataattccagatgcaccagagattaacctagctccgatccacatccgtttaggtgaaggaaagggtagtagtaaacggccaacaccaaatactgcaacagcaaagaaatggagaaccaagcttaagggtcgagggtttaat

SEQ ID NO: 771 - DNA, 297 bp, Cicer arietinum
acgagctctgtttcgcagtggccagaactaccaccgcaacgttcaccggcatggcggcggcgcttttggaagcttctactggcggaggatgtctactctgccagagaaaaaagaagatcatcagtcagattcagatgagaacaacaacaaaaacagcaaccccgtcgtttccagttactgggggatcactaggcctaaggttcatagagaagatggaactgagtggccatggaactgtttcatgccatgggaaagttacaactcagatgtgtcaatagatgtgacaaagcatcatgt

SEQ ID NO: 772 - DNA, 351 bp, Cicer arietinum
acatggaaactggaaagaaataacaagctttacctaggcgcagagaatctccaatgtaaaatgtatcgctgtcatcgccaatgattccatgaatcacatttacagtagcacacagcaaaacccccagccactgtcttttattaattaatccgaaaacggcgtcatacattaaattacattgcacagcaataattgacaataaagttcacacctcacagactaaccaacttaagagaattagccttttcctgcagggtatccaggaggctttcaaagctcttcttaaatgaatcaactccttcaagttcaagctgggaaccaacagatctccaatcaatgcccaacttctgg

SEQ ID NO: 773 - DNA, 334 bp, Cicer arietinum
cagcgcgtggatcaacgaaatggcgaggattaaggtgtatgagctgaggaacaaaaccaaggcggatttgttgaaccagttgaaagatctgaaggcggaactcgctttgctacgagtggcgaaagtcaccggcggtgcgcctaacaagctctccaaaataaaagttgtgaggctttcaatagcacaagtgttgacagtgatttcacagaagcagaaagctgcactcagagaggtttataagaataagaagtatttgccacttgacctacgtcctaagaagacccgtgccattcgaagacgccttaccaaacaccaggcatcattgaagacagaa

SEQ ID NO: 774 - DNA, 125 bp, Cicer arietinum
acgtgctgcacttgttatgtgtatttgatcaaagaagcaacattgttgtgtgggggtttgaataaaaagagaaacattaaaaccaagctgggagctgctagatagatgaatagtaataataatta

SEQ ID NO: 775 - DNA, 547 bp, Cicer arietinum
atgattacattaaggctctaacaaagaggacacaagagggaggaacagaagttgtggaagctaaggctggaaagggttctgcaactttgtcaatggcttatgctggagccatatttgctgacgcttgcctcaaaggtcttaatggagttccagatgttgttgaatgctcgtatgtgcaatccaatatcatcgccgatcttcctttcttcgcttccaaggtgaggattgggaagaatggtgtggaggaaattgttggcttaggtcctctctcagatttcgagcaacaaggccttgaaaacctcaagtctgaactcaaatcatctattgagaagggaatcaaatttgcctcccagtaatgaaacatgtcatgtttttctgacagcttgctggattttccatttagaaccaactcaaattttgcaaattcaaaacaattgtttgtaatgttgcccgcagaggtggcagctttgttgttttatttagagcaggtatacgcctagatttaataattaaatttgcgaaagcggtttattgctgcagggattga

SEQ ID NO: 776 - DNA, 182 bp, Cicer arietinum
acaaaagtttctgcaatgacttagaaaacaaaatgagaataatgtaaactggttgtctaactctcggtctgctccctcagccttcggatggtgcttcgcacagttacagcactggcagtattcaatgtgtatgcaccaccagctttcacctttccacaatctttgcagccccagataccaac

SEQ ID NO: 777 - DNA, 408 bp, Cicer arietinum
actcaacacaagcaacaccatcttcttctgccttgtgtgccaacattggacctggaatcacatcaccaattgcatagacaccagagacatttgtggcaaatctttcatttaccaaaatgcgtcctatcttgtcggtttcaactcctatcttgtccaaattaagtccagaagtgaatggagttctaccagcggatacaaggacaacatccgcttcgattgtggtctgttcaccaccagctgctggttcaacagttagcttcacaccatcaccagaagtatcaactccaaccaccttggtcttcagcttgaacttcatgccttgcttttcaagagaacgctgaaactgcttccggatttcgccatccatggttggaacaatctccgatgcaaactcaacaacagttacct

SEQ ID NO: 778 - DNA, 410 bp, Cicer arietinum
actcattacccccaagaggcacctctctactcgtagctcgccctacagtagttgtcggtgaagcacgtcccatcggacatcaatacagctgatcttagcagagctttcctccagcagcgtctcccatctagttcatccagcatatcatcggcacaaaggcgcatttactttcaagaggtcatcccgtcagcgggaactattcctctccagcctagaattctcttgcacagatagatcaagtagccttccataccctgaggcaggaagtccatgatcccctaagatcgccagtagctgcaacctaggaccgtgcatccttggggaaaacccttgcaggagaaaaccccaaagcggccagaacgctgctctgtggacgaggtagtcgcctcattccacggtctccaggtaag

SEQ ID NO: 779 - DNA, 120 bp, Cicer arietinum
acacaggtggtttttctactggtggcttgtaaactggtggatactctatcggtggcttgtaaattggtggtttttctactggtggcttgtaaatcgggggattttccacagggggcttgt

SEQ ID NO: 780 - DNA, 205 bp, Cicer arietinum
acagagcttccctggagaccgtggaatgaggcgactacctcgtccacagagcagcgttctggccgctttggggttttctcctgcaagggttttccccaaggatgcacggtcctaggttgcagctactggcgatcttaggggatcatggacttcctgcctcagggtatggaaggctacttgatctatctgtgcaagagaattctag

SEQ ID NO: 781 - DNA, 168 bp, Cicer arietinum
acaaaagtaccattttccattttacacttacattcttatcttagcaatagcattgtaaacaaaggatttaaatgaagatgccaataatatataatccttgcttcgaaaactatatatacctcttatttttcacattttcttaatataacaagttttagaaacgattgt

SEQ ID NO: 782 - DNA, 174 bp, Cicer arietinum
acactcactagctctgtcagtgcctctgatgttgatcaaatcaaccaagtagctggtgttgaatggcatggggagactattgtttatgcttacagatcaggtgaggtgatacggctaccaaaaggggtttcgattccagtgacactaaaggttctggagtttgaacttttccat

SEQ ID NO: 783 - DNA, 120 bp, Cicer arietinum
acaagccccctgtggaaaatcccccgatttacaagccaccagtagaaaaaccaccaatttacaagccaccgatagagtatccaccagtttacaagccaccagtagaaaaaccacctgtgt

SEQ ID NO: 784 - DNA, 400 bp, Cicer arietinum
ggccgccccgggcaggtacaaaaacgagaaccacagtaacacaaaaccataacatgataaataccatagccaaaccactaatttcttaaacctactaaagtgacatgacaaggagaacattcttaatcataaaccccaacaagaagaacttaaatctagactttgaataagaaataagccagttcacagaaggaaaatgcttcctctgagcaagctttttgtccaatccccagaaaacctgaactatgctgagggttgcagatgtcacgggatctgagaaatctcctccaggtggagaaacagctccaacaattgttacactacctgtccgttcaggacctccaaggcattttactttcccggcacgttcatagaaagaggctaaacgtgcagcaaggta

SEQ ID NO: 785 - DNA, 407 bp, Cicer arietinum
accatcttttattggcaattcttgtccctcactttgtgttgtatcaattgtattgttcacactatctttgcttttcccccacaccacagtgtaaagtccacacacaatgataattgctccaattatacttcccaaatgagtttgttcagccaagacaacagcacccaaagcagctgtgataatcatacataaaggactgaaggaagtaacaaagacagggccacgttcccttgtcacaactccttgtatatagtatgccattccagaacacactataccagagtaaacacaagctagaagcctagaatcgaagcctaaagaccaaacactcacgtcacgttcaaatataaaagttgcaatagcaccttcaaagatacccaaaaagcaaatccaagctgtcatacaga

SEQ ID NO: 786 - DNA, 320 bp, Cicer arietinum
ttatgtttaagaatttgcctaggcatcagtttggtaatttgcagagcaagatgtttccggcttatttttcaatggttggtgtttgtatcgccgttgcagtggcttcctttggttaccttcacccgtggaaaacttcatccacaactgaaaaataccaacttggcttcttgctttcttcccttgctttcaatcttgctaatttattcgtctttacgccgatgaccattgagttgatgaaacaaaggcataaagtggagagagagaatagcatcggagaggaagttgggtggtcaaaaaatgttgaagttgcaaagaaaaac

SEQ ID NO: 787 - DNA, 411 bp, Cicer arietinum
actcattacccccaagaggcacctctctactcatagctcgccctacagtagttgtcggtgaagcacgtcccattggacatcaatacagttgatcctcgcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctccaggtaag

SEQ ID NO: 788 - DNA, 328 bp, Cicer arietinum
gttggaacatgatgtggtggcagagaaagtgagtaatcacaaaggatgctgcaaatcagggccaggttatgcttctcctcttgaagccatgtctggtcccagagagactctcatttatgtcactgctgtctattcaggaacaggaatagagaagcctgattatttggctacagtggatttggatccaaactctccaacttattcaaaagtgatccatagactacctgttcctaatttaggtgatgaattgcatcatactggttggaattcttgtagctcttgctttggagacccatcggcacagaggagatttcttattgcacccggt

SEQ ID NO: 789 - DNA, 288 bp, Cicer arietinum
cccgggcaggtactttgcaggtattgcaaagaagctcaaaggatctcagtgatttttattctctatacgtaagcaaaagagtgccgtgttgtgcattacattcagtttccagtatgttcaacaaaataagatgttaattgaaaaagatgaaaaatatctaatgcttatgttcaatattacttgttacaaagtgaatcctcaaatacactgttattgttaataacaagaatttggtaattgttacctttttcattgagatcacagtaggcacaagaaacaattggtgct

SEQ ID NO: 790 - DNA, 320 bp, Cicer arietinum
acaatgatatcgcctgcacgaacaacagtcttggatccatcagccaaaaccatctctaactccccctcaaacacaattccatagtcaagcgatgcagtcctatgattgtgccctgaggaatttggtggaaagtcgacgactcgaattagtgagccgggcgtatagattactggatcggtgccgacaggatctttgtcaacgagctcagctgggtgcttgtcgtttctccagatagtgactgcattgctgccaaagccggaggtgagtttgagctcttcatctgataggattgcagagttctggcccttgtggtgggtgac

SEQ ID NO: 791 - DNA, 405 bp, Cicer arietinum
acagtgtgaagcaaaacaaaagctgttttcacacacaacatttatttcattacaaaactataaattaactttgaactttcaaggaagtaatattaatgaaaaagcatttcattacctatgtagaacaatgtcaagaagttggcccaactaccaacaatagacaaaacccataatccagcaatcaccgagagaaactttttgagatcctttccagaagcaatatcccttaatacagcaaaaacccggttgatctcaattctaagagcagcggcaatctgtaaaacaggttcctcaggaatgtgcacttgtgggatctttggtggtgccttgttgatgaaagtggatgcatttgaccataagaacaatacagccagagcaagtatcgctaagtggcaaaccaaagtc

SEQ ID NO: 792 - DNA, 410 bp, Cicer arietinum
acaaatgattgtttgcattcctcccttaatacacaatgttcaaatatagataatttaaaataaaattattaaaaaattaacatcttatttatagtgaaatttatgtcatctcagctgttgagttataaaggctgagttataaaggcaaataagatatccatctagtgaacatgagaaaacattgctcaggagtatactcaggagctgtatgtcctgaaccttttacagttgcaaatgtcatttgattcgagtaagtccttgtatatcctcccacttgaccatttacaaaccatggcctccaatcatccacaatagagtagtttagagcccttatccatgcttgagtcgaaatgaaaggaacaactagatcatgatccccactgtaaatcaaagaacggtatccttttttg

SEQ ID NO: 793 - DNA, 120 bp, Cicer arietinum; identical to SEQ ID NO: 783

SEQ ID NO: 794 - DNA, 312 bp, Cicer arietinum
acagcagaggatgcaaggctttccaatggactcataggcaatggagtcgaccttatcatctctttgaagatagcaccgtagtccagggatgattctgcttcaatacaaatgcgagccatgattttcacagcaagttcaggataagctccggcagcactttcaccactaagcatgacacaatctgttccatcaagaactgcattagctacatcagttgcttcagctcgggttggccgcggagacttgatcatggattcaagcatctgggtagcagtcaccacaggcttgccaacaagattacacttatatatc

SEQ ID NO: 795 - DNA, 206 bp, Cicer arietinum
actatagcatcttgctcaaagccttttgtaatgttttatgtcatttcttcaagtgtaatttccaagttccattaactcaatgctttagttaatggttactagtattgtctacactttttatgtcagctaaactttgtatattttattagctttcaaattgaattgcttttttgtataattccagtgaacaaacggtgttgaacatc

SEQ ID NO: 796 - DNA, 293 bp, Cicer arietinum
actaggttgaattactattgcgacactgtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 797 - DNA, 264 bp, Cicer arietinum
acaacatctccacgatacatcaagcagcaagccatgtatttcccgtgccttggatcacacttggccatcatgctagcaggctcaaacacagcattggtgatttcaggcacagagagctgctcatggtatgccttggcagcagagatcacaggtgcgtaggacgaaagcatgaagtggatacggggataaggcacaaggttggtctggaactcagtgatatcaacattaatcgccccatcaaacctccatgaggttgtgagtgag

SEQ ID NO: 798 - DNA, 257 bp, Cicer arietinum
attctgatgaagatgaggaaattgcaagctctgatgaagacatggatgacgctgatagcgatgatgatgaggaggatgacagtgatgaagatgctgaggaagagactcctgtgaagaaggtggaccaaggaaagaagaggcccaacgaatctgcttcaaaaactccggtttctaataagaaatcaaaaaatgccacccctgaaaagactgatggcaagaaatctgcgactgctgctactcctcaccctaagaaaggt

SEQ ID NO: 799 - DNA, 433 bp, Cicer arietinum
accttagaaactgaaatgctaattgaattacaaaatttgtgtccacaaaatgaagatggaaacacaactactgttctagactctaactcagatgatttgtttgataatcattacttcaacaatttacaatatggaaagggtcttcttagttctgaccagattctattttctagtgatgatgatgagacaacttcaactactaaaaatttggtccaatattatagtcataatcaaagaattttctttatggaatttgcatatgctatggccaaaatggggaatattaatccacttgttggttttgagggagagattaggaaggattgtagagtggttaattctcaatgatgtattttatggacaaatacaagagctaggaaacaaatgaagcattgcaaatacttcttccaataattggatcagtaaaatatat

SEQ ID NO: 800 - DNA, 249 bp, Cicer arietinum
actgagaagagtaagggctgacataagaaatctagaatcgaaaatgctttgacagatgttcagtatctgttaaaatgtgatgtaaaaacagccgccaccgccgacctatttctttccttcttgtgtctgggggtatctcatatgtttgtaaagaagagaagctcgacctgctcatgcaatatatcgcttcgagatgacggatcgcttggacccgactcgccaaccgtttccgtcccagcttgtggtgcc

SEQ ID NO: 801 - DNA, 422 bp, Cicer arietinum
acaacctatgaaaacaccgtcggcgagttcggtaatttgaacggcggcgagtggattattgtgaccggaataagaaatcatcacatcatgagcgaagaattctttgaagcaaggatgaacatcgagaagagaaggtgaaatgatggcgtttagtgttaagtgtttggctttggagtgaatgaaatcgacaccggcgtcgttacaggtgatgtaaacgtaaccgtcggaatcggtggtgagtctaccggcgagaggagggaagtgagagagagaaattgaaagagagtgtttgagagtggaaattaggttttcaaaggaataagggggtgtagaaagtaaaatacctttttgtatgtagtgacatgaaagcattgggagatcagaaacagagagttttaaaggttttattgatgatttttgat

SEQ ID NO: 802 - DNA, 285 bp, Cicer arietinum
acaaaagtaccattttccattttacacttacattcttatcttagcaatagcattgtaaacaaaggatttaaatgaagatgccaataatatataatccttgcttcgaaaactatatatacctcttatttttcacattttcttaatataacaagttttagaaacgattgtcatcatcggcaggaggataccctgggtggtgaggtggcttctcatatggaggataccctgggtagtgaggtggcttctcatatggaggcccgtaaaccggtggtttctcaactgggg

SEQ ID NO: 803 - DNA, 350 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatggga

SEQ ID NO: 804 - DNA, 400 bp, Cicer arietinum
actggaaatcagaatcaaacgagcttttacccttttgttccacacgagatttctgttctcgttgagctcatcttaggacacctgcgttatcttttaacagatgtgccgccccatccaaactccccacctgacaatgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggaca

SEQ ID NO: 805 - DNA, 423 bp, Cicer arietinum
tcttagcatgctgtgccatcccatatttattcttctttttcggggcaagagtcagaacattctctagatacgcctataccccggaaactaataccaaatagagtaatgctcattaatatataattacacaaagagatccttttttttaaccgttgttttgttttgtagagattagccgtggaagatttagggccgacctcacatgcagcacaaaaaaatttttctctgcattttcaccacctccaaccactataaatggacaagcaattccccaatggtttggggttggattattctgactatcaagcatgtcagataacactactttagacaatatcagtgtcaactccgaaaaagtcgtcgactacaccattcaccatgacgaccgcaaagaactagaaagattagtctcccacaacaagg

SEQ ID NO: 806 - DNA, 408 bp, Cicer arietinum
acctttccaaaaacaacatgccttccatccaaccagctagttgttacagttgtaatgaaaaattgtgaaccattggtatcaggaccagcatttgccattgataaaagtccgggtccagtatgctttaacttgaagttctcatctgcaaacttctctccgtaaattgattctccgcccattccattgccgtgtgtaaagtcacctccttggatcataaagctagggataatcctgtggaatgagccgcctttgtaatgaagaggctttccatttttaccggtccccttttcccctgtgcaaagagctcggaagttttccgcagtttttggaactgtcttgccataaagacctattacaacacgacctgcagcctttccatcaatctcaacatcaaagtaaaccttgtga

SEQ ID NO: 807 - DNA, 346 bp, Cicer arietinum
  misc_feature (344)..(346): n is a, c, g, or t
actatatacaaaagcacctaattatcgcttctcacaacttttaacgacaaatcatttcaagagcgagatatacctgtcggcttcaagcaagtgatgggacagtggcgcagaaaggacactggaaaaaagaaaactagtattatattacgatgtcgggatttggtttgactgaggactcaatgtttgaggatttctaaaagttatatgatcagacaaaggatctgttgaaagcggtgtttatttttgagatatcaaatcgtgcaatagttggttataacgggacatgggacttgaacatagcaattgcgtaacgaagcacgcagtgaataccatcttttgcaacnnn

SEQ ID NO: 808 - DNA, 426 bp, Cicer arietinum
ctagcgtggtcgcaaaaaaggtacaatcaagcggcacccttgcccttcttcctctggagtttcttcatgtaaaattcaagctcttttccttcaagaatgtaaccatcagccctgccgcattgaccaggtcgagatgaaatgcatgcaagcaaacgcccaccaccaaactgctcttcaatgtgggaatcaagctggcgttctttctggcgggtctctaattttctttggacatggttactctttttggcttcttctgtaacagcttcggcctcctctggtgtatcttttttggaagcagttttctttttccttccaatttcaacaccgtagtgttgaagataccactgcttgaaaggagcagcatcaacctgcacgatagcactcttcacaagggtctgagttcgcacaagctcattgttggaagca

SEQ ID NO: 809 - DNA, 401 bp, Cicer arietinum
acaatcaagcggcacccttgcccttcttcctctggagtttcttcatgtaaaattcaagctcttttccttcaagaatgtaaccatcagccctgccgcattgaccaggtcgagatgaaatgcatgcaagcaaacgcccaccaccaaactgctcttcaatgtgggaatcaagctggcgttctttctggcgggtctctaattttctttggacatggttactctttttggcttcttctgtaacagcttcggcctcctctggtgtatcttttttggaagcagttttctttttccttccaatttcaacaccgtagtgttgaagataccactgcttgaaaggagcagcatcaacctgcacgatagcactcttcacaagggtctgagttcgcacaagctcattgttggaa

SEQ ID NO: 810 - DNA, 439 bp, Cicer arietinum
caagaatctaaaatcctgaaagaaagaaacgaagtttgacactcactgatcaaatgagtcgccatccggaagttctgtgggcgcagcggtctgacaaggtttacctgactgttgctctacctgatgccaaggatgttactgtgaagtgtgagcctcatggtttgtttagtttctctgcttctagggttcaacatgaatcttacagctttagtttggaactttatggatcaattgaacctgggggttgtaaaactaaaactagctcaagaaacatactatgctcaatccagaaaggacaaagaggttggtggaaaaggctactgaagtctgaagagaaacctgcaccatacctgaaggttgattggaataaatggtgtgatgaagatgaagagtcagattatgagttgatatctgacgacgatggacgatttgctggtga

SEQ ID NO: 811 - DNA, 311 bp, Cicer arietinum
accactaactagcatgatgattaacaacaataagaaagagccaagctaccagagatgaattgcaggctagcctactgcctcacgcttttaccctgtgccgcaagttttccagcaacctgctcttcagacaaaggtaaataatagatccgaggagttgatgttgttttgcggaagagatcatccagagtgacgataggtgggtccactttctcaggaaggggtggtggggatggaagacgctccctggcaactggtgggggccttgacaatggtggtggaggtgggagagtagctggaagatgatgctccct

SEQ ID NO: 812 - DNA, 329 bp, Cicer arietinum
  misc_feature (308)..(308): n is a, c, g, or t
accatgaggctatacattcatttgccaaccatggggtcaaggtttcaaatgtggagattgatttgtctgccatgatggcccaaaaagataaagctgtttctaatcttacccggggtattgaaggcctatttaagaaaaataaggtaaactatgtcaaaggttacggaaaatttctttcaccatctgagatctctgtagagactattgaaggtgaaaatactgttgtgaagggcaagcatgtcattattgccactggttcagatgtcaaatctctacctggcgtcactattgacgagaagaaaattgtnatcatcgacggggctcttgca

SEQ ID NO: 813 - DNA, 136 bp, Cicer arietinum
acaagctttttttttctcatttatttgtcattttggacaattttttcgtacaagcttttttttttttttttttttttgggttcatgaataaattcaatcgtcatctatcctaaacagctaagctatttccttcatt

SEQ ID NO: 814 - DNA, 143 bp, Cicer arietinum
ggaattcgattagcgtggtcgcggcgaggtcgccatcggctccctaacagcagttttcagagaaggaattttggagagttcaccttctctgacaacacctttgtcggatctaatggcggcacctcagaaccagaacgccttat

SEQ ID NO: 815 - DNA, 413 bp, Cicer arietinum
ggtaccataacatttggggaggtgaaaagagcataaggtagagatatatcacgtgggttaccaacatagctaaaataagggtaaacattaacaagtaaaggtgcacccgcatataccaagtaaccaataaaaggatctaaataagacctcacaccacttctaaatgaacctttagatggaggaaaagaatttccaataagggtcatatcaatagaagttgaaactttaatttggtcatgaagatttttagctcttattgcttgatatatattttgtgtggcgggtagaacatattgtgcaagccaagaagagccaccaattggactcacttcattaccaactgcaatgtatttgattttgacacttggatagaagttaagtacctgcccgggcggccctcgaaatcgaattcc

SEQ ID NO: 816 - DNA, 437 bp, Cicer arietinum
gtcctcatgttaaacacccttatgccaaattttgcagcaaacaattctggattttcaccaaggaaattacaacaacaacaacaacaagagattctctctccaagcttgctcgattttccatcacttgctcttagccctgtaacaccattgaatgatgacccttttgataaatcctcaccttcattgggaaactcatcagaggaagacaaagctatagctgaaaagggtttctatttgcacccctctccaattactacaccaagagagtcagaaccacagcttttgcctcttttccctgttacttctcctagagtttcatcacaatcaacttcttgaattgattgttgtgtaaaagattgtaacttgctatgtgggttgtttagattgagagaaattactacatgggttttgaaatttgagtgatttcaaatgcccaa

SEQ ID NO: 817 - DNA, 414 bp, Cicer arietinum
gggtaggaaaagaagggtttccttgagaaaataaaggacaagttaccaggacacaagaaaacagaggaaccacctgttgttgttgtatcagagacaacaagtcatgatgaaagtgaagatgcagtgaaggagaagaaaggtattttggaaaagatcaaggagaaacttcctggttatcatcctaagactactactgaacttgatgacaaagatcatcacaaggatgacacaacaacctctcattgagaatactcaattgtctttcttatcttggattgtgttgttttatggatgtgtctgtttattgggtattttgctttctttcattaattaattaatatcatcaaggacttcttgtgcttgtcttcattttcttgatgatatattattgtgctttgcttgtacctcggccgc

SEQ ID NO: 818 - DNA, 434 bp, Cicer arietinum
actgttctgaaaataataagaggcttattcatttctctacttgtgaagtgtatgggaaaacgattggtagttttcttccaaaagatagtcctcttcgtcaggatcctgcatactatgtgcttaaagaagatgtgtctccatgcattttcggttcaatcgaaaaacaaagatggtcgtatgcatgtgcaaagcagttgattgagaggctggtttatgctgagggtgctgaaaatggcttggagtttacaattgtgaggccatttaattggattggacccagaatggatttcattcccggtattgacggtccaagtgagggtgttccacgtgttcttgcatgcttcagcaataaccttctcagaggagaacccctcaagcttgtggatggtggcgaatcccagagaacctttgtttacatcaaagatgccattgaa

SEQ ID NO: 819 - DNA, 162 bp, Cicer arietinum
actccacttagacggcttttcttacaacaacagaagccgaggaaaagttttgtagttgtaaatgctgctacagtttcaactggccaggaagccccggttcagactagttcgggtgacccttttaaaccaaagcgagttatggtcattggtggagatggatat

SEQ ID NO: 820 - DNA, 143 bp, Cicer arietinum
gcagttttcagagaaggaattttgaaaagttcacttcctcgaacaacacctttgtcgaatctatgcgggccacctcagaaccagaacgccttagatatcggaggacggtgcccgtggcatcggtagcgacatccttccgatca

SEQ ID NO: 821 - DNA, 327 bp, Cicer arietinum
accataccatacacacaattacacatatctgcttcaagctttcatttgttataagcacctcacttgcagttgcaagggtcacatgtgcagcttgatccacacttgcagccaccatcttcagctgcaacactcatttcagctccctcgaactgaatcttcgtcggaccaacgcccaaaaccaccgtctctgtggtttcgccgccttcggcatagttcaatccactagacctcttgttgcatttgcagctatcaccacagttgcagctacttccacagttgcagccagacatattctcaaaagacaaagataaaatcactcacaacaca

SEQ ID NO: 822 - DNA, 430 bp, Cicer arietinum
cattttctacagaacctctagcaagaagaaacgcattgagaaatagacagtgacagagtgatagagagagagagatttcgcaatttcacaaaccctaatttcaaagagatcggcgatggcttcttctaaggatcgtgaaaacttcgtctacatcgccaagctcgccgagcaagctgagcgatacgaagagatggtggattcaatgaagagtgttgcaaatctagatgttgaactgactgttgaagaaaggaatttgctttctgttggttataagaatgtgattggtgctcgcagagcatcgtggaggattctgtcttccattgagcaaaaggaagagacaaagggaaacgatgtaaatgcaaaacggattaaggagtataggcataaggttgaatcagagctttcaaacatctgtaatgatgttatgaga

SEQ ID NO: 823 - DNA, 426 bp, Cicer arietinum
tcaaactttcatttttctttgctattacacttatcttcttacaagccgttacaccattgaatcttcaacatccacttgaccctttaactaaagaagagttttccattgtccaaaccgtagttctacacaaatatcccacctcaaaaaatagtgttgccttccactatattggtctagatgaccccgacaaagatgatgtcctaaaatatgaaacacaaccaactctcataacaatcccacgtaaatcctttgtcgttgctatcatcaatagccaaaaccatgagatagtaattgatttaaggttaaagagcattgtctccgacaatattcataaaggatatggtttccctatcttatctgctgatgaacaaggtgttgctatagaactacctttgaaatatcctccttttattgcctcagttaaca

SEQ ID NO: 824 - DNA, 424 bp, Cicer arietinum
acataccaagagattgcaggaacgaagaatactattggccagtatgagagccacgctgcttttactcttcctgggctctacagggttgttcatggcattgatgtctttgatcccaagttcaatattgtctctcctggagcagatatgacaatatatttcccctactctgaaaaggagaaaagactcacgtccctgcatggttcaattgaaaagctattatatgataccgagcagactgacgagtgcattggttcactgaaggaccggtcaaagcctataattttctccatggcaaggctagacagagttaaaaacataactggtttggtagaaagctatgctaagaacagcaaattgagggaactggtcaaccttgtcgttgtagctggttatattgatgtgaagaagtccagtgacagagaag

SEQ ID NO: 825 - DNA, 428 bp, Cicer arietinum
agcgcctgacactctcatgtccctattttggcaccattgccaattgggttcgctgtgttcttggtgcatttggctacaatcccaattactggaaccggtattaatccagctcgtagtctcggtgctgcaattatcttcaacaaggaccttggttgggatgatcattggatcttctgggtgggaccatttattggagcagctctggcagctctataccaccaagtcgtaatcagagccattccctttaagtccaagtaatcaaatcaaacggtcgtgatcaatcaagcagtgttgtgggtttcatttcaacaacatcatcatgatctgttttttattattattattatttaaatttcaagtgttgtatttcggtaacatgtatgtaaagaaggtgtaatattattatgattattaggtagggcatgtgt

SEQ ID NO: 826 - DNA, 141 bp, Cicer arietinum
cttgttaataatatcttatttctcacactaccaatattcttaattcatcatcatgggtgttttcaattttgaggatgaggccacctcaattgtaactcctgctactctctacaaagctctagttacagatgctgacaacct

SEQ ID NO: 827 - DNA, 433 bp, Cicer arietinum
gagtctttcaaacctccaaagacatgcaccacagtttcctggactttccggggattttatgagaaggcccttcttgattacgaaaggcataacataaaaggtggcgagctgaatgtgcctatcgcttctcctccagagcccgtgagtgttgaaaatcaggcttcagtatcaggtagagcccgaagatatgctgctgaacaggctatgcggggttggcactcacaacgtcttcttggcaacggtgaagttagtgaccctattataaaggataggaattctgtggctgtgcaaaagcgtgaaaagcagcttaagagcatcaatttacttaaacgtaagaaaccgtcttatatggataatgcagtcaaagcagcacgcagcaaaccatctaaaccacagttggatacagccgtggttgatattggacctcctgctg

SEQ ID NO: 828 - DNA, 377 bp, Cicer arietinum
accatctttccgctcattgatgttgctgctcctcttcttgcgttttctgttgcacctgctgcgtatcctcgtctagtaagagagttggagaatccgtcggcaacaagaacagagatagccttgacgttaatgaaggagcgagccattgatgattcaaattaaaattagttaaaaatttgtaggaggaggaggagaagaagggttatttttaaatttgatggaagcaaggtgggaagagcttgatttaatagaaattttttgattttgtgttactaatgaaaaggagaaaattaaagaaacaagttgtcgacagcgagaaacttatgtcacatatatgtggtgtgtgagcttccagcagacacaaaggaattgtatac

SEQ ID NO: 829 - DNA, 399 bp, Cicer arietinum
accgtcgagcttctccgatcaccgttgaactgctcatccgcgagtctctgtcattcttacatcaacgcaaccgcttctatttccgcgtgtcagtccggtccactttgttgcacttaccgaaccggtggttcgagtaactcttacatgattcgtgttagggattcaggttgtagtgcttattctagttttgttaaccttgattggggtctttctgtgaaccgttggtctagacccggtttggagattcagtgggtttcgcctagagaaactgtttgtgggtcccaaaaggattgtgattctgccacgtcgacttgtgggcttgattctttttcgtctaatgggatcaaaaggtgtttttgtaatggagaccttgtgtgggaccctattcaagggctgtgt

SEQ ID NO: 830 - DNA, 344 bp, Cicer arietinum
actgaaagcgatgtttccgtgaaagaagagttaataactctacaagactctacaaccacaccaacttgtgatgaaaccgccattcccgaatcagattcaaaggatttaaactacgaatgtttcaaaaacagtgatggtgtcgcttctctgtttcctgcggatttcaaagacggttcttcagatagcgactcgagcgcaattttaaacgaagacaacaataacagtcccaacgcagcgatttcttcatctggggttctccaaaatcacaactttttgatgtcgtcttcgcaatcttcaatgagttgctttcaatttcagaagtatgtgaaaatggaagagcaaaa

SEQ ID NO: 831 - DNA, 437 bp, Cicer arietinum
actgaaagcgatgtttccgtgaaagaagagttaataactctacaagactctacaaccacaccaacttgtgatgaaaccgccattcccgaatcagattcaaaggatttaaactacgaatgtttcaaaaacagtgatggtgtcgcttctctgtttcctgcggatttcaaagacggttcttcagatagcgactcgagcgcaattttaaacgaagacaacaataacagtcccaacgcagcgatttcttcatctggggttctccaaaatcacaactttttgatgtcgtcttcgcaatcttcaatgagttgctttcaatttcagaagtatgtgaaaatggaagagcaaaattttcttggtggagatgagacatgtgatttcttctcagatgaacaaccacccactcttcagtggtattgttcggacgattggaattaagagaa

SEQ ID NO: 832 - DNA, 200 bp, Cicer arietinum
ggatcaaagctactattttatttataatctcaacatccaaatatttcaatgttttgagccattatcaagccgggttaatcaaggcaaggacaaaattgctcctttagcttgacaatattatacaagtaaaatttgtcctctaaagtatgattcccccttttctaagtcaatttttatattacaaattatacaaggaaata

SEQ ID NO: 833 - DNA, 395 bp, Cicer arietinum
ctgattccttcccaaggtttttcccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccaaaattccttctctgaaaactgctgttagggagccgatggcgtccccgcagtattgtgtggccgagtagcccgtagaaaatcccgctcctaacagtgcactaacagtgcgtgccaagaaagaattttt

SEQ ID NO: 834 - DNA, 199 bp, Cicer arietinum
acattaataaattattgatcacaaagagtgattgatttattgatagtagataggttgtaatatagaaattaatcaccgcaattaacaaaggtatagttaacagtaaggtgaccctgttggttgccctgtccattagtatcaagttgattgaagacattaacatccaagtccaaaccaccattggagcactgatcaacta

SEQ ID NO: 835 - DNA, 293 bp, Cicer arietinum; identical to SEQ ID NO: 796

SEQ ID NO: 836 - DNA, 352 bp, Cicer arietinum
acaaaatttggaaatgttgagcaggcaacagaaactgaacgtgtataaagttgttgatcaaaacctactatttacgctatatgttgttctagagctcatgccgctattatatgcttatcttaccattttatattaaaacaaaagttgtaaccagatcactgtgaattaataacatccaaggaatcctaaggtttattttgaagaataaacagcagcatgagcttaacttttttccttctcttagcacagaacaaaaagctagcaaagtccagaatccagttctgcatctttctcagaaatatcccacccatcatcaagaacagcattgtgttcacctttggacctctcctct

SEQ ID NO: 837 - DNA, 286 bp, Cicer arietinum
atacaattcctttgtgtctgctggaagctcacacaccacatatatgtgacataagtttctcgctgtcgacaacttgtttctttaattttctccttttcattagtaacacaaaatcaaaaaatttctattaaatcaagctcttcccaccttgcttccatcaaatttaaaaataacccttcttctcctcctcctcctacaaatttttaactaattttaatttgaatcatcaatggctcgctccttcattaacgtcaaggctatctctgttcttgttgccgacggattc

SEQ ID NO: 838 - DNA, 385 bp, Cicer arietinum; identical to SEQ ID NO: 766

SEQ ID NO: 839 - DNA, 407 bp, Cicer arietinum
acctgccttgtgcaaaccagatttgacatatcccatagctatgttcttcttgagacaaggactgaatccaccacttgtgacttcaccaatgttgttgcctccttcatcttgaatctcactgtgacttctaggaggtggacccgaagaaatgaaaccgacacgcctgatcaaaggaccatctccgagctgtttcaggataacatcagctccaagaaaaccgccttctgctcttctccgctttcctatagcccatgtcagtcctgcctcaataggtgtaatatgctgttccaggtcattgccgtataagcacaatccagcttcgaggcgaagactatctctagcacctagtcctgtcaatcttattttcccttcagatttttccagtaatgccttggcaagatctactc

SEQ ID NO: 840 - DNA, 439 bp, Cicer arietinum
cattttctacagaacctctagcaagaagaaacgcattgagaaatagacagtgacagagtgatagagagagagagatttcgcaatttcacaaaccctaatttcaaagagatcggcgatggcttcttctaaggatcgtgaaaacttcgtctacatcgccaagctcgccgagcaagctgagcgatacgaagagatggtggattcaatgaagagtgttgcaaatctagatgttgaactgactgttgaagaaaggaatttgctttctgttggttataagaatgtgattggtgctcgcagagcatcgtggaggattctgtcttccattgagcaaaaggaagagacaaagggaaacgatgtaaatgcaaaacggattaaggagtataggcataaggttgaatcagagctttcaaacatctgtaatgatgttatgagagtgattgat

SEQ ID NO: 841 - DNA, 356 bp, Cicer arietinum
acatggagcggttatctctgcctttctaactattgctcaagccatgactgatcaaggctgtgtataaaaattgaatgttgcaaaactttggatggcatcatgatgctgatatttatcacctagggtcaatgacaccatgtcactattgagaaagcatatttccttgtataatttgtaatataaaaattgacttagaaaagggggaatcatactttagaggacaaattttacttgtataatattgtcaagctaaaggagcaattttgtccttgccttgattaacccggcttgataatggctcaaaacattgaaatatttggatgttgagattataaataaaatagtagctttgatac

SEQ ID NO: 842 - DNA, 434 bp, Cicer arietinum
caactagtctcacgaggagaaaaatgtctcataggaagttcgagcacccaaggcacggatcattgggatttctcccaaggaagcgtgctgctcgtcacagaggaaaagtgaaggcattccctaaggatgacccaacaaaggcacccaagcttactgccttcttgggttacaaggctggtatgacacacattgtcagagaagtcgagaaaccaggatccaagcttcacaagaaggagacctgtgagccagttacaatcattgagacccctccaatgattgttgttggtgttgttggttatgtgaaaactccccgcggtcttcggactttgaatactgtttggactcagcatttgagtgaagaaatcaagcgtaggttctacaagaattggtgcaagtccaagaagaaggctttcactaagtattcaaagcagtat

SEQ ID NO: 843 - DNA, 307 bp, Cicer arietinum
aggtgttcaaagaatgttggtctcaggagcttaagcttgagaaagagtggaaatgtgaatctgagtgtgagatcgggcttggaaactgcggggcccactgtgacggtgggacaagtcactgaagttaacaaggatacattttggcctattgtcaatgccgccggtgataagaccgtcgtcctcgacatgttcacccaatggtgtggtccctgcaaagtgatagctccaaaattcaaagaattatctgagaagtatttggatgttgtttttctaaagcttgattgcaaccaagataacaagcccttgg

SEQ ID NO: 844 - DNA, 201 bp, Cicer arietinum
acacacttgacttacaatctcacacttccacaacaatgtgaaaagaagaggagagtatgacatttggcaaccaaattaagcacactaaatataataaaatgtgtcacaaaacagcacaccaggtataataaaagcacttaattgtaattaggattggccaaacaataaccctcaagtgccttgaaaagaccatcacccttg

SEQ ID NO: 845 - DNA, 407 bp, Cicer arietinum
accttgcttaaatgatagaatgagctagcttgtttcggatacggcaaagtgtctgtccttccattgtgagtaatggtaatataaccttcctcgatatcaatatttggagtcccgtattcacccatcgtcccaagcttaactagatgacaatcctctctgaactcttttatattaaagagcacattcagtgtcccgacaacattgttttgctgtgtatacacagctcttgaccgatctatcatagagtaaggagcagatctctgttccccgaaatggacaacagcgtcaggttcgtacgacttgaaggtttcagataagaactcaaactcacatatatcaccaatgtatagctcaatactttttccagtgagagatttccaacgctgaatacgatcctggatggaaga

SEQ ID NO: 846 - DNA, 433 bp, Cicer arietinum
actgtatccccattcgttgtcataccaagaaacaacctttacaaagttatcattcaaagcaattcctgccttggcatcaaatatactagacctgctatcaccaacaaagtcagtagataccacatcatcttcagtgtaacccaaaattcccttcaacttgccctctgattcctccttgatagcagccttgatttgttcataggttgctttcttctcaagccttacagtgaggtcaacaactgaaacatcgacggtgaggactcggaaagacattccggtcaattcaccattcagttctggaagaacctttcctacagccttggcagctccagtgctgctgggaataatattgaaggaagcagctcttccacctctccagtccttgcttgatggaccgtcaacagtcttctgggtagctgtgatggagtggaca

SEQ ID NO: 847 - DNA, 436 bp, Cicer arietinum
taacaaggaaggtagatttggattcaacttattggtgggcggtttctttagtcccaagagatgtgcagaagcagttccacttgatgcatgggtctctgcagatgacgttatcccactttgtaaagctgttcttgagacatatagagaccttggcaccagaggcaatagacagaaaaccagaatgatgtggttgattgatgaactgggaatagaagtattcagatcagaggtggaaaaaagaatgccagagaagaagctttcaagagcatcccaagaagatcttattcaaaaaaatgggaaagaagagactacttaggtgttcatccacaaaaacaagagggtttaagctatgttggtattcacattccagttggtagaatccaagcagatgagatggacgagctagctcgtttggccgacgaatatggcacagggg

SEQ ID NO: 848 - DNA, 427 bp, Cicer arietinum
acttggattacccgactatctgtcaacttaacccttctggccgatttgtcattggaggtccccatggtgatgccggtctgaccggaagaaagattatcattgacacttatggtggatggggtgctcacggtggaggtgccttttcagggaaggacccaactaaggttgacagaagtggtgcctatgttgtaaggcaggcagccaagagtattgtggctaacggtcttgctcgcagatgcattgttcaagtttcttacgctatcggtgcgcctgaacctttgtcggtctttgttgacagttatggaactggaaagattcctgataaggagattcttcaaattgtgaaggagaattttgactttagacctggaatgatgaccattaacttggacctaatgaggggtggacataggtttcttaagacagc

SEQ ID NO: 849 - DNA, 434 bp, Cicer arietinum
  misc_feature (402)..(403): n is a, c, g, or t
  misc_feature (421)..(421): n is a, c, g, or t
  misc_feature (431)..(431): n is a, c, g, or t
cgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgctgttttgtgacacattttattatatttagtgtgcttaatttggttgccaaatgtcatactctcctcttcttttcattttgttgtggaagtgtgagattgtaagtcaagtgtgtacnntgcccgggcggccgctcnaaatcactantga

SEQ ID NO: 850 - DNA, 295 bp, Cicer arietinum
actaggttgaattactattgcgacactgtcatcagtagggtaaaactaacctgtctcacgacggtctaagcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtac

SEQ ID NO: 851 - DNA, 292 bp, Cicer arietinum
accagttcaatttcagcgcttttggctatgggctaagcggcaaaaccatacttatcgacctaatagaccgttgacacatgctgaggaagcacaaactgtcgggcaattgagagaagtgtcaaacaaggttcacaatgcagaactgaagttgtttttggaggtggagaaggggatggatttatgtcccattgcaccacctgacaagacaaaggatgatatattacttttcttcaagctatatgatcctgaaaaagaagagcttcgttatgtcggaaggctctttgcgaagtgt

SEQ ID NO: 852 - DNA, 432 bp, Cicer arietinum
accaatgttatcccatttttaaatactttgagaactggtgccaagatgagaataggcatggagatttcttctctgccttgatgaaagcacagccacaatttcttaatgactggaaggcgaagttgtggtctcgattcttctgtctatcggtttatgtcacaatgtatctcaatgattgccagcgcacggatttctatgaaggaattgggcttaacacaaaagaatttgacatgcatgtcatcattgagacaaaccgaaccaccgccagaattttcccagctgttcttgatgttgagaacccagaatttaagcgaaagttggaccggatggtggtgataaacgagaagattcttgctgttagtgagagtgatgacaattcattggtgaagaacttaaagaggattccactgattgctgctttggtgtctgaac

SEQ ID NO: 853 - DNA, 375 bp, Cicer arietinum
atacaattcctttgtgtctgctggaagctcacacaccacatatatgtgacataagtttctcgctgtcgacaacttgtttctttaattttctccttttcattagtaacacaaaatcaaaaaatttctattaaatcaagctcttcccaccttgcttccatcaaatttaaaaataacccttcttctcctcctcctcctacaaatttttaactaattttaatttgaatcatcaatggctcgctccttcattaacgtcaaggctatctctgttcttgttgccgacggattctccaactctcttactagacgaggatacgcagcaggtgcaacagaaaacgcaagaagaggagcagcaacatcaatgagcggaaagatggt

SEQ ID NO: 854 - DNA, 304 bp, Cicer arietinum
gatcgagcttcaacaatgtcgaagagaggtcgcggtggttccgcggggaacaaattcaggatgtcactgggtctaccagtggcggcgacagtgaactgcgccgataacaccggagctaagaacctttacatcatttcggtgaaaggtatcaagggaaggcttaaccgtttgccgtctgcttgcgttggtgacatggtgatggctaccgccaagaagggaaaacccgatctccgtaagaaggtgttgcccgccgtcatcgtccgtcagcgcaaaccatggcgccgaaaggacggagtgttcatgt

SEQ ID NO: 855 - DNA, 327 bp, Cicer arietinum
  misc_feature (152)..(152): n is a, c, g, or t
  misc_feature (322)..(322): n is a, c, g, or t
tgtgttgtgagtgattttatctttgtcttttgagaatatgtctggctgcaactgtggaagtagctgcaactgtggtgatagctgcaaatgcaacaagaggtctagtggattgaactatgccgaaggcggcgaaaccacagagacggtggttntgggcgttggtccgacgaagattcagttcgagggagctgaaatgagtgttgcagctgaagatggtggctgcaagtgtggatcaagctgcacatgtgacccttgcaactgcaagtgaggtgcttataacaaatgaaagcttgaagcatatatgtgtaattgtgtgtatggnatggt

SEQ ID NO: 856 - DNA, 436 bp, Cicer arietinum
acactggggaagatggatttgagatctcagttccttcagagaatggagtagatcttgccaaggcattactggaaaaatctgaagggaaaataagattgacaggactaggtgctagagatagtcttcgcctcgaagctggattgtgcttatacggcaatgacctggaacagcatattacacctattgaggcaggactgacatgggctataggaaagcggagaagagcagaaggcggttttcttggagctgatgttatcctgaaacagctcggagatggtcctttgatcaggcgtgtcggtttcatttcttcgggtccacctcctagaagtcacagtgagattcaagatgaaggaggcaacaacattggtgaagtcacaagtggtggattcagtccttgtctcaagaagaacatagctatgggatatgtcaaatctgg

SEQ ID NO: 857 - DNA, 198 bp, Cicer arietinum
caaccggaccacatttcaatcctaatgggaaagaacatggttcccctgaggacccgattcgacatgctggcgatttaggaaatatcaatgtcggtgatgatggaactgtaagcttctctattactgacaatcagatccctctcactggaccaaactccatcataggaagggctgttgttgttcatgctgatcctgatg

SEQ ID NO: 858 - DNA, 424 bp, Cicer arietinum
accgcgaaggtgtctcttactgggagggtgttaaggcaactgtggatggagtattaggagggtatccagatgtgaatgaacctgatattaattgcagtgatgaattcttgaacattctcttatctgaacgtttttctcctgatgtcaaaacccaaccactcgttgctcttgattgtggttctggcattggtagggttaccaaaaatctattaataagatatttcaatgaggttgatcttcttgagccagtttcacacttcttagaggctgcacgtgaaacgttgacctctgaaggttatacaagttcagatatgcacaaagcagttaatttttactgtgtgcctcttcaggattttacaccagatactggaagatatgacgtaatatggattcaatggtgtattggtcatctcacggatgatga

SEQ ID NO: 859 - DNA, 422 bp, Cicer arietinum
  misc_feature (80)..(80): n is a, c, g, or t
aaagcttattttctccaaaattcatatattcacatcaaacattaagctttccatagttttatcatacaattgcaatggcntcgctctttcgccaacgctaaggttctctccaccatcctccttaatggattttccaacactctcacaagacgtggttacgctgcggcaacagaaagtgcaagcaaggtgggttcaattagtgggaagataacagcaccaaaatcaggagaagaaaaaagtggttcaacttataaggtttcgtgggttcctgatcctgttactggttactacaaacctgagaacatcaaagacatcgatgctgctgatttacgcgctaagcttatcggcaaaaaaatcaacaactaattcatttcaacacattcaagaaattttggtttaggttacatcaaaattatatactg

SEQ ID NO: 860 - DNA, 408 bp, Cicer arietinum
actcattacccccaagaggcacctctctactcgtagctcgccctacagtagttgtcggtgaagtacgtcccattggacatcaatacagttgatcctcgcagagcttccctccagcagcgtctcccatctagttcatccagcatatcatcggcacaaaggcgcatttactttcaagaggtcatcccgtcagcgggatctattcctctccagcctagaattctcttgcacagatagatcaagtagctttccataccctgaggcaggaagtccatgatcccctaagatcgccagtagctgcaacctaggaccatacatccttggggaaacccctcgcagggaaaaacccaaggcggctagaacgctgctctgtggacgaggtagtcgcctcgttccacggtctccaggtaa

SEQ ID NO: 861 - DNA, 346 bp, Cicer arietinum
accttctctgacttaagtggtttcacaacctcccatgtgaaatcagcatcatctctaccaaaatgtccataagcagcagtcttcaaaaaccttttatttccacctcttaaaagatcaaggttaatagagatcattccaggcctaaaatcaaaattctccttcacaatctgaagaatttccttatcaggtatctttccagttccataagaatcaacaaagacagacaaaggctctggaacaccaatagcataagaaacttgcacaagacatctcctagcaagtgcactagcaactatactctttgcagcttgtctcacaatgtaagcaccactcctatcaacttttg

SEQ ID NO: 862 - DNA, 233 bp, Cicer arietinum
atgaaagacaccggaaagagccataaggcgaacggaaaatcttcgccggagacaaggaaggatcggaaatcagcgacaggaacgagcggatcgccgaagaaaggaggacacggaggtaagtttacgtggatcggacgtggctacgaggatcttcaaattggacctgattacggagcattggattccaaggatccgaacttcgaagatcgtgaagaaatcgccgccgtctgagt

SEQ ID NO: 863 - DNA, 397 bp, Cicer arietinum
acaagagatcaaggctatctagaaacaggaggactgtgaaccgtgcttatggtggagttttatctggaggtgctgtcagagaaagaatcattcgagctttcttggttgaagagcagaagattgtgaaaaaggtcttgaagatccaaaagacaaaggagaaacaagcttcaaaggcttaagtttcaagaaaagagataaagatctttttggagggattttaggtttgagtcattatagtaaaaaacaaatttattagaactgttgttcccttgttaattttgtgctcatttggtttctttgaactcattttagtgcaactgttagcctattatgatacagttttgttcggtttattgatattttcatgttttcttatgaatatatgaattttcatgtt

SEQ ID NO: 864 - DNA, 373 bp, Cicer arietinum
atacaattcctttgtgtctgctggaagctcacacaccacatatatgtgacataagtttctcgctgtcgacaacttgtatctttaattttctccttttcattagtaacacaaaatcaaaaaatttctattaaatcaagctcttcccaccttgcttccatcaaatttaaaaataacccttcttctcctcctcctcctacaaatttttaactaattttaatttgaatcatcaatggctcgctccttcattaacgtcaaggctatctctgttcttgttgccgacggattctccaactctcttactagacgaggatacgcagcaggtgcaacagaaaacgcaagaagaggagcagcaacatcaatgagcggaaagatg

SEQ ID NO: 865 - DNA, 397 bp, Cicer arietinum
actcattacccccaagaggcacctctctactcgtagctcgccctacagtagttgtcggtgaagtacgtcccattggacatcaatacagttgatcctcgcagagcttccctccagcagcgtctcccatctagttcatccagcatatcatcggcacaaaggcgcatttactttcaagaggtcatcccgtcagcgggatctattcctctccagcctagaattctcttgcacagatagatcaagtagctttccataccctgaggcaggaagtccatgatcccctaagatcgccagtagctgcaacctaggaccatacatccttggggaaacccctcgcagggaaaaacccaaggcggctagaacgctgctctgtggacgaggtagtcgcctcgttccacgg

SEQ ID NO: 866 - DNA, 296 bp, Cicer arietinum
accgttaccagaatatatcgatcgctattgggatatgtgtttgaactcagtattttcgtccaaaacctatcatttggttcaccctttattaagtgtataactgtcactaatctatcaaattacacacccgactttcatctcaaactgtaattgatatgctgtttatcccccatatggtggtttgacactggtgatgatgttaaaaaaactgcacttgaactgattttagatggaaggtcctcatgagatagaacttatttatcacatgacaagctacttttttctatgtgttgatt

SEQ ID NO: 867 - DNA, 162 bp, Cicer arietinum
acagatttgtttcaggtgaatttcgtgaagtagaattagtaaggaacaatatttgacatataaaaagaatgtcatccaaccttcacctatataaaccaccatttcccaacacttgaaaagctcctggtctcatttatcggtcatgagaaaataaataaaatc

SEQ ID NO: 868 - DNA, 298 bp, Cicer arietinum
acaaaaagagtgagatttttggccttgagaccccaattgaagtggagggtgtcccttcggaaattctggatcctgtgaatgtgtggtcagacaaagaggcctacaatgaaacactgttgaaactagctggattgttcaagaataattttgagaccttcaccaactacaggattggaaatggtgacactctcacagaagagattcttgcagctggtccaatcttttaaagcaatgactgtgtgttgtaggatgggattgttaggatggtagaataaatgtgaccttagaataattatgt

SEQ ID NO: 869 - DNA, 415 bp, Cicer arietinum
acagagcttacctggagaccgtggaacgaggcgactacctcgtccacagagcagcgttctagccgccttgggtttttccctgcgaggggtttccccaaggatgtatggtcctaggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtacttcaccgacaactactgtagggcgagctacgagtagagaggtgcctcttgggggtaatgagt

SEQ ID NO: 870 - DNA, 433 bp, Cicer arietinum
gatcacaacaaaagccaatgttgactatgaaaagattgtccgtgacacatgtagaaacataggttttgtttcagatgatgttggtcttgatactgacaattgcaaagtccttgtcaacattgaacaacagagtcctgatattgctcaaggtgttcatggccatctcacaaaaagacctgaggaaattggtgctggtgatcaaggtcacatgtttggctatgcaaccgatgaaacacccgagttcatgcctttaagtcatgtcctcgcgacgaaattgggcgcgaaactcaccgaggttcgcaagaatggaacatgcccttggttaagacctgatggtaaagcccaagtcactgttgagtattacaatgacaaaggtgccatggttcctattcgtgtccacactgtgttaatttcaacacagcacgatgaaact

SEQ ID NO: 871 - DNA, 169 bp, Cicer arietinum
  misc_feature (130)..(130): n is a, c, g, or t
gatcgagcttcaacaatgtcgaaaagaggtcgcggcggttccgcggggaacaaattcaggatgtcactggatctaccagtggcggcgacagtgaactgcgccgataacaccggagctaagaacctttacntcatttcggtgaaagggatcaagggaaggcttaaccgtt

SEQ ID NO: 872 - DNA, 238 bp, Cicer arietinum
actactactaccctcactatcggattcaaagttatagtcagtttctttgcaagaagcttgcacactctcatagatagagtcggaaatgagacccatcccgtgcacaaatggataaaaagcactgtcgccgtcaaattttgggtccgtgacaccatttcccacaatgtaaccctttaaattgatcacgggctttttacgtctccggattcctttagcaacttccaaagctagagtgtgt

SEQ ID NO: 873 - DNA, 429 bp, Cicer arietinum
acatagaggatgtaacagtgtttggggtgatgtaaaggatgcaattttggatcctaatatcgaaaatattttccaaagccttaatgggaggtcgttttatgaatatacgaagatggataaagagttgaataatattgttaataaggcaatggcccatgctggaccattagaaattaaaagggtcctacaattatataagggatttgagggaatctcaacattggttgacgttggaggtggagtaggagggaccttaaaactcatcatctctcaatatccttcaatcaaaggaattaactttgatttgcctcaagttgttcaagatttacctcctcatccaggtatagtgcatgttggaggagatatgtttgaaagtgttccaactggtgatgccattttattaaagctcgtatgccacaattggtcaga

SEQ ID NO: 874 - DNA, 428 bp, Cicer arietinum
gttgataaattcactggaatgacgagtcgtctcgagagaacattcaagagtttggatgtattctttcaaagtgttgtcgatgaacatcttgatccagagaggaagaagttgcctccaaatgaaatggatgtaattgattcattgattcaattgaagaatgatccttactggtcaatgaatctcacttctgatcatatcaaacccttgattatgaatatgctgtttgcggcaacagacacaattgcagccgtaggagtttggactatgactgcactaatgaagaatccaacagtgatgcagaaagtacaagacaaaattcgtaaagcgtacaaagggaagggttttatagaagaagaagatgctaaaaagcttccatatctaaatgcagatataaaagaatcgatgagattgtatccaatattgcccat

SEQ ID NO: 875 - DNA, 408 bp, Cicer arietinum
acaagacatatttaatttcaaccttatcattattattgatgaattaactcttctccgcacggctttaatcatcatcaacctttcatctccgaccccacaccatgcgattattgatccatttttactacaatacaccgtgtcataatgtcttatttttctattcccaccccccaagtttaaaactcttttctcttaattccaatcgtccgaacaataccactgaagagtgggtggttgttcatctgagaagaaatcacatgtctcatctccaccaagaaaattttgctcttccattttcacatacttctgaaattgaaagcaactcattgaagattgcgaagacgacatcaaaaagttgtgattttggagaaccccagatgaagaaatcgctgcgttgggactgttatt

SEQ ID NO: 876 - DNA, 436 bp, Cicer arietinum
actcaacgaaccatagagaaaaactcttcactgagccgaaaaccgtcgctgaaaatctctctccccaagaaaaccgagtggatcaaattcggaaactcggatccgaaaccggaggtgattgttcagaaaccagaaccggaacctgttgagaaaaagcactacagaggagttagacaaagaccgtggggaaaattcgccgccgagattcgcgatccgaacaaacgcggctcaagagtttggctcggaacgtttgatacggctattgaagccgctaaagcctacgatcgagccgctttcaggcttcgcggatccaaagcaattcttaactttccacttgaagtcaacgaagttattgcggcggtggaggagacttccggcgacggtgagaggaaacgttgccgtgaagaggaagaggtggaggagaaaccggtggtta

SEQ ID NO: 877 - DNA, 278 bp, Cicer arietinum
accctgttgagattgttacatagttggattgatagttttagaagtatgaattaattaattagagaagggtcatttgcacatttatcttccatttgtttcaaaatttatttgggtcagtgatctctgctttagaagtcagtgttacttggtccaaaactaggttgcttgagttctagttattcaaccattatcttgggtaattatttatgcggagtagtgtcgatatgattgagtatttgttcattcaaactactatgcattgaagtatactttttctg

SEQ ID NO: 878 - DNA, 447 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacatta

SEQ ID NO: 879 - DNA, 359 bp, Cicer arietinum
actagtgatttcgagcgggccgcccgggcaggtactaggttgaattactattgcgacactgtcatcagtagggtaaaactaacctgtctcacgacggtctaaacccagctcacgttccctattggtgggtgaacaatccaacacttggtgaattctgcttcacaatgataggaagagccgacatcgaaggatcaaaaatctacgtcgctatgaacgcttggctgccacaagccagttatccctgtggtaacttttctgacacctctagcttcaaattccgaaggactaaaggatcgataggccacgctttcacggatcgtattcgtaccccggccgcgaccacgctaatcgaattcccg

SEQ ID NO: 880 - DNA, 389 bp, Cicer arietinum
actagtgatttcgagcgggccgcccgggcaggtacacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggcgtgatacttcacactcaactttgcaatggatcctccatttgggcctgcaatcaatttagcctcaaatgagatcttctcaactgtgtctggaagcccagcacctcc

SEQ ID NO: 881 - DNA, 214 bp, Cicer arietinum
  misc_feature (168)..(169): n is a, c, g, or t
acaagaaattgcttattacaagagacatatggaaaatccatatggaagattaaacatgaacaaagttcaaagtaaaacgacaacaaccaccaaaaccaatatgctagtctaaatccaccttattattgttgcaaaggaagatgaatcagccagaagctggcttctttnntggccggagaaaaaatgactgcataaacaggaactgcaacaccaa

SEQ ID NO: 882 - DNA, 197 bp, Cicer arietinum
actgctatgttttgcaggaactaaaatacaaaaaactatgctttatggcagcataatgaggttaccgaaaaaacattcttacataggatgtttcaataatcttttagtggtattattgtaatgaatgtgtcatgtctggaaaataaatttgtcttactctttactcgtgcttcaaccatcctagttttaaatattcc

SEQ ID NO: 883 - DNA, 395 bp, Cicer arietinum
actagtgaagctgtgaatgcatactatgctgcagcattgatgggaatggcatatggtgatgcttcacttgtgagcattggatcaaccttaacatcattggaaattcttggaacaaaaatgtggtggcatgtgaaaaaggaagggaaattgtatgaagaagagtttacaaaagagaataggataatgggagttttgtggtctaataagagagatagtggactttggtttgcagcggctgagtctagagaagctaggcttggaattcagcttataccattgagtccaatttctgaagttttgttttctgatgttagttatgtgaaggatcttgtggagtggactttgcctgctttgaatagggaaggtgttggtgaaggatggaaggggttttttgt

SEQ ID NO: 884 - DNA, 262 bp, Cicer arietinum
  misc_feature (170)..(170): n is a, c, g, or t
  misc_feature (174)..(174): n is a, c, g, or t
  misc_feature (176)..(176): n is a, c, g, or t
  misc_feature (179)..(180): n is a, c, g, or t
accatgtccgccaccagcaccagcaccagcaccaccaccagaacaacaaagttgtccaatagatgtattgaagttgggtgcatgtgttgatgtgcttggtggtctaatacatattggaataggtggtagtagtgctaaacaaacatgttgtccattgcttcaaggacttngtgngnatnnttgggaattgctgctctttgtctatgcacttccattaaacttaagcttcttaatatcaaccttgttatccccattgctcttc

SEQ ID NO: 885 - DNA, 404 bp, Cicer arietinum
accaatggcccaaactggctcataggccaaaacaacattatcccaatttgatactttagctgcaattgcctttgtttgctcagcaacaacagcgattgttgttccagcttcacgctcttcaagagtctcaccgatgcaagcaataactttcctcgctagtgaaagtgcatacgcaactttatctccgacaaactcatttgattcatttagaagctgccttcgttcagagtgaccaagaataacccagggaatatccaaattaacaagcatttcagcactaatctctccggtataagcaccacctttgcgaacccaacagttttgagcagcaacatgaaagtcagagcggagtaaacttttcacaacgggaaggaacacataaggcgggctcacaacaacttcaa

SEQ ID NO: 886 - DNA, 325 bp, Cicer arietinum
ccattttggaggtggcaaatcaaccggttttggtttgatttacgatacagttgagaatgctaagaagtatgagcccaaatacagacttatcaggaatggtcttgacaccaaaatagagaagtcaaggaagcaaatgaaggagagaaagaatagggccaagaagatccgtggtgtaaagaagaccaaggcctctgatgctgccaaggctggaaaaaagaaatgagtttttagttgtcgtgtttgtgctttaaggttgttttgctttccaagtttttttgatagctatgttatctcatgcatggtctacaaaatgagatattttggt

SEQ ID NO: 887 - DNA, 335 bp, Cicer arietinum; identical to SEQ ID NO: 69

SEQ ID NO: 888 - DNA, 307 bp, Cicer arietinum
gaaattgatagagttcttggaccaggacaccaagtaactgaaccagatctccaaaagctaccttacctacaagccgtaatcaaagaaacacttcgtcttcgaatggcgattccactcctcgtcccacacatgaaccttcacgatgcaaagctcagtggttttgacatcccggccgagagcaagatattggtcaatgcgtggtggctcgcaaacaacccggcccaatggaaaaagcccgaggaatttaggcccgagaggttcttagaggaagagtctcatgtcgaggctaatggaaatgacttttggt

SEQ ID NO: 889 - DNA, 428 bp, Cicer arietinum
actttctccggcgaagtaatgtcaatcgccgtcgccgtagatccagtctctttgatatcaccaccgacacggtgtctgcaattccgatggaggaagacaaggtcaataatcaagatagtgtttctcaattacagcctctgagccctgcagcacctgaaactgcaaaaatcaatggatttcctatgatgtcagtatttcagttgggtgttaatgagagtccaatggaagaactcactcttggacaaggaaatgtgaaaaataatgtgtcaaccaacctattccatccaattccttttgttgtttcagatccaaaagcttccactgtatctgatattacctctagttctagtgattcatctactgaccctccaacactttcccttggactgtccttctcatctgatcaaaggaaaacatcatcagcacat

SEQ ID NO: 890 - DNA, 297 bp, Cicer arietinum
accttttcagaaactgctttgcagcgtatttccaattgtgagcgctgccaatgagaccattaaccattatgatcaaatgagtagggctaggacggtggtgaccggaagcatcaacaacctctatatcaaaaccttcacctgttgcatcatgttcaattctgaaacaaccaaatttgggtaaagacaacttcttcttcttattattcttcttcatcttcttggtagtatttttggttttattgttgagctcaacaacctcattggtcccttcttcaacactttcttgaacccccgcgt

SEQ ID NO: 891 - DNA, 326 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataac

SEQ ID NO: 892 - DNA, 247 bp, Cicer arietinum
caaactgatacttatatttaaaacaacaaaattgcctgaacatagttctgattctctgaatgcccacataaattattaaattcccatttcaacagtcagttatttaagctgcaagataccaaactttcaaatagacatgccagttcaaagttaaactgaaactacgagtgcgaccagttgatagatacaagctatcaggttcagtaatcaaggcaactaactagagtaacagactccaataaatggt

SEQ ID NO: 893 - DNA, 404 bp, Cicer arietinum
acttaggatgtaatgtgaaaatactttgtgtaagttttagctatagtatttcactaatttatggtatgctagttctattgtaacttagtcatctacaatatgttttcttcttgctcaaggagaggaagaaattgtgaaataaattatgatattgaaattaaacatctttaaaaaaaaaaaaaaaaaaaaaaaaagtacttccacggtgaagaactttgatagcaacaatttgatctacatatcttccttgataaacttttccgtgagctccttcaccgattttcgagccaataaagagcaatttggggtcaacaagaagattgtcatcaatggtaaagtgtgtggtggttgttaaagacccatttgtcctcactgatttttcacattccctctcttctccttct

SEQ ID NO: 894 - DNA, 269 bp, Cicer arietinum
acgaatacttggagaggggaaatctagaggaaaaacttttcaaagcttatttagcaaccttgccttggttaacaagaatcaaaattgcaattggagctgcaaaaggactagcttttcttcatgaagaagagaaaccagttatttatagagatattaaagcctcaaacattctattagatgctgattacaatgctaagctttcagattttggtttggcaattgatggaccagaaaaagatcaaacacatattacaactcgtgtgatgggt

SEQ ID NO: 895 - DNA, 221 bp, Cicer arietinum
acggtgacatgcagcttattgctgaggcttatgatgtgctgaagtcagttggaaagttgtcaaacgaggaactacatagtgcatttccagaatggaacaagggagaacttctgagtttcctgattgaaatcactgcagatatattcggaatcaaggatgataaaggcgatggatatcttgtcgacaaggttctggacaaaactggcatgaagggtaccctg

SEQ ID NO: 896 - DNA, 418 bp, Cicer arietinum
accaaacattaatcattaagcagcgtaagagtaatgatgagctgcaggatgctcgaaaagaattgattaatgccattaaagagatagcaactcgtgcccaaattggtgtgaagagaatgggagaacttgacactggaccattcctcgaagctatgaagaaaagatataatgaggaggaagctgaagacaaagcttcagaactatgttcattgtgggaagagtatctaaaggacccagattggcatccattcaaagttgtcacgattgacgggaaatcgaaagaatttattaaagatgacgatgaaaagctgaatgggctgagaaaagaagtgggggaaagggcatataatgctgtggtggcagctttaaatgagattaatgaatataatcctagtgggcgatatgtaacctctgaatt

SEQ ID NO: 897 - DNA, 440 bp, Cicer arietinum
acatgtaaatgtctttaccctgctcaagattcttcttacagtgaaaacatatactcagaaagctttcacatggaaaacaatattcactctctttagcagaagcagagtatccaacatcaaattcaaaacaactactctcaattatgcagttatcaaatatatgagttgttcttggatttggcccgtgtgaaatcacacgtgtataatcttctgaaagctccatttcacttgcagaaagacaccctttgaatactccatgagtattattaaaggtttcaacttcaagaactggattttcacacccagatgaagattttcccataggagagtgtgataagcttccataagaagaacccaattgagaatttcccgtcttgatgctgaattcacctcttgaaaaagttgattctgattcagatgaagaagaaaatattgttgtt

SEQ ID NO: 898 - DNA, 297 bp, Cicer arietinum
acgcgggggttcaagaaagtgttgaagaagggaccaatgaggttgttgagctcaacaataaaaccaaaaatactaccaagaagatgaagaagaataataagaagaagaagttgtctttacccaaatttggttgtttcagaattgaacatgatgcaacaggtgaaggttttgatatagaggttgttgatgcttccggtcaccaccgtcctagccctactcatttgatcataatggttaatggtctcattggcagcgctcacaattggaaatacgctgcaaagcagtttctgaaaaggt

SEQ ID NO: 899 - DNA, 404 bp, Cicer arietinum
accttagatttgtgccaaggtttcagaacaaaaggagataagatccttatctgaataccgtcataaaaccagtcttttggcaatttcttgtcagatactggaacgccctgataggtgcattttatatgcacttcttttctccaatcgctaatatcttctaaccattcggggtcttgcaataaaaggatacgaatgatatttttcgttattatcaatgaaggtaatataatatattttctaagatttgattggaatagtaatacaaaacttctaattcttagaccatataaaatgctttcccaggattcttctatttcgttaagtctgctttcagcctcgtctttgttttcctctttgtgtttgtgttccatccttttctgaaaagccaaaaattccgaattgtc

SEQ ID NO: 900 - DNA, 413 bp, Cicer arietinum
acaaccccgggtcgatgggaaaacaatactttttaggacttgagaaaggtcttggtggttctggtgaaccagcttaccctggtggacctttctttaaccctcttggttttggtaaggatgagaaatccttgaaggatttgaagcttaaggaagttaagaatgggaggttagctatgttggctatattgggttactttattcaaggtcttgtgacaggagttggaccattccaaaacctcttagatcatcttgctgatcctgtcaacaacaatgtcttgacaagtctcaagtttcactgaatgtattatatgttaagtcattgcatatatgttgtgaactagttgttttatgataatgcagccttgtaagaaatgacatgaaaaataactagaaatatttggcatatttgtgtt

SEQ ID NO: 901 - DNA, 247 bp, Cicer arietinum
accatttattggagtctgttactctagttagttgccttgattactgaacctgatagcttgtatctatcaactggtcgcactcgtagtttcagtttaactttgaactggcatgtctatttgaaagtttggtatcttgcagcttaaataactgactgttgaaatgggaatttaataatttatgtgggcattcagagaatcagaactatgttcaggcaattttgttgttttaaatataagtatcagtttg

SEQ ID NO: 902 - DNA, 205 bp, Cicer arietinum
actgaagaaggtaagggatgaattggatactcatgtaggacaagatcgtttggtagatgaatcagaccttccaaatctgacttacattaaaaatgtgatctacgagacgcttcggttgtatggtccagcccctttattaataccacactcaacttcagatgattgcattattggaggatataaaataccacgagacaccatagta

SEQ ID NO: 903 - DNA, 240 bp, Cicer arietinum
acagcattctcttaaggctagggtgctggatcaattttcattatcacaaatatggttaagttaaattgtttacatgtttgtattattaactgaagagtaaagatagatagtatgcatatatttctgttcaatattgtgcacatttagtgcactgataagaacatgggatgttgcagatttatgatagtgtgctatttttaaaataaataaaccggtgtgtttgcacttcagttaggagtg

SEQ ID NO: 904 - DNA, 175 bp, Cicer arietinum
acaattagcgttaacctttattaataggtggcaagtttttgccattagttttgttgctattcaccaatcatgttgtgctttcattaaaactatattttagatacaaaaaattcagtttcttttggaatattttgaagattttagtgcctgcaatttgcggattgaattattggat

SEQ ID NO: 905 - DNA, 388 bp, Cicer arietinum
acaaaaaaaccacttcttcatctttcttcaattcaccaaagttattcacacaaaaaggttttcatgaaacagaaaccatgatgatgagtcctacttcaatactcgacagtaagaacttttctggtttaaagaaccccttttggtctgaaacaaacagtcccagaacaccaaactgtggtgaacacaaacgttgttgggataaattggattcaaaaccggttggtcttggtcttgttgatgttcttgtagacgaaaaaaatggtgaagttaattcaaaactagaaaacagaactgttctgtttggatctcagttgaagattcagattccacctttttcaccaacaacaatattttcttcttcatctgaatcagaatcaactttttcaag

SEQ ID NO: 906 - DNA, 324 bp, Cicer arietinum
acccaacaaaaacaaacatacaattcctcatcatatctgttcctgaaacattgaaaaaaacagttcccttcccctctaaaaaaaaaccatctttgtaatcaatatatattgtcttatctctagaaaaaatcaaactcaagataattgtcaaaacctttctgattaaatgctgttgacatgtggttattaacaacagccttttccccggctgaggaggcagccggtgaaggtatcttctcgaactcaacaggcttgggaatctcgggaggggtagcacatcggatcaatgcccaattcacaccttcaaaaaagggatgttgcttg

SEQ ID NO: 907 - DNA, 195 bp, Cicer arietinum
acttgtcctctgtgctatttgagtcagtgagacgtcaagctgaaaccatgactttcgagccctgaattattgttttgttcaaggcttgaaattgctttgcttctattttttgttgaaaattttaatgtagttgactattgactctccaaattactgttttgtggttctgaaataaaacttgctttagaaggctcg

SEQ ID NO: 908 - DNA, 148 bp, Cicer arietinum
actaccccagatgatccaatatttccccttattattcctcattgttttgtggggtttcattttgtaaatacctagttttttttacaataaaaataaaatcaaaaaaaaaaaaaaaaaaaaaaaaaaaaagtacctcggccgcgaccac

SEQ ID NO: 909 - DNA, 335 bp, Cicer arietinum
acagacatggtcatacagaatggttccaaagaacaacaatcacagagaagcagcagacttaactgccagcatgcgccttctgagctggaaaaacctattcatgtttatactcgtaggtccaattcgaggaaaaagtattttgatagcaatcatgccgaggttcctgaaaaaccttctggttatatagatgagaaatccccggctgaacttgttttgaagtttgctgagttggattctgttctctcggaaactagcctaaataatatttttaagcattttggacctctaaaggaatctgaaacagaaattgatagaggaagcagccaggcaagagt

SEQ ID NO: 910 - DNA, 413 bp, Cicer arietinum
acatattgaagtccaaatgtttattcttcatagatgaaaactcaagcaagattgaaagtcatacaatgaaataaagtaacaataaaacatttcatatagccacactgtgtagaacaacagtttcaatagtaagtcctggtccaaatccaaacaacacaccccattcaagtccttctcctgttgtcttcagtccatctttagctgatttccttctcatttcatccaatataaacaatacgcacgcacttgacatatttccatattcactcaacacttcccttgttgccctcatcttttcaggcttcaatgctaacttttcctctacttgatctagaattgctggtccacctggatgtgcaatccaaaatattgaattgtaatcagatatgttcaatggttggaaagcttcaatc

SEQ ID NO: 911 - DNA, 148 bp, Cicer arietinum
acttgccccattcgaacttggaggaaattggcagcaggctaccaccaaagggcagtggtagtgaaactgtgcgtatggctcgaacactcattgctgctcgtcacgcgggtgaaaggcttttgagatgctggggtgggggaactggatg

SEQ ID NO: 912 - DNA, 329 bp, Cicer arietinum
acaaatgattatttgagttgtaaaaatctacaaaggaacgtcagaaggatagactttgggatacttctcaatggtttttctaagtattctttcttgctcctcaaggtttgatgaaagttggtcatagacatcattaaacatgtcctcaagtggaggtttttgtgctttctctgccacttgaattgcatgcattgtctgctttctgacactgcttctaagctccaattcatccttatcactccaccaaccattcctttctacccatcttttgaatctactcacaggatctctttccattttccaatattcaatctcatcaattggcctgt

SEQ ID NO: 913 - DNA, 217 bp, Cicer arietinum
acaaatttaaatcaacaagatcgtgatgcagatgttggactacggttgaggcgcataaatcaacaggcgggctgagtgaaaatcattgtcgggtaggaaggaaggaaactctaggatatgttcagtctcttgctggcatggttcttcctgaatagcttatgtgactgtatacacgtgtgttgttggatattataacatttcttgtcatggcaaccgt

SEQ ID NO: 914 - DNA, 408 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccactttg

SEQ ID NO: 915 - DNA, 173 bp, Cicer arietinum
acttttagagaggaagatgtttccaattacttcagcatttatggtcctgttcaagatgtgaggattccatatcagcagaagcgtatgtttggctttgttacttttgtttatccagagacagtgaagttgattttatcaaagggaaaccctcattttgtatgtgatgctcgagt

SEQ ID NO: 916 - DNA, 393 bp, Cicer arietinum
acatgaccacttctgattccctttctaggctctggtgcagttccatcaaacctgccaatggataaaattggtgtccaaaattaagaaacacatttgtcatgaactagggtgaaaaagtgtaaagcccttgtttgcatttatttttagtgttccaagccattttttatttttttttaattaatatttgacctgcttttggcattagaagcattatagggtttgacttttcattgatggttcacctaaagaacacctacataaccggtttctaactatgacccaaacggatcgagattctctacagttaagtccttctgcatttaatcaaaaatttatcaagagaaaattgtgtacttcgagcacagaggatctcacagttgcttggttctgaag

SEQ ID NO: 917 - DNA, 406 bp, Cicer arietinum
actcaataatattacacttttacactttcacattctacttctttgagcagctggcttaaagctggcaaaaccagtaacttctcttcctgtgaccaaagtgttgatttcatacgtgccttcgaaggtgtagataggttctaagtcacagaatgccttagccactagaaaatcagctaaaattccattgccaccaagcaattctcgccccagtgcagctgtttctcttgccctcaaggtgatccacgacttccctaagctagcatgacccggggtcattttaccactttcatacaacttgcatagacgccaaccaacaagaatcatcgcttgaacattactgagcatttgaacaagtttctgttggttgatttggaaagcggctaatggtgctccaaattgtttcctc

SEQ ID NO: 918 - DNA, 436 bp, Cicer arietinum
acgcgggggggataagaaagaaggtgaacacaaaggagagagccatgttgaacaacaacatgggtatggtggagagcacaaaggagagcaacatggtgtgtatggaggagagcacaaaggagagcaacatggtttgtttggtcatggaggtgagcacaaaggagagcaacatggtgtgtttggaggagagcacaaaggagagcagcatggtgtgtatggtggagagcacaaaggagagcaacatggtctgtttggtcatggaggagaacacaagccagaacaacatcatggagaacaaaaggaaggatttttagagaagatcaaggacaaggtccatggtgaaggtggagagggtgaaaatatcaaaaagaagaaggataagaagaaacgtggtgaacatggtggtgaacatggccatgacagcagcagcagtgat

SEQ ID NO: 919 - DNA, 236 bp, Cicer arietinum
ggataaacttatttaatttttattgataaagggagatacaaagacatgaaatatcacatttcaggagagagaaaggaaaactaaacaagagaacagtttatttgattgaaagctaacataagaagacatcaactcatgttaggtatagttgaaggatggatcagttgtaattaggattggccaaaacgtaaccctcaatggccttgaaaagagcatcaccctttgcctttccttct

SEQ ID NO: 920 - DNA, 109 bp, Cicer arietinum
actagagagtaacaggctggatgccgatctcaattcctacactgctgtggacaagtcaatcccaaaagagattcatctggatttggacgatagtcaagaaattgagcct

SEQ ID NO: 921 - DNA, 287 bp, Cicer arietinum
acacgtgctcccatggagagttggatcaattgcttctactacttgaggaactaaatgatacagtctattggaatgatgcttgctgcagaatcatcttgtgttgtatttggaatgagcatttaagttctgctattgacttgtgtaagctcctcaaggataagttacaagatgatgaactggctatgaaagctctatttgataaggtattttctctaattgaggagtcagagtccaatcatttgcatacttgcatggtgctgctttcataaatcacggataagcacggc

SEQ ID NO: 922 - DNA, 232 bp, Cicer arietinum
acagtcctttttgcatgtaatgaattcaattgacattaagaatgcgtttttattcttctctaagtagcttctaacggcattcagaaagtctttcactgtaacggttctgtaatcatgatagatttctggggcagttagcaagaactgaacatctcgcaaacttatattaccaaccgccgtgctgccacctcttttgattacaggcactcctccaaccctctttttcctcatc

SEQ ID NO: 923 - DNA, 226 bp, Cicer arietinum
accaccaccgtgattaaatgatttgttagctccacgaccttgcccgctatgcccacctctgtggagtatgcttggatcttcaccttcccatcgtatatcctcaggtgatatctctttgagatcaacccattcccaagtctcatttgctttgttaatatcataaaccaaagcatgccggccctcagcagggttgtagtcagttatgacagcttcataaaagtggttg

SEQ ID NO: 924 - DNA, 326 bp, Cicer arietinum
acaatcgcaatacaagacttgcgacaaatctaagactgaatcaaatactgacgtatatcaacaatgaagttcactaccagcattagcatgtcttctggtatatcataaaaccataaaaccaatattttctgtaactgcatattggcatccttaatactctgactacaaattccttcaaataaaagggaaaaaacaagtacggaaggaaacaacataagcaacaaaagatatagtaactagttcctactaggatgcttaaaacacaccaccatcatccaacagcatcaaaactgcaacttcaagcctccaccttttcttcctcaagg

SEQ ID NO: 925 - DNA, 157 bp, Cicer arietinum
acagagcacctgaacttttgttgggcgctaaaaaatactcaaaggcaattgatatgtggtcggttggttgcataatgggcgagttattttccaaggtgccacttttcaaaggcaaaactgaaatcgaacaacttgataagatttttcgaactcttgg

SEQ ID NO: 926 - DNA, 349 bp, Cicer arietinum
acgttggggattaacataacgagctctacatgtgttgttactggagcggatataccgaagcaacaggggattacgcatgttagcaaatggaactgcttgtttattactattgcttggggattcttctttcgattcctcttacttggctttgctatttggaagcaagaacaagaggaagtaaacgaggattttatatataaacttttattaatttatttataattctacctcctatataaattcttgtgtaataataatcaaatccagagtgtagaaatagtgcagcaccacaaaaactctaccaatagcttcttgtgcttttcttttctttttagaatgttgtaagtgt

SEQ ID NO: 927 - DNA, 407 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccacttt

SEQ ID NO: 928 - DNA, 435 bp, Cicer arietinum
accaacaaggttgctttgcaggtggcacggtgcttcgtttggctaaggatttggctgagaataacgaaggtgcacgtgtgttggttgtttgttctgaagtcactgcagtcacatttcgtggtcctagtgatactcatttggatagtcttgttggacaagctttgtttggagatggagctgctgcattgattgttggatctgatccaattcctgaaattgagaaaccaatatttgagatggtttggactgcacaaacaattgctccagatagtgaaggtgctattgatggtcaccttcgtgaagcagggctcacatttcaccttcttaaagatgttcctgggattgtctcaaagaacattgataaagctttgattgaagctttccaaccattgaacatatctgattacaattcaatattttggattgcacatccag

SEQ ID NO: 929 - DNA, 230 bp, Cicer arietinum
acgcgggaacgtgaaaccgaagaaaaaattgatttgagggagggcaaaggactcaccatgccaatgggtgttccactcaaggccatgtgtaaaccactacctattgccaattatattataagctgatgatactaattaattatggtaaaagccttagtttgtagtaactagggttagtcgttatagttaagttactttctgttaattgttgggtgttgttttatgtgtgt

SEQ ID NO: 930 - DNA, 393 bp, Cicer arietinum
gattcccagagttcgacattgtttccaacgctagttgtaccaccaactgccttgccccacttgctaaggttatcaatgacaggtttggcattgttgagggtttgatgaccaccgtccattccatcactgccactcagaagactgttgatgggccatcagccaaagactggagaggtggaagagctgcctcatttaacatcattcctagcagtaccggagctgctaaggctgttggcaaagtgcttcctgttttgaatggaaaattgaccggaatggcattccgtgtcccaactgttgatgtctcagttgttgaccttacagtgaagcttgagaaggccgctacctacgacgaaatcaaggctgctatcaaggaggagtctgagggcaagttga

SEQ ID NO: 931 - DNA, 427 bp, Cicer arietinum
acgcgggggtgttgtgtgtgccataacctatattcagagagacatagcgatgaacaattcaagggttatgttattaagggtaagtttgttagtagtagctgtatgcatagcaggatacatattaggtcctcctctctattggcatttcaaagaaggtttaactgctgtcaaacattcttcttcttcttcttctgctacttgttccccttgtctctgtgattgctctacacaacccactttttcaattccacaagggctgagcaacatttcatttggagattgtgcggagcctgatccggaagtgaatggagacaccgaaaagaattttgcggagctattgtcggaagaactgaagctacgcgaaaacgaagctttggaaaatcagcgtcgtgctgacatggctcttctcgaggcaaagaagatcgcg

SEQ ID NO: 932 - DNA, 434 bp, Cicer arietinum
actcgggacagcaggtgggctatgttgggagcattgggatgtgtgttcccagagcttttgtcccgaaatggtgttaaattcggtgaagctgtatggttcaaggctggatcacaaatctttagtgagggtggacttgactacttgggtaacccaagtttggtccatgctcaaagtatccttgctatatgggctacccaagttgttttgatgggtgctgttgaaggttaccgtattgctggtgggcctcttggtgaggtcactgacccactctaccctggtggtagctttgacccattgggcttagctgacgaccctgaagcttttgcagaattgaaggtcaaagaacttaagaacggtagattagccatgttctctatgtttggattctttgttcaagctattgtcactggaaagggtcctttggagaaccttgc

SEQ ID NO: 933 - DNA, 418 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaggcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccactttgtgcaacacaa

SEQ ID NO: 934 - DNA, 427 bp, Cicer arietinum
acctctcttttgacattaaatgcagagagattggatcagcttgagtcatccatggtattttgggagactattgcgcatgaagctggtgacaactttgttcatgctcgttcaaacattgatttagatgaatctacatgctgtgctgatagtttgtctatatcttctgggcaactagatgttgaagttcaacctaagtcatctggaattgacatgaattctgagccaactgctgctcctgctgttgttgcattaaaagaacaacctgtgggaatcaccactgcagcaactggggttaatgatgtattctgggaacagttcttgacagaggatcctggtgcatcggaagcacatgaagtgcaatcagaaagaaaggattctaatagcagaaaaaatgaaggaaaacctagtgatcacggcaaattttggt

SEQ ID NO: 935 - DNA, 312 bp, Cicer arietinum
accctttttccttgttacacaaagcccctcgatcagacccctccattagcactgaatacttaagaaaccacaaaattttatagaagataaataatacatcatccattgaaagtgttcagcatcggctttaagtgcagcttagagatccatcctgttgaaggcagcagaactgatggggactacaccttctggagatacaagagcatcaactggaacatcagttgaagtaattggtattactccttcatccagtatttgttgcgaatatgacagtgcaacaagcacgggctgcttccaattccgtgcccgcgt

SEQ ID NO: 936 - DNA, 288 bp, Cicer arietinum
cttccagagtgacgagaaacggagaaaggatcacagaccttctcaaaattcaagtctttaagatctgggaataacacttctcaaccacaattttcgtaattcttttttcattccaaaaaaaaaaaaaattccccaaaataaataaataaataagggggaaaaagcgatggagcaagcgcagggaaagagaagcgcgaagatgtggatggctttgatgtgtttgatgtttatcttcgttgatcgaattgaatctttatctgttacagtgaacgacgttgaatgtatcta

SEQ ID NO: 937 - DNA, 427 bp, Cicer arietinum
acgcggggagaaagcggctgcgtagaaagttaagtgtgccaagttgaagacggtggaaatcggagagagagatagtcgcagttgaagtcaaatcaaacacaaagcaatccaaaccggttaactgtttcttcttcctccgatctgcacgatgccgtcccgaagaagaactctattgaaggtcatcattctcggtgacagcggggtggggaagacatctttgatgaatcaatatgtgaataagaagtttagcaatcagtataaggcaaccattggagcggatttcttaaccaaagaagtgcaatttgaagataggcttttcactttacagatttgggatacagctggccaggaaaggttccaaagcctaggagttgctttctatcgcggtgctgattgctgcgttcttgtatatgatgttaattcaatg

SEQ ID NO: 938 - DNA, 379 bp, Cicer arietinum
acttagccaataaatctgtcgcatccaattcgactatatcatcttcacaatcagggccgacccaaatataagacggaccaaattttaggtttatattatcgtcatgactacatataatctttggagacatagtttcatctgaaccttttatactggtttcactaatttcaactctttgatcatcctccttgatcttataattaatgttactattatagctttcactaaaccaatccaatggttgtgattgatcatcattagaaaataagctttgacctcttagatctatgcttgtgttaatattaccaaagtttgagtgatgaatactattagaatttttctctagcaattcttgattggtgcatggagtaatagtagt

SEQ ID NO: 939 - DNA, 439 bp, Cicer arietinum
accaaacattaatcattaagcagcgtaagagtaatgatgagctgcaggatgctcgaaaagaattgattaatgccattaaagagatagcaactcgtgcccaaattggtgtgaagagaatgggagaacttgacactggaccattcctcgaagctatgaagaaaagatataatgaggaggaagctgaagacaaagcttcagaactatgttcattgtgggaagagtatctaaaggacccagattggcatccattcaaagttgtcacgattgacgggaaatcgaaagaatttattaaagatgacgatgaaaagctgaatgggctgagaaaagaagtgggggaaagggcatataatgctgtggtggcagctttaaatgagattaatgaatataatcctagtgggcgatatgtaacctctgaattatggaactataaagagggaag

SEQ ID NO: 940 - DNA, 152 bp, Cicer arietinum
acaatgagtgcaccatctactcctgcttcctccatacactggagcagaaaatctacatgtccaggtaaattaggctcttgtccaggtgagtaagggaatttaccagcctcttgagaagaagcccacacgtgtagatgtgaatcaatgacttt

SEQ ID NO: 941 - DNA, 335 bp, Cicer arietinum
cgatcactctacttgtgcgctatcggtctctggccggtatttagctttaaaaaacatatacctcccatttagagcagcattcccaaactactcgactcgttgaaggaactttacagagatttggcatccaaccaaacggggctctcaccctctatggcgtcccgttccagggaactcggaaggcaccgcatcaaaagtatcctctacaaattacaactcgggcccgaaagccagatttcaaatttgagctgttgccgcttcactcgccgttactagggcaatccctgttggtttcttttcctccgcttattgcccgcggactttttttttttttt

SEQ ID NO: 942 - DNA, 169 bp, Cicer arietinum
actgtatctgctgatgagaaatatggtttggaggcaatgaaagtcatggaacacatgaagactcttccgaaagtggaaggactagttcctatctacattagccctcattctggtcagtttagtggagacaacattagactgggatctcgtggcgacagttactatgagt

SEQ ID NO: 943 - DNA, 320 bp, Cicer arietinum
acgcgggcactgaactggaagcagcccgtgcttgttgcactgtcatattcgcaacaaatactggatgaaggagtaataccaattacttcaactgatgttccagttgatgctcttgtatctccagaaggtgtagtccccatcagttctgctgccttcaacaggatggatctctaagctgcacttaaagccgatgctgaacactttcaatggatgatgtattatttatcttctataaaattttgtggtttcttaagtattcagtgctaatggaggggtctgatcgaggggctttgtgtaacaaggaaaaagggtacctgccc

SEQ ID NO: 944 - DNA, 127 bp, Cicer arietinum
acttgaactttaactgatttcgtcttgtattatcattctgactttcttaggaggcttatttggatgtctataacataattcggtcctttatctccttgatgtcttgaaaatacacaatctcttcagt

SEQ ID NO: 945 - DNA, 438 bp, Cicer arietinum
acgcggggacacaaacaagctagctacttgttaataatatcttatttctcacactagcaatattcttaattcatcatcatgggtgttttcagttttgaggatgaggcacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaatccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatc

SEQ ID NO: 946 - DNA, 429 bp, Cicer arietinum
aagcagtggtatcaacgcagagtacgcggggacacaaacaagctagctacttgttaataatatcttatttctcacactagcaatattcttaattcatcatcatgggtgttttcagttttgaggatgaggccacctcaatcgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatg

SEQ ID NO: 947 - DNA, 401 bp, Cicer arietinum
acttgaactgatgagataatccaatatccagcaccacatggttcaataggaatgattctctgtccatatccattgtcacgaagaagataaatggaaaagaaagagaaccacactaaaagtaaggccaataacttcaaccacggaatactcatcaatttgctattctctttagggaccataacaatgatttttggtccatcattttccttaagcattctcaccaaccctttactttcctcttcactagttccattttctagcagccctttttcaagtccattttgcctcatctcttctgattcaatattccaaaacattactccacttttgcaagtttttgaggtagaccaagcaagaaatatagcaaacattaaagttatcaaccattctggaaaaacaag

SEQ ID NO: 948 - DNA, 168 bp, Cicer arietinum
actctttcattccttcaattccatgtctttcagaggtctcagccggcccaatgcttcatcaggcatgggtgttgatgagaacagcaaaaacatcttcatggaattgaagacaaagaaggtccatcgttatgtgatctttaaggttgatgaaaagaaaagggaggttgt

SEQ ID NO: 949 - DNA, 437 bp, Cicer arietinum
acgtggggggcgattagtctcttctatcaaatcccaaaaaaaatgaaggaaaaaaggaatgttcatgctcatgttactgagtactggcaactgacccataatcagacacgtgcacacgggattccctttcattgttcagtgcattttgtatctttttggggactggggaaggtgaaagcttcaaatgcagagttatttacaattgaaaatttatgcattgtacgcggggatgatgatgatgaggacgacgatgatgatgaggaagatgatgattgagattggtgtgtataaattaagatatgatgtttcattggtggagggaggctattatatagtttgtctctgcatattaggatacttttggatatttgtgttggttgaatatctgtcttgtcttgctggtatgatattttgccagcttccctcagttgttagtt

SEQ ID NO: 950 - DNA, 403 bp, Cicer arietinum
accaaaataaagcacatgctaagttgaatagaacatggtggcaccatagtataagacaaaaacttgcaaaatttaaaaatctcatatacatgaaaataatatttagtctgaaaatgtaaataataattacttgttattctcatcacctacaggagcaaccttgttgtctggctgtcccaataagctgcttatagaccgtgctttaaccattccaagcttcactctcttcttttgcttcttctcatcaaaattatccgtcttatcatcatcattcccagcacaattcatcattctcttctcaacaacatcagaattagaagatgaagcattaatattattctttgttagtgatggtgcagtagtagtagtagtagtattagaaaatccaataccaatagatcta

SEQ ID NO: 951 - DNA, 335 bp, Cicer arietinum
accagtttcatcaccgatgagacactcagagattagagttgggcgaatattgtacgggggaagatgaagaaaaagaaggtcttgttgttcctttttgcaagacagtttcggatgttaaaaccgtagcaactagagtgtgaccgttggttcctggttccatctgatccacttttgtgaaaacgggttttctcttgacgggtttattgttgttgttcccttcttctttaacattttttgatgccattgatttgatattcccaaccaacaacaacaactacaactacaaacaaagcacaagaaacaacctttttcttctcagttccctctttaaacac

SEQ ID NO: 952 - DNA, 259 bp, Cicer arietinum
acacaagattacgatgaagctgaattcaacactggtgctgaaattaaaaaaggaagttacccaactcatagcaacaatggaaccaaaaaggcattcaacaactcatggggaggaactcagaaattcggaaaagctaagtttaacactggtgccaagattggaaactaaaacctttacatgtttcagaagcttcacaaataatataattatgaataaataatactaataatgtgttttaagtatgtgtgtgatcaggtgt

SEQ ID NO: 953 - DNA, 416 bp, Cicer arietinum
actggacccaactctgatcagaacttatttactattctatcgcactgtaaccaattacggtctggtagttcttatgattcagtcagaaatagtgaccagtttcttgcaccaagaacttatggagtagatgcaagcactaccagtgtgaatgctactgctgcaccacaggcttcccttccattagattactttgctggacgtgagtcggcggcacctggtggagtggtgcctgatgacatgacatggatgaatttgcaacatccgaattctgcgttaaatgatcaaatgggaaagccgtatttaaggtcatggaaccggtaatggatgttctactttcaccccatatgtgatagcattttgtgatttagcaagatccttagaagcttggtatacacccttagatgagaaggtttctg

SEQ ID NO: 954 - DNA, 341 bp, Cicer arietinum
actgaagagttccgtttgaggaagatcaagaacgatcaactcaaggctgaagctaaggcaaagggtgaggtcattagcacctagcgcaagccagagggtcctaaacctggtttcaaggttgagggtgctacattggaaacagtcactccaattccttatgatgtggttaacgaccttaaaggaggatactagtcattttgttttcttaatgtttgttagtctgtctgtttttgtttggatttttgtcatctttctttcctcattcagacagccttataatttatgataaaccagactcagttctttttgtgtttatttgaaatacatctagattttcagtc

SEQ ID NO: 955 - DNA, 384 bp, Cicer arietinum
aaaaccaaacttcttcaaatttaacagcaacaaaacaaaatgatattacagtagcaattacgaaaagagaggacacagtcacaaaacctagagtttcaatatttttcaaagaagtaaacagttggcgtttgttctacagatcttgaacagtcaaaccaggaggaagagattgcttcaacttatcagctttgtcggtgtcgaaaacacagagggggtactgattgttctgggctttaattgaacaccaagtcgcaaacagtgcatgttatacggaggaaacatgtaaacaaaggaatttgcaaggagtgactagattctttttggggttaataaatttgtttgccaataaattaagagtggtttgctttggaagttcaaacaagg

SEQ ID NO: 956 - DNA, 336 bp, Cicer arietinum
acgcggggcacacaaacaagctagctacttgttaataatatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagt

SEQ ID NO: 957 - DNA, 296 bp, Cicer arietinum
gatttcgagcgccgcccgggcaggtaccctgtcacaccatgggctttacaagaagtgttggataccttcaagatccattatggcaatccgcctatattcattcatgaaaatggccaacggacagctagcaattcatcgctccacgacgtatcgagggtgaaatacttgcatgcatacattggtagcgtgcttgattccttaagaaatggatcaaatattaaggggtattttgtgtggtcttttattgatgtgttcgagttgctggatgcatacgattcaagctttgggttgtaccc

SEQ ID NO: 958 - DNA, 433 bp, Cicer arietinum
acttagggttgtgaacaatgttcttggaggtgtgccttttgtgatgttggcaaggttgacagggtcacaaggtgttggtagtgaagagaaggtgtcaaaattggaggttggattagatgagaaggtggaagaggctttggagaatagcaaccagactaatccatcaaagtgatagcatcacttagttttggttttattatctcttgctttgactaaggttgttgatcagataggcgagggctttttagttttatttttagaattttctggcagcaacaaataagaagggtagattttgagacagggatattcggttgaaatttctggcagggtgttgtaacttacaataaggtgtcaaatttgcctggccatgttttggattttggaccctactcaaatgaaaaatgttttggctactatgttgctgttttgg

SEQ ID NO: 959 - DNA, 426 bp, Cicer arietinum
acaacgtatcctcatggaacttttgaatcagatggatggtttcgatcagacagtgaatgttaaggtcataatggcaaccaatcgggcagacactttggatcctgccctcttgcgtcctggaaggcttgatcgcaaaattgagttccctttgcctgatagacggcaaaagaggcttgtatttcaggtttgcacagccaaaatgaacttgagtgatgaggtggacctggaggattatgtttcccgtcctgacaaaattagtgctgctgagatatctgctatttgtcaagaagcaggaatgcatgctgttcgtaagaatagatatgtcatactgccgaaggacttcgagaagggttacaggacaaatgtgaagaagcctgatacggactttgaattttacaagtgaatggtttttctgatttgtttgtg

SEQ ID NO: 960 - DNA, 434 bp, Cicer arietinum
ctttgctgatgcaggagtattggctattgagcatgctgattttgatggtattgagcgtctggctcttgtcactggtggtgaaattgcttcaacctttgacaaccctgagtctgttaagcttggccactgtgaccttatcgaggaaattatgattggtgaggataaattgattaaattttctggtgttgcaatggggcaggcatgcacaatagttctgagaggtgctagccaccacgttcttgatgaggctgagaggtcattgcatgatgccttgtgtgtgctatctcagactgtcaatgacagtagagtgttgcttggaggtgggtggcctgagatggtgatggcaaaggaggtggatgcattggctaggaaaacaccgggaaagaagtctcttgctatggaggcattctcccgggcactcttggctattccaa

SEQ ID NO: 961 - DNA, 328 bp, Cicer arietinum
ctttgctgatgcaggagtattggctattgagcatgctgattttgatggtattgagcgtctggctcttgtcactggtggtgaaattgcttcaacctttgacaaccctgagtctgttaagcttggccactgtgaccttatcgaggaaattatgattggtgaggataaattgattaaattttctggtgttgcaatggggcaggcatgcacaatagttctgagaggtgctagccaccacgttcttgatgaggctgagaggtcattgcatgatgccttgtgtgtgctatctcagactgtcaatgacagtagagtgttgcttggaggtgggtgg

SEQ ID NO: 962 - DNA, 288 bp, Cicer arietinum
actggttatacaatacgaatgagtcagttggcactttcttgccgtcgtcgttgcggttccagtggtaaatagcatgtgttctattttttatctccagtgtggagtgtccatagctggcttcacgaaatgcagagtattctggctgaggatccataaatctagaagcaagaccttcttgatttcctccatctccgaccgttatatacacaggtgctgatttgtcagctacaggataccggttaccgcttgttatgttgtaatctacattggagaatcgatacgatcttt

SEQ ID NO: 963 - DNA, 424 bp, Cicer arietinum
acatatgttcagttaatcggtgaaagtaagtctgtaaatgtcaatagtgtatcttttgctcatagatacggtatatagtttactaagtaatgtttgatgattgagggttaattggggttacatgccccctttactttacttgtagtagtgtgttaaaaatcattctctgtttgtaagtagaaaagtgagaatgggatatttcatttcgatttttcctttaatggtttctgaattgtaactagaaaaaatgtactattaattaacagcagaacagactgctttacaactgtcaaaataaataaaaagctaaaatacataacagcttaaagaaattagagaaaaaaaaacacaataacaatcttatcaccatataatagaaaaattaacgccttttctttcctgaagacaaaacgcggaaactttg

SEQ ID NO: 964 - DNA, 289 bp, Cicer arietinum
gatctggaaagatcgttgttgaattgaatggtaggttgaataaatgtggtgttattagtccacgttttgatgttggtgttaaggagattgaaggttggactgctaggcttctcccttcaagacagtttgggtatattgtcttgactacctcagctggcattatggatcatgaagaggccaggagaaagaatgttggtggtaaggtccttggattcttctactaggctagttttttattaaggatcttttctatttcagtttttgatttaccgaatgtaatggagcttgt

SEQ ID NO: 965 - DNA, 407 bp, Cicer arietinum
ctgtatttcatacatgagcgctggaaattgtgaataggttctactttcttatttccttgttccttttcatatactttgatggtttacacaatgttttagtaaacggacagttgaacccgacaaaccatgaacagacacactatggttaggttatttgagcggtttgttcaatctgtttaaagcttggaggtcttaccagttggatgtctggtttgttttttagaacattgggtttacgtaattggaattggcgattcttgaccctgctccagagtttactaaatgtgtgttcacttgtaggggaagaaagtgagttcctcaaacccattcagcctcagatatcctgagattgaagatgttacaacactgggtcgatgacatgaacctgatatataataactaaagat

SEQ ID NO: 966 - DNA, 259 bp, Cicer arietinum
acataaaacataaaccatcgtccgccactctatagtataaaccataaaccacttaaatcattattatgttctccaggaaccttttccaaaaccccgtctatcaaatttcactctttcttgagtaaccgtttagtgcttcttggcgttgttcctagcactggcctcggcagtcatgatcagagcgcgaggagcatcctctctgggcatgtagagctcgacgaattgcaagcactcagcagcgttgaactccttgttggtg

SEQ ID NO: 967 - DNA, 136 bp, Cicer arietinum
acggtaaagtttacaacggtttaggtgagaaagacaagaggtttgacatcttcaaagacaaccttaagttcatcgatgaacataatgttctgaattcaacctataggttgggtctgacccggttcgctgatctaac

SEQ ID NO: 968 - DNA, 277 bp, Cicer arietinum
acgaggagtggttagttaagcacggtaaagtttacaacggtttaggtgagaaagacaagaggtttgacatcttcaaagacaaccttaagttcatcgatgaacataatgttctgaattcaacctataggttgggtctgacccggttcgctgatctaaccaatgaagagtatcgagccaagtttttgggaactagggtcgatccgaaccggaagatccgtaaggtgaattcaccgagcaatagatatgcgccacgtgtcggcgataagttacccgagtc

SEQ ID NO: 969 - DNA, 442 bp, Cicer arietinum
accggtaaatggacagttcaacaagcagccgagctttctgttgcggcgcccacgattgccgcttcgttggattgtaggtatttgagtgggttgaaggaagagagggagaatgcatctgcggttttgaaggaagcagggttgaacgaggaagcagggtttgtgaaaagtgggattgataagaagaggttaattgatgatgtgagacaagctttgtatgcttcaaagatttgtagctatgctcaagggatgaatttgttgagggcaaagagtgacgagaaaggttggaatttgaatttaggggaattagctaggatttggaaaggtgggtgtattataagagcagtgtttttggataggattaagaaagcttatcaaaggaaccctaatttggctagtttgatagtggatcctgaatttgctaaggaaatggtgcaaagacaag

SEQ ID NO: 970 - DNA, 269 bp, Cicer arietinum
gcggccggccgggcaggtaccatctttaagtccagagagtcttctattagcatcattagcacgatccatttcttccaattgagtcctcatacaccttgctttcttcaaaacagttacaatatcagtgttaattctttccctcaatgatttcaaagcttccgttttgtgaagtgacttgctctcttcatttgattgttcaagctttgttaggatatcgcgaatttgacccatttctgttcttactttctctgcctcttctaagaacaaat

SEQ ID NO: 971 - DNA, 427 bp, Cicer arietinum
aagttttgggagagagtaagatggcacagtggtcgctactcatcgtgttgttctgcgtcgccaccgccgccggattgagcttcgacgacaccaaccctattcggatggtgtcggacatggaggaacagctacttcaagtgatcggagaaagtcaccacgctctctccttcgtccgcttcgctaatagatacggaaagcgatatgataccgtggatgagatgaagcgtagatttaatatcttcaccgataatcttgaacttatcaaatctactaacaagagacgcctcggttacactctcggtgttaatcattttgctgattggacttgggaggagttcagaacacacagacttggtgctgctcaaaattgctctgctactcttaagggtaaccataagattactgatgctaatcttcctgaagagaa

SEQ ID NO: 972 - DNA, 383 bp, Cicer arietinum
accttgctgagtttaagagtggcgctgagcgtaaagacgctgctgaaagcactcttactgcttataaatctgctcaggacattgcaaactctgagctgcctccaactcacccaatcaggcttggtcttgctctgaacttttctgtgttttactatgagattctcaactctcccgatagggcttgcggtcttgcaaaacaggcttttgacgaggctatcgctgaattggatacattgggagaggaatcatataaggatagcactctaatcatgcaacttctccgtgataacctcaccctttggacatctgacatgcaggacgatggtgctgatgaaattaaagaagctgcacctaaaggtgatgaacagcagtgaacatattgt

SEQ ID NO: 973 - DNA, 418 bp, Cicer arietinum
actgtatccccattcgttgtcataccaagaaacaacctttacaaagttatcattcaaagcaattcctgccttggcatcaaatatactagacctggtatcaccaacaaagtcagtagataccacatcatcttcagtgtaacccaaaattcccttcaacttgccctctgattcctccttgatagcagccttgatttgttcataggttgctttcttctcaagccttacagtgaggtcaacaactgaaacatcgacggtagggactcggaaagacattccggtcaatttaccattcagttctggaagaacctttcctacagccttggcagctccagtgctgctgggaataatattgaaggaagcagctcttccacctctccagtccttgcttgatggaccgtcaacagtcttctgggtagct

SEQ ID NO: 974 - DNA, 438 bp, Cicer arietinum
cttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatgggggatccattgcaaagttgagtgtgaagtatcacaccaaaggagattttactccttctgaagaggagctcaaaagtggcaaagccaagggtgatg

SEQ ID NO: 975 - DNA, 278 bp, Cicer arietinum
gcaattatgtgatggacaagaaggtagaaaaatgattcccttactgtgacacgtaagtactttgatatatagcaagcaaactagtaagttactatagtttagtaattaatcatcactttattttaattaatgtctagcgtcttcttgcagcggtttctctctgagcattgaagtaaacagcagcaacaggaagaccaagatcattctgtgaagcgaaattgcgtgtgttgaaatgatcccttgaagatggtgttgtcataactgattctcggcttttt

SEQ ID NO: 976 - DNA, 232 bp, Cicer arietinum
tcaaaatttacaagaaaatcagctttctattcttggtctaatcctaaatccatgcctcttttgccattgaatgaggatcacgatgacggcgacgatgattattatgattataacgatgaagaagaaaaggttagaaaagtaccatctgcttcatcgtcttcttcttcctcttcattggctgaggataagaaacaagaagatgatcaagtggagtttcgtcaatcctatgctg

SEQ ID NO: 977 - DNA, 198 bp, Cicer arietinum
acaacgtattctcatggaacttttgaatcagatggatggtttcgatcagacagtgaatgttaaggtcataatggcaaccaatcgggcagacactttggatcctgccctcttgcgtcctggaaggcttgatcgcaaaattgagttccctttgcctgatagacggcaaaagaggcttgtatttcaggtttgcacagccaa

SEQ ID NO: 978 - DNA, 428 bp, Cicer arietinum
caacactgaacttcacaaaccaaagcaatggctcctaaccatgctttcatctttttggttctattatccttttcaccacaactcttcttcactctttcttctgcacaacaagataatggtcttcttatgaactactacaaagaatcatgtcctcaagctgaagaaatcatcaaagaacaagtcaaacttctttacaagcgtcacaagaacactgctttctcatggctcagaaacattttccatgactgtgctgttcagagttgtgatgcttctttgttgacttccacaagaagaagcttatctgaacaagaacatgacagaagctttggtttgaggaatttcagatacattgatacaatcaaagaagttgttgaaagagagtgtcctggagttgtttcttgttctgacatccttgttctttctgttag

SEQ ID NO: 979 - DNA, 413 bp, Cicer arietinum
ggcaagacatgctggttgttgaggttccaagattagggaaagaggggggagggggagctatcaaagaatggggtcaaccaaagtcaaagattactcatttgatcttttgtaccacaagtggtgttgacatgcctggtgctgattaccaactgaccaaattgttgggtcttcgtccatatgtgaaaaggtatatgatgtaccaacaaggttgttttgcaggtggcacggtgcttcgtttggctaaggatttggctgagaataacaaaggtgcacgtgtgttggttgtttgttctgaagtcactgcagtcacatttcgtggtcctagtgatactcatttggatagtcttgttggacaagctttgtttggagatggagctgctgcattgattgttggatctgatccaattcctgaa

SEQ ID NO: 980 - DNA, 312 bp, Cicer arietinum
actgagctgaacaagaaaatttacaagcttggcaagtctggagaagagacccatgatgcccaaactgattatgataggactgagaaagacatcaccccaatgggtggattcccccactatggtgttgtgaaggaggattatctgatgatcaagggaggtgttgttggtcccaagaaaagggttattactttgcgtcagtctctactcaagcattacttctcgcaatgccttggaggatatcaaacttaagtttatcgatacctcttcaaagtttgggcatggtcgcttctagacaacacaagagaaacagaa

SEQ ID NO: 981 - DNA, 427 bp, Cicer arietinum
catttggatagtcttgttggacaagctttgtttggagatggagctgctgcattgattgttggatctgatccaattcctgaaattgagaaaccaatatttgagatggtttggactgcacaaacaattgctccagatagtgaaggtgctattgatggtcaccttcgtgaagcaggactcacatttcaccttcttaaagatgttcctgggattgtctcaaagaacattgataaagctttgattgaagctttccaaccattgaacatatctgattacaattcaatattttggattgcacatccaggtggaccagcaattctagatcaagtagaggaaaagttagcattgaagcctgaaaagatgagggcaacaagggaagtgttgagtgaatatggaaatatgtcaagtgcgtgtgtattgtttatattgg

SEQ ID NO: 982 - DNA, 428 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggc

SEQ ID NO: 983 - DNA, 439 bp, Cicer arietinum
actttggctgagcagttgtcaggatttgcctttactgctaatgggtgggtgcaatcctatggatctcgttgcgtcaagcccccaatcatctacggtgatgtgagccgcccaaagccaatgactgtcttctggtcatctcttgctcagagctttaccaagcgtccaatgaagggaatgcttactggccctgtcaccattctcaactggtccttcgttagagttgaccagcctagatccgaaacctgctatcaaattgctttggctatcaaggatgaagtagaagaccttgagaagggtggtattggtgttatccaaattgatgaggctgccttgagagaggggctaccactaaggaagtcagagcatgctcactacttggactgggctgttcactccttcagaatcaccaatgttggtgttcaggattccactcagatcc

SEQ ID NO: 984 - DNA, 334 bp, Cicer arietinum
tcacaaaccaaagcaatggctcctaaccatgctttcatctttttggttctattatccttttcaccacaactcttcttcactctttcttctgcacaacaagataatggtcttcttatgaactactacaaagaatcatgtcctcaagctgaagaaatcatcaaagaacaagtcaaacttctttacaagcgtcacaagaacactgctttctcatggctcagaaacattttccatgactgtgctgttcagagttgtgatgcttctttgttgctgacttccacaagaagaagcttatctgaacaagaacatgacagaagctttggtttgaggaatttca

SEQ ID NO: 985 - DNA, 360 bp, Cicer arietinum
ttcacagagatcctaagtcatggagtgaggccacaagcttcaagccggagaggtttgacaaaaaaggggagattgaaaaggtgattgcatttgggatgggaagaagagtgtgtcctggagaagctttggctcttcgaacaattagcatgactttggcattattggttcaatgctttgattggaaacgtacaagtgatgacaagattgatatggcagaacgagatggattcgttttaacaaaattgattccattaaaggccatgtgtaaaactcgtccggtggtcaacaaggttttcaagtaattaacttatatcgcaattggttgatagtccgatgctatattattcatattaattattt

SEQ ID NO: 986 - DNA, 274 bp, Cicer arietinum
actcattacccccaagaggcacttctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatga

SEQ ID NO: 987 - DNA, 109 bp, Cicer arietinum
actgttgaacaactttgtttgtgaaaaacggcaccgtcatgattcttctcattttccgccaatgttcaccgtaaacggtgaaaaccgtatcctgtccttttccggtgaa

SEQ ID NO: 988 - DNA, 414 bp, Cicer arietinum
acgacactgttcatggtcaatggaagcattttgaccttaaggttaaggactctaaaacccttctctttggtgagaagaccgttactgtttttggaactaggaaccctgaggagattccatggggtgaggttggagctgattatgttgttgagtcaactggtgttttcactgacaaggataaagctgctgctcacttgaagggtggtgccaagaaggttgtcatttcagccccaagcaaagatgcacccatgtttgttgttggtgttaacgaaaatgaatacaagccagagcttaacattgtttccaatgctagctgcacaaccaattgccttgctccccttgccaaggttcttaatgaccgatttggaatcgtcgagggtcttatgaccactgtccactccatcacagctaccc

SEQ ID NO: 989 - DNA, 463 bp, Cicer arietinum
acttggaggaggaggattcatcactcatgaaaacatttaagggtgcaacaactggtttggttgctggcactttctggggttctgtggttgccacctggtatgatgttcctcgtgttgagagaagtgttgctcttccagggctgattagaactttaaagatgatgggtagctatggtgccacctttgctgccataggaggagtctacataggtgtggaacagttggtgcagaactacaggaacaagagggatcttgtaaatggcgccgttggtggatttgttgctggtgcaactattcttggttacagaggaaggagcatcccaaatgcaatttctgctggatcagcgctggcattcacatctgcagtccttgattttggaggtcagacaatgaaacatgatactggaatggagtatgctgcatacactacaaagaaaagacccagtaataacaacgcataatt

SEQ ID NO: 990 - DNA, 362 bp, Cicer arietinum
acggtggacgatttctccgatgaatggtgggccctcgttcaatcatccccttggtttcgtgattactggcttcgtgaacgcttccaagatccccaaaatcataacgacacttcctacttctctgatttcgagatcgatgaagatgatcttttccatcaaatcgagccacaacacgaagatgaaggaggagacgggaaagaaatggtgaggttgcgagatttgaaatggagaggatgtgatggatgggctgaagttcctaggtatgcggaaaaggctccgaagattgttaagcccagagtgagcccacgggctattcatcagcctaggtagatgatgacaagtggaaacaccgtttgcgttgt

SEQ ID NO: 991 - DNA, 446 bp, Cicer arietinum
acttagttttattcactccaagttacaaggatgctatgatgttggttggagaaagttacccttttgttaaaggaaactattacatgactattcttggtgaacaacaagaggattatattaaagaatttgcttcttttaaggaatctaaggttatcatagcacctaggacttggttggatttgaggattagagggtcacagttaagtcaaaattttaggaggaaatgtaagattggtccaaaagggttgtttgcttatgcagcagatgtgaatggaacaatgcattgggtttctgaggcacatagaaactattggcatgttttgcttgatgcttcttccttggttgtgggaaaggataggttacatgttggacttcataggcctgattttttagtatgttgtcttgataacacacattcaaatccttcaagaatcacttgtcttttg

SEQ ID NO: 992 - DNA, 347 bp, Cicer arietinum
actgaagagttccgtttgaggaagatcaagaacgatcaactcaaggctgaagctaaggcaaagggtgaggtcattagcaccaagcgcaagccagagggtcctaaacctggtttcaaggttgagggtgctacattggaaacagtcactccaattccttatgatgtggttaacgaccttaaaggaggatactagtcattttgttttcttaatgtttgttagtctgtctgtttttgtttggatttttgtcatctttctttcctcattcagacagccttataatttatgataaaccagactcagttctttttgtgtttatttgaaatacatctagattttcagttattctc

SEQ ID NO: 993 - DNA, 293 bp, Cicer arietinum; identical to SEQ ID NO: 671

SEQ ID NO: 994 - DNA, 431 bp, Cicer arietinum
actgctggaatctcaggtggtcacataaatccagcggtgacatttgggttatttttggcgaggaagttgtcattgaccagggcactgttctacatggtgatgcaagtgttgggtgctatttgtggtgctggtgttgtgaaagggtttgaaggaaaaacaagatttggtgatcttaaaggtggtgccaactttgtgaaccctggttacaccaaaggtgatggacttggtgctgaaattgttggcactttcattcttgtttacaccgttttctcagccactgatgctaagcgtagcgccagagactctcatgtccctattttggcaccattgccaattgggttcgctgtgttcttggtgcatttggctacaatcccaattactggaaccggtattaatccagctcgtagtctcggtgctgcaattatcttcaa

SEQ ID NO: 995 - DNA, 393 bp, Cicer arietinum
actttctctctggattccacaaaattacaaatgaaataattaatatgaataatatagcatcggactatcaaccaattgcgatataagttaattacttgaaaaccttgttgaccaccggacgagttttacacatggcctttaatggaatcaattttgttaaaacgaatccatctcgttctgccatatcaatcttgtcatcacttgtacgtttccaatcaaagcattgaaccaataatgccaaagtcatgctaattgttcgaagagccaaagcttctccaggacacactcttcttcccatcccaaatgcaatcaccttttcaatctccccttttttgtcaaacctctccggcttgaagcttgtggcctcactccatgacttaggatctctgtgaa

SEQ ID NO: 996 - DNA, 434 bp, Cicer arietinum
tatttggagaacaccgacacgttagctggagctgccactacgttgccgcaatgtgtgcgtaacctagtcaagtggtcgcaaatcagcttgccccaagcggtgatgactgttactaataatgctgccaagtcaattggcgttgaccacgagcgtgggtttttgaatgttgggtgtttagctgattttgttgttttagacaagagtgggtttgttcggaaagtctacaagttgggacgtgaagttcaatcgtcagatatacctttagatagagctactgataaattaactgctgttttatagatgtgtatttaatccatgtttggagcgtatgcgtatttggaaaaggttctaattcttgcaccgaaaatgtagaacaaatatgggatggcacagcatgctaaggagatgaatgccataagggaggttgcccattc

SEQ ID NO: 997 - DNA, 197 bp, Cicer arietinum
acgaatttgcacagaaatacagaccaactgtctttccctcaagctcagagataggtatattttttccatcggatgatatcacaaaatcacgggaacgagagcccaaaatagatctcaaggactgattcctcttagcttcctcttcttgatcttttaactcttggatcctttccgatgtgaaagggaatgcttcgggt

SEQ ID NO: 998 - DNA, 407 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcccccatttgggcctgcaatcaatttagcctcaaatgagatcttctcaactgtgtctggaagcccagcacctccaactatgctgtagtggtaagcccaattagcatcatctattgcgtccacttt

SEQ ID NO: 999 - DNA, 422 bp, Cicer arietinum
tactattctattttcttgctcaatatttctaagcagtagtgtgggaaatggccggcgtgacagaaaacggacgaagaatcatggtagcaatcgacgaaggggatgaaagcatgtacgctttgtcgtggtgcctaaagaatttaattttccaaaattcaaaagaccatcttatcctcttctatgttaagccccctcgtgccgtttattcggcctttgatggcacaggataccttttttcatctgacataactgcaaccatggagaagtatagccaacaagttgccgattgtgtcttggagaaagccaagagggtttgtaaagacctccaaaatgtggagaccgagatagagaatggcgatccgagggacgtgatatgtcatgcggttcaaaaattgggtgttgatattttggtcatgggaagt

SEQ ID NO: 1000 - DNA, 437 bp, Cicer arietinum
accatatactcatggtattcctcaaagcatgacacttcttcttcggtttcaattacgaccgtccattgcaatagccatctccgaacccggagagtcatcagaacacacctattccaattcaatgttgagaggtctgcaagttctgttagttgaccacgacgatgtaaatagagcagtgacacaaaaattgcttcagaaactaggttgtgccgtgacttctgcttcttccggattcgaatgccttaccttcattggacctgctggatcttccattcaagttgtgcttttggatctccaaatgcctgatatagacggcttcgaagtcgccgcaaggattcggaagtttaaaagcggaaataggccaataattgttgcattgaccgcaagtgccgaagaagatttgtgggaaaagtgcatggagattggtgttaatgggg

SEQ ID NO: 1001 - DNA, 274 bp, Cicer arietinum; identical to SEQ ID NO: 986

SEQ ID NO: 1002 - DNA, 363 bp, Cicer arietinum
actatgatgccaaatacagatcaggcttttcgtctgaattgggcttcattcagcgctggtggcggtgagagacgttcttctgatgctacttctgatctctctatatttgtgggggacttggccatagatgttactgatgctatgctgcaagaggtgtttgctagcagatactcatctattaagggagcaaaagttgtcattgattctaattctggccgttcaaaaggctatggttttgttaggtttggtgatgaaaatgagaggacaagggcaatgactgaaatgaatggtgtttattgttctagcagggcgatgcgaataggtgttgcaacacccaaaaaaacttatggaaatcccccacaa

SEQ ID NO: 1003 - DNA, 253 bp, Cicer arietinum
acaacatctccacgatacatcaagcagcaagccatgtatttcccgtgccttggatcacacttggccatcatgctagcaggctcaaacacagcattggtgatttcaggcacagagagctgctcatggtatgccttggcagcagagatcacaggtgcgtaggacgaaagcatgaagtggatacggggataacgcacaaggttggtctggaactcagtgatatcaacattaatcgccccatcaaacctcaatgagg

SEQ ID NO: 1004 - DNA, 460 bp, Cicer arietinum
atgctcttcgccgccatgggaaacgcgggaattcgatttcgagcggccgcccgggcaggtctctcgtttgtttcaatcatcatccatgccgactactgctggtcaagtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaaggttcagactcctatgtttcctcgtatatttggtcatgaagctggagggattgtggagagcgtaggggagggtgtgactaatctgaaaccaggggatcatgctctgcctgtattcactggggagtgtggggaatgtccacattgtaagtctgaggaaagcaacatgtgtgatcttcttaggatcaacacagataggggtgtc

SEQ ID NO: 1005 - DNA, 433 bp, Cicer arietinum
gggaagaagataacatggttgtttggttatacaaagtgataacaatcaccgttacagtagcaagtgtggcgttaacactaacagaagctcaaaaggaggcagatttcaagtgcagctcagaaatcgccacgtgtcgtagtctaaccgactacaaatcccctaacgtaacaaccctgaaggaaatcgaaaccctgttcggcgtgaaacacttccttgacctcctaggcgctaacaacttcccaagcaacaccaaagacaacttcaaagtggaagccgaccaagtcgttaaagttccgtttccgtgtaaatgcggtaacggaacagggacgtcgaaccaaattccgcgttacaaagtaaaaccgggtgacacgttggacggaatagcgaggaaccgttttgcgggtttggttaagtatcaacagattcaaaccgc

SEQ ID NO: 1006 - DNA, 316 bp, Cicer arietinum
acatagcttatatttaaaatattaaaacattaatttaactttagctacgatatatgacaacaggtttatttatttttttattacaattttaatcttagtctttggaattattctccaattgtagtataattttaaaacttgtttttgtgtgaactataaatttgcaaaaacttgtatcacctttaaatatttcaataactatattaaaggctaacctgatacaagcttaacaaatttaaattttaacgcacaaaaaataggtttataaattaaactacataatgaaaaataaaaggctttattttttatatttttg

SEQ ID NO: 1007 - DNA, 114 bp, Cicer arietinum
actggatgtgtcttcaacaggacggctttatacggctacgaacctcctcttaagctgaagcataaaaagcctgggtttctatcatcaatctgtggtggaaatagaaagaagagt

SEQ ID NO: 1008 - DNA, 319 bp, Cicer arietinum
acggacaagtgggcatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagatttccactgtccctgtctactatcctgcgaaaccacagccaagggaacgggcttggcggaatcagctgggaaagaagaccctgttgagcttgactctagtccgac

SEQ ID NO: 1009 - DNA, 407 bp, Cicer arietinum
ggagggtgttaagtctctcttcaagggtgctggtgccaacattctccgtggtgttgccggtgctggtgtcctccccatctacgatcagctccaggtcctcctcttcggcaaggccttcaaataagcgctttgtataacataccctgtatagacgagtgtgtgggggataaggaattcggggggatcttaatctgcgggcttgacatggtgtccgctggttgaaactaaaaggcgagatcgaagtgcaggttgagggaagttgtcacagatacccgacgtggtcctctgaaacagcagctctttgcgggttagagtggcataggcacggcgtctttttctaatcttgctttgccttccgttctaggccgctgtaatttatacaccaatggcatttccctttactgtcc

SEQ ID NO: 1010 - DNA, 392 bp, Cicer arietinum
gggtaaggtcttcctttctgccgtgtcgtttgctgttattttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttcatacttccagtattgagctctgcaattacgattatgactatgacaatatctcttattgtgtgacgtgttttattactgatgttagta

SEQ ID NO: 1011 - DNA, 385 bp, Cicer arietinum
gctattgatgtccttgaggaaaattccaatctgttaactaagttgaagaacaacattgctgtgttatggaaagggctgttgaaaataccaggcttcacaattgcaagtcatccagagtcaccaattgtttatttgagattaaagaagtcaacgggttctttgaaagatgacctacatctgcttgaaaatattgccgagcgcgttttgaaagaagattctgtatatgtggtggcttccagaagatcaacattggacaagtgtcgattgcctgtaggaattagattgtttgtttctgcagggcattcagagtctgatcttcacaaggcatctgaatcattggaaaggattgcggcgtcagtccttgatggtcatgattgaacaatgt

SEQ ID NO: 1012 - DNA, 431 bp, Cicer arietinum
acacaagtgagctgctagctcttcttatccactataaacaacaacaaagttacaagacaactcaaagaagctgtgataatcaccatactagtagctaacagcaacgatgcatatcccatttatctttgttttcagcaataacctcaactctatcaaggcagagtgtatttgtccacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttgtgacacacttgcattttcatcttgtgctgcacttgcacaaggagctagcttaaaagcttcattatctggtgtagtggattttccacattcaccag

SEQ ID NO: 1013 - DNA, 411 bp, Cicer arietinum
acgtcaattctccaggagggtcagttacagctggcatggcaatatttgatactatgaggcacattcgacctgatgtgtccactgtttgtgttggattagcagcaagtatgggtgcttttctgctaagtgcagggaccaaaggaaagagatacagcttgccaaattcaaggataatgattcaccaaccgcttggtggatttcagggagggcaatctgacatagatattcaggcaaatgaaatgctgcatcataaggcaaacttgaatgggtatctctcctatcaaactggccaaagtttagaaaagatcaaccaggatactgaccgtgattttttcatgagtgcaaaagaagccaaagagtatggactcatagacggtgtcatcatgaatcctctcaaagctcttcagccat

SEQ ID NO: 1014 - DNA, 447 bp, Cicer arietinum
  misc_feature (44)..(44): n is a, c, g, or t
  misc_feature (107)..(107): n is a, c, g, or t
  misc_feature (132)..(132): n is a, c, g, or t
  misc_feature (144)..(144): n is a, c, g, or t
  misc_feature (183)..(183): n is a, c, g, or t
acggacaaggggaatccgactgtttaattaaaacaaagcattgncgatggtccctcgcggatgttgacgcaatggtgatttctgcccaggtgctctgaatgtcaaangtgaagaaattcaaccaagcgcggngtaaacggcggngagtaactatgactcttcttaaggtagccaaatgcctcngtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctc

SEQ ID NO: 1015 - DNA, 296 bp, Cicer arietinum
acaagtttgagagttgaaataaaagtagagaaacaatgaactcttctcttcatctcacattcacagctttatggtgtgttgtggttgtgctaggagggttacccttctcctcggatgcacaacttgacccatccttttatagaaatacttgtcctaatgtccattccattgttcgtgaagtcataaggaacgtttctaagacagatcctcgaatgcttgctagtctcgttagacttcactttcatgattgttttgttcaaggttgtgatgcgtcagttttgctaaataatagtggt

SEQ ID NO: 1016 - DNA, 438 bp, Cicer arietinum
acggacaatggccatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctc

SEQ ID NO: 1017 - DNA, 421 bp, Cicer arietinum
acgtcaattctccaggagggtcagttacagctggcatggcaatatttgatactatgaggcacattcgacctgatgtgtccactgtttgtgttggattagcagcaagtatgggtgcttttctgctaagtgcagggaccaaaggaaagagatacagcttgccaaattcaaggataatgattcaccaaccgcttggtggatttcagggagggcaatctgacatagatattcaggcaaatgaaatgctgcatcataaggcaaacttgaatgggtatctctcctatcaaactggccaaagtttagaaaagatcaaccaggatactgaccgtgattttttcatgagtgcaaaagaagccaaagagtatggactcatagacggtgtcatcatgaatcctctcaaagctcttcagccattatcagctgc

SEQ ID NO: 1018 - DNA, 428 bp, Cicer arietinum
actgagctgaacaagaaaatttacaagcttggcaagtctggagaagagacccatgatgcccaaactgattatgataggactgagaaagacatcaccccaatgggtggattcccccactatggtgttgtgaaggaggattatctgatgatcaagggaggtgttgttggtcccaagaaaagggttattactttgcgtcagtctctactcaagcagacttctcgcaatgccttggaggatatcaaacttaagtttatcgatacctcttcaaagtttgggcatggtcgcttccagacaacacaagagaaacagaagttctatggacgcctcaaagcttagttatggctgctgctttgaaatgttggaaatcgttatttatgttatttttgttgccatccttttaaactctgttgtggtgtcttccgttagct

SEQ ID NO: 1019 - DNA, 404 bp, Cicer arietinum
actgcaaaaataacccatgagtatgcacggattaccaaaatagctaacggaagacaccacaacagagtttaaaaggatggcaacaaaaataacataaataacgatttccaacatttcaaagcagcagccataactaagctttgaggcgtccatagaacttctgtttctcttgtgttgtctggaagcgaccatgcccaaactttgaagaggtatcgataaacttaagtttgatatcctccaaggcattgcgagaagtctgcttgagtagagactgacgcaaagtaataacccttttcttgggaccaacaacacctcccttgatcatcagataatcctccttcacaacaccatagtgggggaatccacccattggggtgatgtctttctcagtcctatcataatca

SEQ ID NO: 1020 - DNA, 128 bp, Cicer arietinum
actgttaggtgtcgctgtgaaaacacttcaatgttgggtgagaggaaaaatgtaaatcttcctggtgttattgtggaacttcccactcttactgacaaggataaggaagatattcttcaatggggtgt

SEQ ID NO: 1021 - DNA, 293 bp, Cicer arietinum
cttccagagtgacgagaaacggagaaaggatcacagaccttctcaaaattcaagtctttaagatctgggaataacacttctcaaccacaattttcgtaattcttttttcattccaaaaaaaaaaaaaattccccaaaataaataaataaataagggggaaaaagcgatggagcaagcgcagggaaagagaagcgcgaagatgtggatggctttgatgtgtttgatgtttatcttcgttgatcgaattgaatctttatctgttacagtgaacgacgttgaatgtatctatgagt

SEQ ID NO: 1022 - DNA, 358 bp, Cicer arietinum
tcacagttgaagagaaatgggaaaattgatcgcggaggtttttaccttaaagtggcgtttcctttttctttaggatctaaagagaaaaagaagaagaaaaatgagttgttatcggtgaatagtagttcaagagtttcacctagaccttcagcagtttgtgatggatcggtaaaaggtgttgttgataaagagaaggaatggtggaaaaagagtagtttggtgtataaagagagtgatagtggtgaatcgagtattaacagtggaagcgtgaaaagctctcgtagtagtagcagcaatagtagtagcagcagaagaatcagaagtaacagcagcaggaggcgtgagaagaatggtggtt

SEQ ID NO: 1023 - DNA, 435 bp, Cicer arietinum
aaagagaaaaagttattggaccacggagacccaaactgctaaaaccgaatcagatgcaaaaattacaattgggctgagcccagctgagcttgttgttgtgaatccaaacaaaaaaactgcggttggaaacgaggtcggataccgtttgattccagcaattccagctcatccacttttaacggaagatgattacccacaaatacgtggcgcatttaccaattataatgtttgggtcacaccttataatagaactgagaaatgggctggtggactttatgttgatcatagtcgtggagatgatactttagctgtttggactcaaaagaatagagacattgagaacaaggacattgttttgtggcacgtagtgggaattcatcatgttccagcacaggaagattttccaattatgccattgttgagtacctgcccggg

SEQ ID NO: 1024 - DNA, 344 bp, Cicer arietinum
tggtgatgctggtcttgttaagatgattccaaccaagcctatggttgtggaaactttctccgagtatccaccacttggtcgtttcgccgtgagggacatgcgtcaaactgttgctgtcggtgtcatcaagagtgttgagaagaaggatccaactggagccaagatcaccaaagctgcagtgaagaagaagtgatggttgatgcagaagtggatgttgctttatagtagcttattatcttttaagagtcttagtttatttttgccttttaattttgccgtttttatgcagccaaacttgcaaaactgggttcttgatcggcgatggtcgacctttattttgtggt

SEQ ID NO: 1025 - DNA, 255 bp, Cicer arietinum
ccacctgatcacacacatacttaaaacacattattagtattatttattcataattatattatttgtgaagcttctgaaacatgtaaaggttttagtttccaatcttggcaccagtgttaaacttagcttttccgaatttctgagttcctccccatgagttgttgaatgcctttttggttccattgttgctatgagttgggtaacttccttttttaatttcagcactagtgttgaattcagcttcatcgtaatctt

SEQ ID NO: 1026 - DNA, 436 bp, Cicer arietinum
actttggcgagcagttgtcaggatttgcctttactgctaatgggtgggtgcaatcctatggatctcgttgcgtcaagcccccaatcatctacggtgatgtgagccgcccaaagccaatgactgtcttctggtcatctcttgctcagagctttaccaagcgtccaatgaagggaatgcttactggccctgtcaccattctcaactggtccttcgttagagttgaccagcctagatccgaaacctgctatcaaattgctttggctatcaaggatgaagtagaagaccttgagaagggtggtattggtgttatccaaattgatgaggctgccttgagagaggggctaccactaaggaagtcagagcatgctcactacttggactgggctgttcactccttcagaatcaccaatgttggtgttcaggattccactcagat

SEQ ID NO: 1027 - DNA, 201 bp, Cicer arietinum
actaaggaggaaaaattcactcagacaattttttataagcatcattaaatcttcttgcactgcaaggttattatgtgcttggaacagcttctttactctctgtagctgcctcaccagcaacatcgctcttgccagcagcatcttgctcaccaggcttcgacacttcttttttttcatcgtcactctcgtcaatatcatcca

SEQ ID NO: 1028 - DNA, 166 bp, Cicer arietinum
actttttttgtatgcaaatgaattgctttgatgtgattttcaaattttggaacatttgaaattcatgttatgactttttttgtgatgttagttttgatgattgatcttgtttctttaattgatatacacttcttttttctacctaataatagtttttaaattttac

SEQ ID NO: 1029 - DNA, 226 bp, Cicer arietinum
ttggatcaaagcttttattctaatttatttcagaatcaaactgatacataaaggatcaactatatgatcatagtcgctggtacaaggaacttatttaacaaatgagcataaaacattaataacaacctaatgattttctataaaaaaagcctaacagtatatttaaaggtgccccagcttcagacgatagagctaattactgcaagttctttttgagaaagttctt

SEQ ID NO: 1030 - DNA, 191 bp, Cicer arietinum
acaactctagggaggatctcacaccaagatatgttccggataggtttgctggtctaactgcttatgagcaatcaagtgttcaagagcataacatgaattatggtaacaaggatttgagaaatgccgatagggttcttgatagacctgttgtaaatccacctcctgcccgggcacaagagacagcagtgtca

SEQ ID NO: 1031 - DNA, 428 bp, Cicer arietinum
acaggaatcatagagattacaacaggcggcagacgagaattccaagttacgggagttcttgatggaccgagggcagattgttgatacgttgcaaggagaaatttctgttatctgtgaggatattaggcttctaaaagagaaatttgatgcaaatcttcctttgagtaaatcattcacatcaagtcagacaagttgcatcttagcttcttcaggttcatcccacaaaagcttggcatctaatgtgggttctgagcatagtgattcttccgaaatactcaagatcacccaggcagcctcagttgaaggcctttctgacaaagttgatcaagaggagaggtccaaagctgaacacaatgctcttcttgatgatgggtgggatatttttgagaaagatgcagaactggattctggactttgctagctttttg

SEQ ID NO: 1032 - DNA, 120 bp, Cicer arietinum
gaatatatgaatttaccgaaagtgatggaaggaagatacatcgaaagagaaaaaagggaagcaaagtttccgcgttttgtcttcaggaaagaaaaggcgttaatttttctattatatggc

SEQ ID NO: 1033 - DNA, 459 bp, Cicer arietinum
atttcccatcttgtgagaactcaaattgcaacccgcacagtcacaaatgttgctaaggaagtagaaacctacgtgatgacagctagaatgcaaccagcaattgccattgaagtgaaccctccagcaataaccatcaaagctggtgcatcacgtaggtttaccgtgacacttactgttcggacagtgacaggaacatatagttttggagaggttttgatgaagggaagtagaggacacaaagtgaggatccctgttctggctaatggttattcaagatagcctagtttggtcagaaatatgcttgtaatattctttgtaacttgtgggaataaggtatgttgctagatttattattcattaatatatatgtgatgtaaaggtaaataggtgaaaggagagactcctagtttattccacattttaagttttgataacatcatctagtgatgatatgttaaa

SEQ ID NO: 1034 - DNA, 430 bp, Cicer arietinum
acgttccacgcgccgttctcatggatctggaacctggaaccatggattccgtcagatccggtccgtttggtcagatcttccgtcccgataacttcgttttcggtcaatccggcgccggaaataattgggcgaaaggtcattacaccgaaggcgccgaactcatcgattccgtcctcgatgtcgttcgcaaagaagccgagaattgcgattgcctgcaaggatttcaagtgtgtcattctttgggaggtggcacgggttctggaatggggacgctattgatttcgaaaattcgagaagaatatccggatcgaatgatgttgacgttttccgtgtttccttctcctaaggtgtctgatacggttgtggagccgtataatgcaacgctttccgttcatcagcttgttgagaatgctgatgaatgtatggtttt

SEQ ID NO: 1035 - DNA, 401 bp, Cicer arietinum
acccttaatgtatcgtctggaaaagaagagaatgtgaagaatgcacaagatgctttgttgacaagggctaaggctaattcagaagctactcttggaacttacaagggtaactctcaacttggtgaaggtgcctcagagagtctccatgttaaggactacaagtattgatcaaagttggtgtatcccttaaagagggtaggtttggcatttaagggtataacaactgaacattgtgagggttgaattttcttgttattgagtattgtggaataattgcttggagtttttctttttgttttctctctgtttgtttgatcatagctttagtctatttggtcaaaacccgagcaaaagggtggacataagacactattctaagtcaggttatttgtttatttcgc

SEQ ID NO: 1036 - DNA, 293 bp, Cicer arietinum
acgaatacgaaccgtgaaagcgtggcctatcgatcctttagtccttcggaatttgaagctagaggtgtcagaaaagttaccacagggataactggcttgtggcagccaagcgttcatagcgacgttgctttttgatccttcgatgtcggctcttcctatcattgtgaagcagaattcaccaagtgttgggttgttcacccaccaatagggaacgtgagctgggattagaccgtcgtgaggcaggttagttttaccctactgatgacagtgtcgcaatagtaattcaacctagt

SEQ ID NO: 1037 - DNA, 335 bp, Cicer arietinum
acacaagtgagctgctagctcttcttatccactataaacaacaacaaagttacaagacaactcaaagaagctgtgataatcaccatactagtagctaacagcaacgatgcatatcccatttatctttgttttcagcaataacctcaactctatcaaggcagagtgtaaggtccacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttg

SEQ ID NO: 1038 - DNA, 459 bp, Cicer arietinum
atctccagagtcgccacaaacaatgggacgtgtgatccgtgcacagcgtaagggagctggctccgtcttcaagtctcacacacaccaccgcaaaggaccggcacgtttccgcagtctcgacttcggagaacgtaacggttacctcaaaggtgttgtaactgacgttattcacgatccaggtcgcggtgcacctctcgctaaagttactttccgtcacccgttccgttacaagaaacagaacgaactcttcgtcgccgctgaaggtttatacaccggtcaattcatttactgcggtaaaaaagcgactctcgttgttggtaatgttcttcctctccgttctatccctgaaggtgctgttatttgtaatgtcgagcatcatgttggtgaccgtggtgcttttgctagagcctctggtgattacgctattgttatcagtcacaaccctgataatgatacatc

SEQ ID NO: 1039 - DNA, 437 bp, Cicer arietinum
ctaaataaaaaggtcgaagagaggcactgccggaagggaacaaccaccgtctttcaattttccggcgatctcctcgtttcttccacctgcgatctaatatcccaacaatcaaacatgactacatcaagacgccttgcagttaggaaggtggagaagtttgagaaaaacatcacaaaaagaggaagtgtgccagaaaccactgttaagaaaggaaaagactatcctgttggccccgtgctgcttggtttcttcgtctttgttgttattggatcatctctctttcagataatcaggacagcaacgagtggaggcatggcataatggagctttgagttggactgtgtcatcttctctttcttagccctgtagaaaatatgactatacttttctacatgtaccttgccacctggactgttaacattttacggattaactga

SEQ ID NO: 1040 - DNA, 440 bp, Cicer arietinum
acttcaatggctgctcctcacgtcagtggtgccgcggcgttgttgaaatctgcgcatccggattggagtccggccactgtgagatccgccatgatgaccaccgctactgttctcgataacagaaatctccctatgttggatgaggctaccgggaatagttcaactccttatgattttgggtcgggtcatcttaacttgggtcgtgcgatggatcctggtttgatctatgatattactaacaatgattacgttagtttcctctgttctattggttacagtgcaaaggttattcaggtaattactcgtgcgccggtgaattgtccagcgaggaagcctttgccggagaatctgaattacccgtcgtttgtggctatgtttcctgtggcgtcaaggaggttggcttcgaagacgtttataaggacggtgactaacgtgggggt

SEQ ID NO: 1041 - DNA, 436 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagatccccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccc

SEQ ID NO: 1042 - DNA, 460 bp, Cicer arietinum
actgagctgaacaagaaaatttacaagcttggcaagtctggagaagagacccatgatgcccaaactgattatgataggactgagaaagacatcaccccaatgggtggattcccccactatggtgttgtgaaggaggattatctgatgatcaagggaggtgttgttggtcccaagaaaagggttattactttgcgtcagtctctactcaagcagacttctcgcaatgccttggaggatatcaaacttaagtttatcgatacctcttcaaagtttgggcatggtcgcttctagacaacacaagagaaacagaagttctatggacgcctcaaagcttagttatggctgctgctttgaaatgttggaaatcgttatttatgttatttttgttgccatccttttaaactctgttgtggtgtcttccgttagctattttggtaatccgtgcatactcatgggttat

SEQ ID NO: 1043 - DNA, 433 bp, Cicer arietinum
gcaactcagcctctcagcctctagcaactctgaccggtcacgaaggacctgtttgggaggtggcatgggctcaccctaagtttggttcactgcttgcttcgtgttcttatgatgggcgtgccattctatggaaggagggtaaccaaaacgaatgggttcaagctcatgtctttgatgatcacaagtcatctgtgaattcagttgcttgggcgcctcacgagttgggtctctgtttggcttgtgcttcgtctgatgggaatatatctatattcactgcaagagcagatggtggatgggacacctcaaggattgatcaagctcacccagttggtgtcacctcagtgtcttgggctccttcaatggcaccgggcgcccttgttggttcaggtttacttgatcctgtgcagaagctttgctctggtggttgtgataa

SEQ ID NO: 1044 - DNA, 225 bp, Cicer arietinum
acacgacctgaacaatcagattctatggctccactgttgtcacctgttgccactccccatctactgcttctttccataatgtcacattgttgtttccatcagctacagccagtatatttcctgtcaatgaccatgaaaccctccaaacaggtgtcttgaaatcattcaaaaccttgccatcccaatgatccccttctttgcctacagtccatatgatgactttac

SEQ ID NO: 1045 - DNA, 425 bp, Cicer arietinum
acacaaaggggaaggaaggtaagattgctgtggtggtgggagccataactgacgatatccgtgtttatgaagttccagccataaaggttacagcactcaggtttacagagaccgctagggcaagaatcgaaaaggctggcggtgaatgcttgacttttgatcagttggctctcagggcccctcttggacagaacactgttcttcttagaggcccaaagaatgcccgtgaagctgtgaagcactttggtcctgctcctggtgtgccacacagccacacaaagccttatgttagagccaagggaaggaagttcgagaaggccagaggaaagaggaacagcagaggattcagagtttgatgtgatcatatttatttgctggtattgttaacttctgatatcagatttttcctatatctagacagtgtt

SEQ ID NO: 1046 - DNA, 311 bp, Cicer arietinum
acggtcctaggttgcagctactgacgatcttaggggatcatggacttcctgcctcagggtatggaaagctacttgatttatccgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctatgagtagagaggtgcctcttgggggtaatgagt

SEQ ID NO: 1047 - DNA, 299 bp, Cicer arietinum
acagctccgaatacaacttccatagtatacccttaaagcaactagtctaacaattacttttcttataaaacacgtgtcatgttttaggtttattttgtgcatggtctaacacttgattttgggctttaacaatatatttcaaaatacataatatatattattcttcttaattatcatcagcctcactattactcacatgtgatccaaagtggttcttcaaatccacctttaagaacatcctcgtctccttttccagaacgcaataacgcagccccttctctagcatgccacattggtgt

SEQ ID NO: 1048 - DNA, 175 bp, Cicer arietinum
taaaaattctttcttggcacccactgttagtgcggtgctaggagcgggattttctacgggctatgcgactacccaaaactgcggggatgccatcggctccctaacagcagttttcagagaaggaattttggagagttcaccttctctgacaacacctttgtcggatctaatggcg

SEQ ID NO: 1049 - DNA, 436 bp, Cicer arietinum
cttactcatatcatagagagagaaagcggctgcgtagaaagttaagtgtgccaagttgaagacggtggaaatcggagagagagatagtcgcagttgaagtcaaatcaaacacaaagcaatccaaaccggttaactgtttcttcttcctccgatctgcacgatgccgtcccgaagaagaactctattgaaggtcatcattctcggtgacagcggggtggggaagacatctttgatgaatcaatatgtgaataagaagtttagcaatcagtataaggcaaccattggagcggatttcttaaccaaagaagtgcaatttgaagataggcttttcactttacagatttgggatacagctggccaggaaaggttccaaagcctaggagttgctttctatcgcggtgctgattgctgtgttcttgtatatgatgttaattca

SEQ ID NO: 1050 - DNA, 417 bp, Cicer arietinum
accatgtggaaacgtgtcacaccaatttgttcttttttccctaataccaaaacaagagctttctcaatagaatcaggaagcttaggacaaatgaaacgtccaacaataaaaggaagaaccaaagtgacaacatcaagaccatgttgttcaccaaattgaagcactgctttttctgccaaagtctttgaaactccataagaccaaccaaatggtttgacagttctaaacaaatcaacatcactccaatcactctcatccaagacttgtttgtcttttccagtgaatgaaacagcagagccacttgaagtgtatataactctttttactgtctttgaatgaacacatgcttttaaaatgcctaatgctccatcaactgttctttttgtcacaacttcttcaggttcactaactgcaaaa

SEQ ID NO: 1051 - DNA, 429 bp, Cicer arietinum
ggtgctttcggccgcagcaagcgatcgcaaccaacggggagaggattctgcacagaaattcatcgtcacaatcatgggtaaggttcacggttcacttgctcgtgccggaaaagtgagaggccaaacaccaaaagtggccaagcaggacaagaagaagaagccacgtggccgtgctcacaagcgtatgcagtactaggactctctgtgtttatgatgaagccgaacgaggtgcatagtgactctgacacagagtcatttgagttactcaacgatattgactggactaatctatgtgatccaatgtcagcagtagatattgccggggatactagtgccagtcagtttatgcagaatggaggaagtattagcttctccggaacagtttgtgaagcgggatataatgctgccaagatgatcttgctcgagttt

SEQ ID NO: 1052 - DNA, 358 bp, Cicer arietinum
acaccaaaccgaaggtcaacacgatctccaacaccaaagcgggacccactccaactccagctgaaagtgagaatgctggaacagacaaaccagtagcgaagacgaggagcaaggaagcgacgatggatccgaggagttgagcgataatgtaaacgataccacggaggagggtgatgttaccaccaacgaaggcaccgaaagtgacggcggggttaacatgaccaccggagatattggcacctacggaaacagcaacaaagagagcaaacgcatgagcgatagcggcggagatgaggccggagggactagcagcaccgtcgctggttagcttgttgtaagcgatgcttgaaccggagcc

SEQ ID NO: 1053 - DNA, 433 bp, Cicer arietinum
actgttctgaaaataataagaggcttattcatttctctacttgtgaagtgtatgggaaaacgattggtagttttcttccaaaagatagtcctcttcgtcaggatcctgcatactatgtgcttaaagaagatgtgtctccatgcattttcggttcaatcgaaaaacaaagatggtcgtatgcatgtgcaaagcagttgattgagaggctggtttatgctgagggtgctgaaaatggcttggagtttacaattgtgaggccatttaattggattggacccagaatggatttcattcccggtattgacggtccaagtgagggtgttccacgtgttcttgcatgcttcagcaataaccttctcagaggagaacccctcaagcttgtggatggtggcgaatcccagagaacctttgtttacatcaaagatgccattga

SEQ ID NO: 1054 - DNA, 450 bp, Cicer arietinum
acctcagacgatgaaaccggcgctacccttcaaacaacacaggcagaaaccagccaccagtagttcaccagttacagaaagctcatattttccaccatagatgttaaaacagtgagtaaaatgctacataattttataataactacacaccaccactataaagtagggggataaaaaaattacaaaaatagataataaaaaaaaaaaaaaaaaaaaaaagataacagaagtgaaagtcaggctttttagtcatgtatggccttgtgtaggcaaaggttaagtagtggtagtatatatatatatatatatcaacaattaggatgcatggacgaaggtgtttatctcattcatgaggcaatagaaatgatcgttgttaggcaagaagtagaaaccaatagtggcttcctttaggtaaagaagtttaacatcttgtcctgaattttttagact

SEQ ID NO: 1055 - DNA, 123 bp, Cicer arietinum
acctcagacgatgaaaccggcgctacccttcaaacaacacaggcagaaaccagccaccagtagttcaccagttacagaaagctcatattttccaccatagatgttaaaacagtgagtaaaatg

SEQ ID NO: 1056 - DNA, 460 bp, Cicer arietinum
gattagcgaggtcgcggccgaggtacagcagatgatccaaggctttccaatggactcataggcaatggagtcgaccttatcatctctttgaagatagcaccgtagtccagggatgattctgcttcaatacaaatgcgagccatgattttcacagcaagttcaggataagctccggcagcactttcaccactaagcatgacacaatctgttccatcaagaactgcattagctacatcagttgcttcagctcgggttggccgcggagacttgatcatggattcaagcatctgggtagcagtcaccacaggcttgccaacaagattacacttatatatcatcattttctgtgcaagaaaaatcttctcaactgggagctccattccaagatccccacgtgccaccatgaatgcatcagtctcacgcaggatctcatcaaagttcatgactccctcttgattct

SEQ ID NO: 1057 - DNA, 198 bp, Cicer arietinum
ggtttactatttaggaatatatagtagaacaaacaattacatatagcacgagaattatttaaaggaaatgactctttaaatcattcctaaaacaatcatcagtccaacataacttacttctcacttatactcagattaccagaccattttaatcgagagtcagattattaaaaacacatacacaaatttcattttact

SEQ ID NO: 1058 - DNA, 293 bp, Cicer arietinum
actcatagatacattcaacgtcgttcactgtaacagataaagattcaattcgatcaacgaagataaacatcaaacacatcaaagccatccacatcttcgcgcttctctttccctgcgcttgctccatcgctttttcccccttatttatttatttattttggggaattttttttttttttggaatgaaaaaagaattacgaaaattgtggttgagaagtgttattcccagatcttaaagacttgaattttgagaaggtctgtgatcctttctccgtttctcgtcactctggaag

SEQ ID NO: 1059 - DNA, 326 bp, Cicer arietinum
acaagtgatttagtcagaagatgaggttgctaataaactgacaacatcatcttccagcccttgtcagggttctctccttcaagacttcatcagaattcgaggtcaatgaaggtaaaggaagaggctccgaacaaacaggagaggctttggttgtcgccaactcttcatttgcaggtgtatgcacaggttgaagaggttttggtgtgtatgtgaggttaagatctttgttttcagataaagctatgagctctttctcctctaaccctttggttggttccaagctgcatctatctggagtgtgtttggccaatgcatcttaaccttgg

SEQ ID NO: 1060 - DNA, 372 bp, Cicer arietinum
caaattacccctcctcatggtttgtgccttgagaaaattggtaatggatcttatctcaatatggttgctcatccagatggatcaaaccgcgcgtttttctctagtcaaatgggaaaagtttggttggcgagtataccggaagaaggatcgggaggacaattggagcttgatgaatcaagtccatttgttgatctgactgatctagtttattttgatacacaatttggaatgatggggatgtcatttcatccaaatttcgcaaacaacggtcgattcttcgcttcgtttaactgtaataaagataaatggtctggatgcaatggtatatgttcttgtaattcaaatgttaattgtgatccatcaaaactaggt

SEQ ID NO: 1061 - DNA, 386 bp, Cicer arietinum
aggtctttctttctgccgtgtcgtttgctgttattttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttcatacttccagtattgagctctgtaattacgattatgactatgacaatatctcttattgtgtgacgtgttttattactgatgttagt

SEQ ID NO: 1062 - DNA, 301 bp, Cicer arietinum
aaatgattaccggcgttaacttactttctgtgtttttatccaaatgaggatgaattaaggtgaaggagagaaatcaaagggatatggcgagcgagaagattaagattaagaagatagacaacgcaacagcgagacaagttactttttcgaaacgaagaagaggcttgttcaaaaaaggtgaagaactctccgttttgtgtggtgctgatgttgctctcatcattttctcttccaccggaaagctctttgagtattctaatttaagcatgagggaaatacttgaaaggcatcatttgcactc

SEQ ID NO: 1063 - DNA, 184 bp, Cicer arietinum
acgagaccattaagaaccagtggcagagtatctcctcggctcaggctaaacgattcacgaaattcagggaaagaaaagggcttattgagaaagatgtggtgagaactgatagatcgatcactttctatgagggggatgataatccaaatgtaaatgttctgcgagatatcctgttgacatattc

SEQ ID NO: 1064 - DNA, 210 bp, Cicer arietinum
  misc_feature (96)..(96): n is a, c, g, or t
  misc_feature (135)..(135): n is a, c, g, or t
  misc_feature (166)..(166): n is a, c, g, or t
acaaaaacgagaaccacagtaacacaaaaccataacatgataaataccatagccaaaccactaatttcttaaacctactaaagtgacatgacaagnagaacattcttaatcataaaccccaactagaagaacttnaagctagtccctccaggttccaccaccttcnccgccacgtgagtagcgagaaccaccatcaccaccaccatatcc

SEQ ID NO: 1065 - DNA, 363 bp, Cicer arietinum
actaattgctgttaaacaatattgggttactgatggaaattccacatcaacagaataatcactgagaaaaacaagttgaaattacagtcctagccttaaactgccactaccttttctattatacaatagtcaaagagttcaaatagtttgtcaatggaattttggctttaattcatcatcaaaactgtgttagagagaggggttgcttcagctttattctacaagtcattttttggtattaaatttaatttacagtgtaaagagtagtaacccccttctctctgttccactatctctctaatagtttctgttctggactggaccaagatcagtttcttatttatttaaatgtttttggtttgt

SEQ ID NO: 1066 - DNA, 386 bp, Cicer arietinum
acaatgttggatagccttgaaccacaaaggtttcgctagggacatcattggcagtagcatcaagttttgcaataacaacatcagcatcactttggtatgagacggcaacttcatccaaaattggagccaactgtttgcaatgtccacaccaaggagcataaaattcaagcaaaacattcttcccagagttgaaaactatgtcctctagagttttcccaactaccactttaacaggctcgttgttagtttcaggaataggctcagacttgacaaatggtgcaagagttccctccttgtatgccttcaaccaagttggaacatcatcagcttccaaattgggtttgaaaaatttcttcccatcagtattctgaacaataattagaggt

SEQ ID NO: 1067 - DNA, 150 bp, Cicer arietinum
tgcactgttaggagcgggattttctacgggctactcggccacacaatactgcggggacgccatcggctccctaacagcagttttcagagaaggaattttggagagttcaccttctctgacaacacctttgtcggatctaatggcggcacc

SEQ ID NO: 1068 - DNA, 356 bp, Cicer arietinum
gattagatcgattggcgtttctagaggccaactatccaatatgagtaagcttcagagtgatgctttgagagaagccatctcaggaatcacggctgattccaaggagaaaaacaggaaatttgtggagactattgaactccagattggtcttaaaaactatgatccacaaaaggataagcgtttcagtggttctgttaaattgcctcacattcctcgtcccaagatgaaaatctgtatgcttggagacgctcagcatgttgaggaggcagagaaaataggattggactggatggatgttgaagctttgaagaagctaaacaaaaataagaaattggtgaagaaacttgcaaagaagt

SEQ ID NO: 1069 - DNA, 433 bp, Cicer arietinum
cgttctagccgccttggggttttctcctgcaagggttttccccaaggatgcacggttctagggttgcagctactggcgatcttaggggatcatggacttcctgcctcagggtatggaaagctacttgatctatccgtgcaggagaattctaggctggagaggaatagttcccgctgacgggatgacctcttgaaagtaatgcgccttcgtgccgatgatatgctggatgaactagacggaatcgcagttgcatggggatatgtcctgaatcacctgctttgacatccaagatgatgtgcttgaacctaccgtagggctggctacgagtaggaaggtgccctcgggggaaggagctcgagaggctctccgttgatgcgagtggacatggcgggtattctaggaggagtccagcgcgacagcaattgtagatagt

SEQ ID NO: 1070 - DNA, 424 bp, Cicer arietinum
tggtttcgaatcagtcgatggttctagaaagcaggtttctggaacaaacaaactacgttctggaaattattgggaaggagcgccaattatttgagacttcacaacaacaatgccagtataacttacaagaaaaaataaatcaacagtccatagaatacaacaaattgacaactcaaatcgaaggacaaaataaagacatacaagaaatcaaacaatttttaaaattattggtccctagaatagttggaatcgaagcatcctataaagtactttcaactgaaaatccgataatggaaagccaacaaaaaccaagaccaataaaacggaaaaaacaaagctagagctccttgccttttcgggaatgtgaaagcgattttaagtttctgcctttgctcacatgacggaatctaaaatttgtgtgttg

SEQ ID NO: 1071 - DNA, 371 bp, Cicer arietinum
ggcaaagtataaagacataactagcaaagcataacacaagtgttgccgcaacaaattcatgacaaaaacagcaaaacaccatttaggaaagggactataataaattcatacactgaataaattaaagtaaaaaaagtcttaaaccaacaaaaagacttgtcaaaactactttagaacagtaaatgagggtgccagtccaaagattctgccaagcgatctcagaatgccactcacttcttggttttctttggtgcttgtgttggctgtgatgcggcggcaggtggagcagcaggtgcagctgctggcttctctccaggaccttgagcaaatcgctcctccctccgagcaaacttcctttctcggctggcttt

SEQ ID NO: 1072 - DNA, 348 bp, Cicer arietinum
actgattcaccatattggctgaaaacttgcctcagatgatcatcagtgacattaggatccaaattgccaacaaaaatagttgtattatttggatcattctcgctttgtgcaccttgagagttctgatatgaagctttcggctgctgagtggtggcggcaggatttttattagaggctggtccaatcctcatgggccttgttgaacaaagaaccccttgcatctcagtcatagccctaatttgttcactctcggcagcaaatctaacaaaaccataacccttagaccgacaagaaagcctatcaatcacaacttttgcccccttcacagagttataacgagccctaaaa

SEQ ID NO: 1073 - DNA, 337 bp, Cicer arietinum
acatgaaaggggagataccggggaggttgatgttctcacaaaaggagataacaactatggggatgacaggctactgtatgctcatggtcagctatggctgaatagacaccacattatgggtagagctgttgggttcttgccttatgttggctgggtgacaattatcatgactgaaaaacctatcatcaagtatattctcattggtgctttggggctgctggtgataacttcaaaagagtaaatgatgatgaatctaaatcaaactaaatgggtctggcctccaagagcactatgagcacatgtcatgctttttttgaacttgaaggtgtcattttgt

SEQ ID NO: 1074 - DNA, 402 bp, Cicer arietinum
acccgacgaaaatcattcaccggaattcctcattcagaaaatggctttaggtggaggaggtccccaaagaggaagtgcagcagctaccgcaagcatgaggagaaggaaaacagcaggtggtggggcatctggcggagcagctggaactatgcttcaattttacactgatgatgcccctggactcaaaatctcccctaatgtggttcttgtaatgagcattggctttattgcttttgttgctgtccttcatgtgatgggaaagctttattttgttcgcagggaggcttaagggatataagtcaagaagttgggtttataacacttactctgttaatgaacttagatttctgttgctagacccacataaccccttgtgatgttatatttctttttgttcttttg

SEQ ID NO: 1075 - DNA, 418 bp, Cicer arietinum
actgtcagaagaaagaagaaggccgtccacaagacaacaactacagatgacaaaaggcttcagagcacccttaagagaataggggtgaatgccatccctcaaattgaggaggtcaacatctttaaggatgatgttgttatccagttcttaaaccccaaagttcaagcatccattgctgctaatacatgggttgttagtggtgctcctcaaacaaagaagttgcaggatatactccctagcattattcaccaattaggaccagataatttggaaaacctgaagaaattagccgagcagttccagaagcagcctcctgaagcaggggctggttcaaccgctgcacaagaagagaatgatgatgatgttccagagcttgttccaggagagacttttgagacagctgctgaggagcctaagg

SEQ ID NO: 1076 - DNA, 153 bp, Cicer arietinum
acagagaattgtttgtgcatcagggagagaacataattctctcaattaccttgacaaagctggccgaaagcttatcaaatttggaagatcagctgaatggagcttcttaattgcagccgcaggtgccttgcgagactccaaggagagagtgca

SEQ ID NO: 1077 - DNA, 352 bp, Cicer arietinum
actggatggatgacaattatctctacacctgcttcggtcaaaccggcgaggtaacatctctgaaagtgattaggaataagcaaaccagtcaatcggaaggttatggttttatcgagtttaattctcgtgctactgccgagagagtgcttcagacatataacggagccattatgcctaatggtggccagagctacagattgaattgggcgactttcagtgctggggagaggtcgtctagacaggatgatggtcctgatcataccatttttgttggtgatttggctgttgatgttactgattaccttcttcaggagacttttagggctcgttataactctgtgaagggggcaaa

SEQ ID NO: 1078 - DNA, 402 bp, Cicer arietinum
  misc_feature (164)..(164): n is a, c, g, or t
acacaaggaaaggtcacagttttttcttttttgtagagttcatgatacaaattaattaaacattgccaattgctatgttgttcaaacatcatccaataatatgaaacaaggactaaataataataataataatatcatatccatccattattaaaacctaagangaagcattggaggtgtcaaaagatttctttctaaccaaaagacaagtgattcttgaaggatttgaatgtgtgttatcaagacaacatactaaaaaatcaggcctatgaagtccaacatgtaacctatcctttcccacaaccaaggaagaagcatcaagcaaaacatgccaatagtttctatgtgcctcagaaacccaatgcattgttccattcacatctgctgcataagcaaacaacc

SEQ ID NO: 1079 - DNA, 138 bp, Cicer arietinum
atcgactaaagcaatgaactaatgaagaaaacaaacaagacataaaggtaaaagaacataggaaaagaccccaaataaagaaaatgaataggcgcgttaccctgcaaaaatatcaaattgaaaatgacccctaacagc

SEQ ID NO: 1080 - DNA, 292 bp, Cicer arietinum
gccgaggtacactggagttcacgctattgctggaaggcacactcctggaaccttcaccaatcagctacaaacttccttcagtgaacctaggttgcttatcctcaccgatccaagaacagatcaccagccaatcaaggaagctgctcttggaaatattcccaccattgctttctgagacaccgattctccaatgaattatgttgacattggaattcctgctaacaacaagggaaagcatagcattggttgtctcttttggcttttggctaggatggtgttgcagatgcgtggt

SEQ ID NO: 1081 - DNA, 350 bp, Cicer arietinum
acgccagtaaaacagaccttgcctgaggtccttaacagtctcgcttccgccatactctttccggaaccgggagatgacaataacttacttcgccggatcaaaaattccgtcgccgacaacgcttcacttcttccagaagcttctagaaattctgcacgtgatattcttctatggactcgtcgcggtagccacctacgcgctatcctcgttatctccgttggggcggttacttttgtttctcttacaggattgcttgtatttacgcttttctttctggccgcaaccataaatgccattgtcatatcgctgctgatgtcattggctgcagctggagggttcttggctctttt

SEQ ID NO: 1082 - DNA, 344 bp, Cicer arietinum
acgtcagtaaaacagaccttgcctgaggtccttaacagtctcgcttccgccatactctttccggaaccgggagatgacaataacttacttcgccggatcaaaaattccgtcgccgacaacgcttcacttcttccagaagcttctagaaattctgcacgtgatattcttctatggactcgtcgcggtagccacctacgcgctatcctcgttatctccgttggggcggttacttttgtttctcttacaggattgcttgtatttacgcttttctttctggccgcaaccataaatgccattgtcatatcgctgctgatgtcattggctgcagctggaggggtcttggc

SEQ ID NO: 1083 - DNA, 192 bp, Cicer arietinum
tgatcaggtggcacgcgagtcgcttattgctatttccaacacttcaccagataagattctggattcaaattctgtgtccgagagcaagaaatcagatgggggtgtgttgccaaactgtgatcaggatgaacagtttaggtctgaactgatttcaatttcatattctgaatcacctgatgtcaagattggatc

SEQ ID NO: 1084 - DNA, 426 bp, Cicer arietinum
acaatggccagttgtggaagttgagaagctaagagtaaatcttgtcaacttgccccccaaagttctcaagggaggtgaattgctgcaaattaacggtgtcacagcagcacaagctgatgttgaaatttcatttgaagtgaataacattggagaggctgaagttttggacaattggacagaccctcaaattctgtgtagccaaaagggttcatcagtaaaaagtggtttgggaccctttggtctattagtttttgcttcaaaggggttgcaagagttcacatcagtgttctttagaatattcagataccaacacaaaaatttggtgctcttttgcagtgaccaaagcaggtcttccttgaataaagataatgacatgaccacttatgggacttttatagacgtggatgttgttcacgagaagctgtc

SEQ ID NO: 1085 - DNA, 344 bp, Cicer arietinum
ctcccacttcctccaccgtctctcacattcacatccggtttcgaaccaacccgagttgaatcagtgagtcgagttgagtcatgtcggacgaggaacaccactttgagtccaaggccgatgccggagcttcaaagacttatcctcagcaagctggcaccattcgcaaaaacggttacatcgtcatcaagggtcgtccctgcaaggttgttgaggtttcaacctctaaaactggtaagcatggtcatgccaagtgccactttgttggaatagatattttcaccgccaaaaagcttgaagatattgtgccctcttcccacaattgtgatgttccccatgtgaatcgt

SEQ ID NO: 1086 - DNA, 219 bp, Cicer arietinum
gacgcaattgaagggatggacggtcaagatgttgacggacgtaacattaccgtgaacgaagctcagcctcgtggtagcggtggtggaggcggccgtggtggcggtggatatggtggaggcggtggatatggtggtggacgtcgtgaaggtggatataacagaggtggcggtggaggatatggtggtggaggtggatatggcggaggaggtggtggtggt

SEQ ID NO: 1087 - DNA, 274 bp, Cicer arietinum
acagaggccagaaaagatctcagttggaaaagagcttcgagagagattcactggtgctgttgaagcattctcgcggaggaacccaacaacttctagtcctcgcgttgaacacgccaagcataggagttttgaggatgtcactgcaatgcacaaggatgggtatcacgatcaagagaagggacgcaatttgactcgatatggaagcagttcaagaagaccaataatctcatcatcgaccaggccaacttcctcaggtgatcataccgacactcgt

SEQ ID NO: 1088 - DNA, 366 bp, Cicer arietinum
acataccaagagattgcaggaacgaagaatactattggccagtatgagagccacgctgcttttactcttcctgggctctacagggttgttcatggcattgatgtctttgatcccaagttcaatattgtctctcctggagcagatatgacaatatatttcccctactctgaaaaggagaaaagactcacgtccctgcatggttcaattgaaaagctattatatgataccgagcagactgacgagtgcattggttcactgaaggaccggtcaaagcctataattttctccatggcaaggctagacagagttaaaaacataactggtttggtagaaagctatgctaagaacagcaaattgagggaactg

SEQ ID NO: 1089 - DNA, 183 bp, Cicer arietinum
ggaagggggaaaaattcaattacatattaccatacttttacaaatgacatacatagaaacatatatcacatacaacactcatacataaacacacataattttcaaacactctttcaatatttcatttttcttctatatctctcttcctatcacatcatcaccatatcacatcatcatctttat

SEQ ID NO: 1090 - DNA, 422 bp, Cicer arietinum
  misc_feature (275)..(275): n is a, c, g, or t
atttatgtttctattctttggcaggagctctttacaaggttttttgtgcatcccctgatcaagcaaggaaggaaatgcgtcaagcttgttttgattatcttagccttggaggcctattctcggagggaccgatatctttactttcaggattaaaccctcgacccttaagcttggttctccatttctttgctgttgcagtatttggtgttggccgtttactactaccctttccttcacctaaacggatgtggatcggagctaggttaatctctggngcatctggaattatcttacccataattaaggctgaaggaattcgccaaatgtttttccctgctcctgttccagcttattacagagctcccccggcttcacaagagtgagtatcggcaaatgcatttcaagatgagctagctttattc

SEQ ID NO: 1091 - DNA, 238 bp, Cicer arietinum
gaaaagtataccccagaaaagagaaagaaatcaaaagaaaaagaaaaggtaggttggagagaatatagcaaaactgcataaagcatcttcatcatcatcaccacaagaaaccgttgttcgatagatctgtggagaacaagatgggacacaaccagaaccaaaaatctctgatctacgctttcgtttctcgaggaagcgtgattcttgctgaattcaccgaattcagcggtaattttaa

SEQ ID NO: 1092 - DNA, 400 bp, Cicer arietinum
actaggtatcctcatggaacttttgaatcagatggatggtttcgatcagacagtgaatgttaaggtcataatggcaaccaatcgggcagacactttggatcctgccctcttgcgtcctggaaggcttgatcgcaaaattgagttccctttgcctgatagacggcaaaagaggcttgtatttcaggtttgcacagccaaaatgaacttgagtgatgaggtggacctggaggattatgtttcccgtcctgacaaaattagtgctgctgagatatctgctatttgtcaagaagcaggaatgcatgctgttcgtaagaatagatatgtcatactgccgaaggacttcgagaagggttacaggacaaatgtgaagaagcctgatacggactttgaattttacaag

SEQ ID NO: 1093 - DNA, 436 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtc

SEQ ID NO: 1094 - DNA, 460 bp, Cicer arietinum
gcttccagcgcccagggtttcactcagatttcacatctagggtctatttttctccgccgatccatggctcccaaaggtgatgtttcaaagaagactgacccaaaggcacaggccttgaaagctgctaaagcagttaagtcaggcactgccattaagaagaaggcaaaaaagatccgaacatctgttacattccataggccaaagactttgacaaaggagaggaacccaaaataccctcgtattagtgctacaccaaggaataagcttgatcactatcagattctgaaatttcctctcactactgagtccgcaatgaagaagattgaagacaataacacattggttttcattgttgacttgcgagctgacaaaaagaaaatcaaggacgcagtgaagaaaatgtatgacatccaagccaagaaagttaacaccttgatcaggcctgatggcaccaagaagg

SEQ ID NO: 1095 - DNA, 431 bp, Cicer arietinum
acatggattgagaaatgcatagctattttgataaatttaactacttctgaagttggaagggaggaaatggtatcaactcctggattcattagcgctttggcttcaatattggacaccgatgagctccttgtgcaggagcaagctgtctattgtctcctaattttgtgcaacagtagtgagcaatgttctgacatggttcttcaagaaggggttataccagcgttggtatccatatcagtgaatgggaccccaagagggagagaaaaagctcagaaactcttgatgctgttccgacagcagcgacgagatgattcacctgttgaggaacatcaatgtcctcctgaaaccagtgatttgtctatgccgcctgctgaaatgaaacctccatgtaagtctatgtctagaagaaagactgggaaaggttttagctt

SEQ ID NO: 1096 - DNA, 249 bp, Cicer arietinum
gataacaacaaagtgaaaatagatatagaatgatacggaggtctacacaagcacaagcatatattcaaattattcagttgcaatgcaagagatacgggctgaaataactactacgaaaaactctgtaggcgtgccttgatccatgactcaagataccgcagctcctcgctggttatcgagtgggcaagaccaggataagccttaaactcacaaccaacaccaattttttcaaggaatggaggggctgct

SEQ ID NO: 1097 - DNA, 398 bp, Cicer arietinum
gctcaaaattgctctgctactcttaagggtaaccataagattactgatgctaatcttcctgaagagaaagactggaggaaagaaggaatagtcagccatgttaaagatcaaggcagctgcggatcatgctggacattcagcacaactggagcattggaagcagcttacgcacaggcctttggaaagaatatctctctttctgagcagcagctagtggactgtgctggttctttcaataactttggctgcagcggtggtttgccatcccaagcctttgaatacattaaatacaatggtggccttgagacagaggaagcatatccctacaccggagaaaatggcctctgcaaatttacatctaaaaacgttgctgttcgagtccttgaatctgtcaatat

SEQ ID NO: 1098 - DNA, 293 bp, Cicer arietinum
actaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 1099 - DNA, 328 bp, Cicer arietinum
acaaaattaaacaaatccagatagataacagaacaactatgcagtaagcaaagttgattcactgacatacagattgtgaaaccatggattctcaactacaggtttgtggatgcaaggggctttgacaatagcaacaattgcatcattttcttctacgttttcttcgtttcctgtcactttcatcagaacttgctgagtctgcctctgactcagaactagtagttcctgaatctgatgaaccggagctcgcagactcattgtctgagtcagaatctgaaacttgtttctgttgttgcatgatcagacgtggcatatttttcaagtacct

SEQ ID NO: 1100 - DNA, 293 bp, Cicer arietinum; identical to SEQ ID NO: 796

SEQ ID NO: 1101 - DNA, 366 bp, Cicer arietinum
ccacagcaattacccattctccggcggcaatcatccctgtccaagcggctaggctaagatgtctttggtggcaaacgaagaatttcagcacattttgcgtgtgctgaacactaacgttgatggcaaacaaaagataatgttcgcactcacctccattaagggtattggaaggcgatttgccaacatttgctgtaagaaggctgatgttgacatgaacttagagggccggtgaattgagtgctgcagagttggataatttgatgacagtggttgcaaacccacgtcaattcaagatcccagattggtttttgaataggaagaaggattataaggatggaaagttctctcaagttgtttccaattcac

SEQ ID NO: 1102 - DNA, 469 bp, Cicer arietinum
actgctggaatctcaggtggtcacataaatccagcggtgacatttgggttatttttggcgaggaagttgtcattgaccagggcactgttctacatggtgatgcaagtgttgggtgctatttgtggtgctggtgttgtgaaagggtttgaaggaaaaacaagatttggtgatcttaaaggtggtgccaactttgtgaaccctggttacaccaaaggtgatggacttggtgctgaaattgttggcactttcattcttgtttacaccgttttctcagccactgatgctaagcgtagcgccagagactctcatgtccctattttggcaccattgccaattgggttcgctgtgttcttggtgcatttggctacaatcccaattactggaaccggtattaatccagctcgtagtctcggtgctgcaattatcttcaacaaggaccttggttgggatgatcattggatcttctggg

SEQ ID NO: 1103 - DNA, 253 bp, Cicer arietinum
acgcgggggaagaatgacttccttggcattgcttatctcactgtcggaggattatgcttctttttgtctttggcttttaccattgtatatttcgtcaagccaaggcaactaggagatccttcatatttgtcatggaataggaacccaggaggacattaagcaaaaataccaattgtgctatgttcgttaattccaatttccaatattacagggcttggttattctacagtgacagatgtgatgtagtttttgt

SEQ ID NO: 1104 - DNA, 200 bp, Cicer arietinum
gaaaacaaacataacacctcaatctatcattattatcattacataacatattatcccctttctccgccgcgttctacaaacacgttaattaatcataactcataataataataaataaaaacacaaagccctctctccaacatcaacatgcaattcagaaggtagatgaaatgtcagccgaatgaatgatgtaggtcagt

SEQ ID NO: 1105 - DNA, 203 bp, Cicer arietinum
acaaatggcagcctgaaaactggtctgacaactccaagttgagcgagagcggtgttcaaaccaatgggattgggcatgtggaaaagccagtcaattagaggcaagagcttggaattcaatgtaggatttttgcccccgaacatgagatctcgcattaaaccaggaatcaggttgcttgcaacagatatcactccagttgcccc

SEQ ID NO: 1106 - DNA, 374 bp, Cicer arietinum
gcggccccgggcaggtacgcggggacgactcttcgagtaattcgaggccactccttttatatggtcattgctgataatggcttcttcctttttgacaaagattcttttaggtcctcgctcgattatcactcaccacccaccaattctctcttctttcttctctaaacggctgttctctatacaaactgttccaacctctacagcccaaaacaccaaattgactggttgggctccttgtatggcttcttcaatagttggtagaagagctgcatattcaacacgatctgcacccacaaatgagccagttgtgtctgtggattggctttatgataacctgaaggagcctgatattaaggtggtggatgcatcctggt

SEQ ID NO: 1107 - DNA, 372 bp, Cicer arietinum
acctagttttgatggatcacaattaacatttgaattacaagaacatataccattgcatccagaccatttatctttattacagttaaacgaagcgaagaatcgaccgttgtttgcgaaatttggatgaaatgacatccccatcattccaaattgtgtatcaaaataaacttgatcagtcagatcaacaaatggacttgattcatcaagctccaattgtcctcccgatccttcttccggtatactcgccaaccaaacttttcccatttgactagagaaaaacgcgcggttcgatccatctggatgagcaaccatattgagataagatccattaccaattttctcaaggcacaaaccatgaggagggttaatttg

SEQ ID NO: 1108 - DNA, 257 bp, Cicer arietinum
accagtggcgctgtctgagagagtggagacccagcttgtcagtaatctcagcagcattcattgcattgggaagatcttgtttgttggcaaacacaagcaatactgcatctctaagttcatcctcattcaacatcctatgtaactcatctctggcttcaacaactctatccctgtcactgctgtctacaacaaatataagaccctgggtgttctggaagtagtgcctccacaagggacgaatcttgtcttgacccccg

SEQ ID NO: 1109 - DNA, 259 bp, Cicer arietinum
acataaagatctgtttccaatcttctttaaaaatcaaacattgcttctaattaagcatcttctgagctctgaacaccctctagtatctagtcaatcactcttatcctgttgtaaaccaatcccttgcaggaagtgttctgcatccaaagccgccatacacccagtgccagcagcagtaatagcttgcctatacttcttatcctgaacatcaccagcagcaaaaactccctcaacactagtcttcgtagtccccccgcgt

SEQ ID NO: 1110 - DNA, 285 bp, Cicer arietinum
acgacaagaagaaattcatcaaaccacacggctaactaatggtcacccattacatagaataaatgtatcacagagacaatgacacatatactaaacatatgtatcaggaaaagaattatattacaacatgtccatgtatcagttaaggaggagactgtgaaaccacccaaccaaaccaatggctcccctgagaggaagtatccagagaggacaaccaaacaagtagaactctagttccctccgtccaaataacgaaacactacacatagcaacacagagtcagac

SEQ ID NO: 1111 - DNA, 323 bp, Cicer arietinum
ttccgaagtcaaggcaatatgcaggcgagtgataggtttaacatcaattcccaactcgagcatctccaagctaaatatgtcggaactggtcatgctgatatgaacagatttgaatgggcagttaacattcagcgtgatagctatgcatcttatattggccattatcctttactctcctacttttctattgctgaaaatgaatctattggaagacaacgctacacttttatgcagaaaatgctcctgccttgtggtctgcctcccgaaagagaagaagattagaattactgttgggattacaaaaggattcgactgtttgttgt

SEQ ID NO: 1112 - DNA, 410 bp, Cicer arietinum
acatgccaatgtcatacaacaaatgccctttataaacctagaaatatgcttctgttattgttcaaaacaaagaaaagagaacaatcatgcaaacatatgtataagaacatacacaaccctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcg

SEQ ID NO: 1113 - DNA, 315 bp, Cicer arietinum
actgtattttcaaagttcccaatggccataacgaccaaaaggagaccacaaactatcacctaccattcagaaaccaccccgacaaatgcagtcctgagcaaggattgtccaacataagcttcaaatccctgcaatatgaaaagtatgggacatagcaaccacagttggccatccacaccagctgtttccccccatacaacatccatcctcttagcctttcccaatgcaatgcgggtataaagtctttgacgttgatatctattttgcaaaagcattgcaactccttgcatcatagcccactgcaggaaaagttgt

SEQ ID NO: 1114 - DNA, 359 bp, Cicer arietinum
ctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaagtcgacagtatgcccccgaacccgctgacgggtgacgggctcgagaaaatacagcgccttttgtgccttggtatgctggatggtgaaggaagcggggtatcctgt

SEQ ID NO: 1115 - DNA, 337 bp, Cicer arietinum
accgatacacacaattacacatattggttccaatatctctgcctcaagctttcatttgctatatgcacctcacttgcagttgcaagggtcacatgtgcagcttgatccacacttgcagccaccatcttcagctgcaacactcatttcagctccctcgaactgaatcttcgtcggaccaacgcccaaaaccaccgtctctgtggtttcgccgccttcggcatagttcaatccactagacctcttgttgcatttgcagctatcaccacagttgcagctacttccacagttgcagccagacatattctcaaaagacaaagataaaatcactcacaacaca

SEQ ID NO: 1116 - DNA, 434 bp, Cicer arietinum; identical to SEQ ID NO: 611

SEQ ID NO: 1117 - DNA, 226 bp, Cicer arietinum
accaaaatcaccattgtctaacgcctgacaaagctgaaggagcttatcagcagcatttttggagatgtctccactgttcaactttgcaaacaacccaccaagtctctttgagttgtcttctatctcccgcctctttgctgggtttgcacgtgaacctccaagtgcttccgatgtctcattgaaaagtcttgtcaatgttgtgacaatgggtgtttggtgcacaggt

SEQ ID NO: 1118 - DNA, 275 bp, Cicer arietinum
gacaaaaacttcaacgattatccaataataaaacagaacttcgccggcaaaacaaaattgttcagatctttatactagtcaacataaagaaaatcagaactacattcaatagatataatcagatgtcttggctcaatcgaaagtcaaatctcaaattccggtaaaagccttctttgcaacaccgctggatgaaccagctgggatcaccttcaacacgttgaacctcactgtcttggagagcggcctgcattggccaatagtaacatgatctcctt

SEQ ID NO: 1119 - DNA, 419 bp, Cicer arietinum
accatatcattccccaatggcaaagatgacctgatgaactttgaagttgtaattcgacctgatgatggattttacttaggtggcacatttttgttttccttccaagtgtctcccatctatccacacgaagcacccaaagtgaagagcaagacaaaagtctaccatccaaatattgatttggaaggaaatgtttgtctcaacatcttaagagaagactggaaacctgtccttaatataaacactgtcatctatggcttgtatcatctctttacggagccaaattacgaggatcccctgaatcatgatgcagctgctgtgttgagagagaacccaaagatgtttgaatctaatgtgaggagggcaatggctggtgggtatgtggggcaaacctttttcccacgctgtatgtaaaccgtgct

SEQ ID NO: 1120 - DNA, 181 bp, Cicer arietinum
gatttcgagcgggccgcccgggcaggtatccaccataaatacattggcaggagctctttacaaggttttttgtgcatcccctgatcaagcaaggaaggaaatgcgtcaagcttgttttgattatcttagccttggaggcctattctcggagggaccgatatctttactttcaggattaaac

SEQ ID NO: 1121 - DNA, 400 bp, Cicer arietinum
accccatgctatagcaatcactgcccagaaataaaagtaacctttgctgaactctcctgcagggagagaaagaataggccataatatgactatcaaaacagtgaagccaacaccccacttcactatccacactttggcccttattaacttttcttctctaaactcttcagctggcaattcagtcttttccttttcaaccactgtgatttgtttggtgctactccaatcatagttttgaggccacaacatgctgcatgcggcatgaacagctccacctgttagtattgaaacaaggtttccaacaagcattggtgcatttcttccagttgtatcaaggtttatcataccatactctatttttgtaacagacaaccatgtgattattccaagaacacaacca

SEQ ID NO: 1122 - DNA, 460 bp, Cicer arietinum
gatttcgagcgggccgcccgggcaggtatccaccataaatacattggcaggagctctttacaaggttttttgtgcatcccctgatcaagcaaggaaggaaatgcgtcaagcttgttttgattatcttagccttggaggcctattctcggagggaccgatatctttactttcaggattaaaccctcgacccttaagcttggttctccatttctttgctgttgcagtatttggtgttggccgtttactactaccctttccttcacctaaacggatgtggatcggagctaggttaatctctggtgcatctggaattatcttacccataattaaggctgaaggaattcgccaaatgtttttccctgctcctgttccagcttattacagagctcccccggcttcacaagagtgagtatcggcaaatgcatttcaagatgagctagctttattctcccgttcttga

SEQ ID NO: 1123 - DNA, 406 bp, Cicer arietinum
acttaggatgtaatgtgaaaatactttgtgtaagttttagctatagtatttcactaatttatggtatgctagttctattgtaacttagtcatctacaatatgttttcttcttgctcaaggagaggaagaaattgtgaaataaattatgatattgaaattaaacatctttaaaaaaaaaaaaaaaaaaaaaaaaagtacttccacggtgaagaactttgatagcaacaatttgatctacatatcttccttgataaacttttccgtgagctccttcaccgattttcgagccaataaagagcaatttggggtcaacaagaagattgtcatcaatggtaaagtgtgtggtggttgttaaagacccatttgtcctcactgatttttcacattccctctcttctccttctat

SEQ ID NO: 1124 - DNA, 400 bp, Cicer arietinum
acttaggatgtaatgtgaaaatactttgtgtaagttttagctatagtatttcactaatttatggtatgctagttctattgtaacttagtcatctacaatatgttttcttcttgctcaaggagaggaagaaattgtgaaataaattatgatattgaaattaaacatctttaaaaaaaaaaaaaaaaaaaaaaaaagtacttccacggtgaagaactttgatagcaacaatttgatctacatatcttccttgataaacttttccgtgagctccttcaccgattttcgagccaataaagagcaatttggggtcaacaagaagattgtcatcaatggtaaagtgtgtggtggttgttaaagacccatttgtcctcactgatttttcacattccctctcttctcc

SEQ ID NO: 1125 - DNA, 266 bp, Cicer arietinum
actgcaccatgaatcgatgctacagctgaaccagagcttgcatttctcgattttcttctcttttgtataatatttccctctacataagctctatcacggaaatctttagctagatcttcatctccacccttcattaagcctgctagaactgctgcggcatgttctcttacctcaacttggttgtctactagtaacttctcaactgttctccaaatttcttgtttctttgaacttgagagaatgaaagtgtgcctgtacatgaaagt

SEQ ID NO: 1126 - DNA, 261 bp, Cicer arietinum
accactgcttgaatggtgcagcatccacctggacaatagcacccttaacaagagtctgtgttcggacaagctcgttatttgaggcattgtaaaccacatccagaagacgagtcttgcgagttactgcttcactaccccatgagaagttaccagtatccaatctaagagctctccacttcacattaccccctcgaacacggatcctcctgactgtcttgttgcttgataatttagtgtttgctggctgacgaccaagctcgt

SEQ ID NO: 1127 - DNA, 262 bp, Cicer arietinum
tacttcatgggattcacttcgaaaacgggcgagaaaactctaagctcaattggatgagcagatgaatgcttatcgtaaattagtttcttctaatatttcgacaaaagctgatgccgcagagagtgatctagagtcttggattgagcggttaataaaataactccatcaagtaaactcacagatgcaagcttgggtatcctctggtggttcagatatggtttctcatactttgactagacaccaagaagttcttcaagatatc

SEQ ID NO: 1128 - DNA, 405 bp, Cicer arietinum
cacaagacatggctccaatgagcttgggtttgtctcatagcttatccagatacaagctgaagttcagtgccgagaaggttgataccatgatcgtccaggctattggtttactagatgatcttgataaagagctgaacacttatgctatgagggttcgtgagtggtatggttggcatttcccagaacttaccaaaatcatacaagacaatatccaatatgcaaaagctgttaagttgatgggtgaccgcactaatgctgcaaagcttgatttctctgagattctggcagatgaagttgaggcagaattgaaagaagcatgtgtgatatctatgggaactgaaattggtgagcttgacttggcaaatattagagagctctgtgatcaggtgttgtccctttctgagt

SEQ ID NO: 1129 - DNA, 397 bp, Cicer arietinum
acctaaagtcatttccattagcctcgacatgagactcttcctctaagaacctctcgggcctaaattcctcgggctttttccattgggccgggttgtttgcgagccaccacgcattgaccaatatcttgctctcggccgggatgtcaaaaccactgagctttgcatcgtgaaggttcatgtgtgggacgaggagtggaatcgccattcgaagacgaagtgtttctttgattacggcttgtaggtaaggtagcttttggagatctggttcagttacttggtgtcctggtccaagaactctatcaatttcttcccttactttgttttggatcttttggtgattcactagctcagcaatgccccattcaattgaccataatgttgtttcaattgcagcaac

SEQ ID NO: 1130 - DNA, 340 bp, Cicer arietinum
tggctttggatgatcatggaaagaatgaaagttgggaatgccaagctagaagaaattgatatgcttcaggagttgactaagcaaattgaaggtcacacaatctgtgccttgggtgatgctgctgcatggccagtgcagggacttatcaggcatttcaggcccgagcttgagagaaggattagagagaatgcacaaagggagttgctgcaggcctctggttaggcctagactaaggggtgtgactgtactggtggatagcacaaatcaaaataaggcagtgccagttatcatttaggaaagatgagtggctcaagttgctgtggatttattgctactttta

SEQ ID NO: 1131 - DNA, 401 bp, Cicer arietinum
acttcttcactttgctttgtcaccaagtcttcagcggcattcttcgatgtgagtatctctttaactgtttcgtccttctcgacaagtgctgcggagagctttgactgtaaatcacttaatttggattcatagctagctaagtcctgaataagttttgatttttcctcatttattccagcagtttccttttcatggtgaagtgacttgttttgaagctcctcaactactgcttcaagattctttaattttatgagactctcctccagctcagctttatgagtttcagaggttgtaacagtttcacgcacctgttcttcataaatctttatctgtccttcaagagtattcagcttctcattcaattctttggtttctgattccttctcagtgtgcttctgcaa

SEQ ID NO: 1132 - DNA, 428 bp, Cicer arietinum
caattgccttgctccccttgccaaggttcttaatgaccgatttggaatcgtcgagggtcttatgaccactgtccactccatcacagctacccagaagactgttgacggtccatcaagcaaggactggagaggtggaagagctgcttccttcaatattattcccagcagcactggagctgccaaggctgtaggaaaggttcttccagaactgaatggtaaattgaccggaatgtctttccgagtccctaccgtcgatgtttcagttgttgacctcactgtaaggcttgagaagaaagcaacctatgaacaaatcaaggctgctatcaaggaggaatcagagggcaagttgaagggaattttgggttacactgaagatgatgtggtatctactgactttgttggtgatagcaggtctagtatatttgatg

SEQ ID NO: 1133 - DNA, 378 bp, Cicer arietinum
cagagaaacagaaattggaaacaaattgtgtttctcagtgaagctatggatttgcaagcgaacgatttcgatcgcattatgttcttcgagcatgcacgtaaaacctctgaagctgaatacatcaagaaccctctcgatgctgataatttgacaagatggggtggagcgttgttagagttgtctcagtttcaaaattttcctgagtcaaagaagatgacccaagaggctatttcaaagctggaggaggctctttctgtggatcccaacaagcatgatgctctttggtgcctcggaaatgctctcacttcacaggcatttttaatcccagaccaggaggaggctaaagttcattttgacaaggcagctgtgtacctcggc

SEQ ID NO: 1134 - DNA, 114 bp, Cicer arietinum
cagagaaatacaaattggaaacaaattgtgtttctcagtgaagctatggatttgcaagcgaacgatttcgatcgcattatgttcttcgagcatgcacgtaaaacctctgaagct

SEQ ID NO: 1135 - DNA, 399 bp, Cicer arietinum
actggaaatcagaatcaaacgagcttttacccttttgttccacacgagatttctgttctcgttgggctcatcttaggacacctgcgttatcttttaacagatgtgccgccccagccaaactccccacctgacaatgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggac

SEQ ID NO: 1136 - DNA, 271 bp, Cicer arietinum
acgactaaaaacgaattaaagaccaaaatttaaagaaaaatatgaaattcgtctccaatttcaatattaaatttataaaacgtgatttagtctcgaatttcatctcattgatctctaaatttggtcattaattcattttttccaaatatacattaaaaaaaaaagtcctagaattcaaaccaataccaaatcaactaaaaatacataaatcaacaattcatggcattttaggattattaattatcccgcatacatgtgaattccaattgct

SEQ ID NO: 1137 - DNA, 200 bp, Cicer arietinum
gatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttcc

SEQ ID NO: 1138 - DNA, 439 bp, Cicer arietinum
acatctgagtagttacccctacgtttctgcttatttgattgttctctttttttagatattcaatttggttgttaagatcttccatgtgttgttgtttcttcattcttgatcttcgtgccgattccctattcgattgcattctcttccttttcttttgatccataacatgcacctgttgttgttgaatatctccctctgatccagatccagagttttgaagagagcttgttccagatgaatatgctccaccaggagaagccataggtagttaggttttaaatcgcggtcgcgagttgcgatctttgatttgattgatgcagcctcaattgcagatgcgactgttcgcttaagactcaaaaactttgatgtggcgatttagatagtggtaattagtatttaattagatagttaaattgattagatagatagaatgaaacta

SEQ ID NO: 1139 - DNA, 400 bp, Cicer arietinum
acctttccaaaaacaacatgccttccatccaaccagctagttgttacagttgtaatgaaaaattgtgaaccattggtatcaggaccagcatttgccattgataaaagtccgggtccagtatgctttaacttgaagttctcatctgcaaacttctctccgtaaattgattctccgcccattccattgccgtgtgtaaagtcacctccttggatcataaagctagggataatcctgtggaatgagccgcctttgtaatgaagaggctttccatttttaccggtccccttttcccctgtgcaaagagctcggaagttttccgcagtttttggaactgtcttgccataaagacctattacaacacgacctgcagcctttccatcaatctcaacatcaaagtaaa

SEQ ID NO: 1140 - DNA, 197 bp, Cicer arietinum
acttgggattacgggagcacctccaaagagtgatgttccaattattacaccaaatgagctcactgaagctgatggtttgatgtttggatttccaacaagatttggaatgatggctgcacaattcaaatcatttttggatgcaactggaggcctatggaacaaacagtcacttgcaggaaagcctgctggcatctttt

SEQ ID NO: 1141 - DNA, 328 bp, Cicer arietinum
acccagcagaactctctatgacagcttggatttgctttttgggtatctttgaaggtgctattgcaacttttatatttgaacgtgacgtgagtgtttggtctttaggcttcgattctaggcttctagcttgtgtttactctggtatagtgtgttctggaatggcatactatatacaaggagttgtgacaagggaacgtggccctgtctttgttacttccttcagtcctttatgtatgattatcacagctgctttgggtgctgttgtcttggctgaacaaactcatttgggaagtataattggagcaattatcattgtgtgtggacttta

SEQ ID NO: 1142 - DNA, 360 bp, Cicer arietinum
acactggccatgcttttggagtcatcatccataacccagcttccctttggacttgccttcttcagtttcctaacaactgctgcacaacctggctttgaaggagctgaattggattgaaagctaggtgagccggggttttggctcgctgctggagaatgtatttcagaattgagctggaaacgagcaaatgatttgctgatttctccaccggtaatgctgcgacttgaacttttaacagatgaatgatcatttagttctttatccacaaggccacagctctcccaaggtcaggctgccatccatcgttctaaccagctccatccccatgcacgattggttggatccgtgaacattggattc

SEQ ID NO: 1143 - DNA, 437 bp, Cicer arietinum
acggacaaggtgaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttgttttacttattccgtgaatcggaggcggggcgctgcccct

SEQ ID NO: 1144 - DNA, 401 bp, Cicer arietinum
actggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggacag

SEQ ID NO: 1145 - DNA, 402 bp, Cicer arietinum
acaaccaaaacaaagagcatgaactttccctacaattaagaatcaaaacaatcttagttgttactacaaatgatgaccatcacactaaaaaacatatatatatacacctgaaacacaaacaaaaccaacaaatacatatagtcaaacactcctctatgatcttcactgtctccttaactgtccctactttgtatcaacacttcccaaagctgatgttcttcaactaatttcctgtcctcaaatgtcagtcattactcactgtccatgtatatatatatctcagcttattacaagcaacatacactagtttacaatttggccatctcatattcacaaggtttgctcttgatattaataatgtttacaagaaaatcttggtcaattccatttttgtttttattg

SEQ ID NO: 1146 - DNA, 240 bp, Cicer arietinum
acgactaaaaacgaattaaagaccaaaatttaaagaaaaatatgaaattcgtctccaatttcaatattaaatttataaaacgtgatttagtctcgaatttcatctcattgatctctaaatttggtcattaattcattttttccaaatatacattaaaaaaaaaagtcctagaattcaaaccaataccaaatcaactaaaaatacataaatcaacaattcatggcattttaggattattaa

SEQ ID NO: 1147 - DNA, 411 bp, Cicer arietinum
  misc_feature (198)..(198): n is a, c, g, or t
  misc_feature (374)..(374): n is a, c, g, or t
acaaaagcaccattttccattttacacttacattcttatcttagcaatagcattgtaaacaaaggatttaaatgaagatgccaataatatataatccttgcttcgaaaactatatatacctcttatttttcacattttcttaatataacaagttttagaaacgattgtcatcatcggcaggaggataccctgggtggngaggtggcttctcatatggaggataccctgggtagtgaggtggcttctcatatggaggcccgtaaaccggtggtttctcaactgggggcttataaactggaggctcttcaattggtggcttgtatacgggaggcttctcaactggtggcttataaactgggggtttctctactggnggcttataaatagggggtttctcaactgggggtttgt

SEQ ID NO: 1148 - DNA, 160 bp, Cicer arietinum
tggcggctcctcagaaccagaacgccttagatatcggaggacgatgcctatggcatcggtagcgacatcctcccgatcaacgacgccgattgcgatgggtttttcccctttgaaggcaagccgcaccgccggcctctgattccttcccaaggtttttccc

SEQ ID NO: 1149 - DNA, 128 bp, Cicer arietinum
acaaaagcaccattttccattttacacttacattcttatcttagcaatagcattgtaaacaaaggatttaaatgaagatgccaataatatataatccttgcttcgaaaactatatatacctcttattt

SEQ ID NO: 1150 - DNA, 385 bp, Cicer arietinum
acaatacagctatgaagaggatgatgaggaacccttatgagtatcatcacgatctgggtatgaattatacagttataacggagtatttgattgtgggatcccaaccacagaaacctgaagatatagatcatctgaagaaggaagaaggtgtggcatacattctaaacttgcaacaagataaggatgtagaatattggggaatagacttgcaatcaataataaaaaggtgtcgtgaacttgacattaggcacatgaggagaccggcagtagactttgatccaaactctttgcaaagtgcactacctaaagcagtttcatctttggaatgggcaatttctgagggaaaaggaaaagtttatgtgcattgcactgcaggacttggaag

SEQ ID NO: 1151 - DNA, 353 bp, Cicer arietinum
acatcagcataggctaagtgataaagtggaaccgttggttgagctaatatcacttcctcgtaacaaaatgctgcttgtttatacatttgcagagataagtaaatttcagccagttccctccatgcatcatgatctgccatgaatatttccagatatttattaagccattcgatagctccagaaatattgccttgtgcctttgccatatccaccctccttttatggatgatctgatctagaggattatcttccaaaaggcttgtgtaagagttttctgccatgtcccatgatccttttgcttcgagcaacattgcctccagcctgccaactcttttgctctcgggaaacctctt

SEQ ID NO: 1152 - DNA, 379 bp, Cicer arietinum
taactcgcgcctctgtctaagaccttcgttcatccaaccgatctcatggctccaaagaaggataaggctcctccaccttcctccaagccagccaaatctggtggcggcaagcagaagaagaagaagtggagcaagggaaagcaaaaggagaaggtgaataacatggtgctctttgatcaggctacctatgacaagctcatatctgaagcacccaaatacaagctcatcactccttcagttctctctgatcgtttgagggttaatggttctcttgcaaggaaggctattagagatttgatggctagaggtttaatcaggatggtatcttcccattcaagtcagcagatttacaccagggctacaaacacctaagtgtagt

SEQ ID NO: 1153 - DNA, 402 bp, Cicer arietinum
acatttctcatctctgataaggatgcaataaaagacgattattttaaaggagccctaaatagaaatttcacacagccactaaaggtgaataacaaaaagaagataacggcgacaacggtggaacactgaaaattcccttaatatcaccgtcccaaaacccagtccaagttgacggcgttaacggcatatctttaaaacagttcacatcaaactccatcgttttctcctttttaaccaccggtttctcctccacctcttcctcttcacggcaacgtttcctctcaccgtcgccggaagtctcctccaccgccgcaataacttcgttgacttcaagtggaaagttaagaattgctttggatccgcgaagcctgaaagcggctcgatcgtaggctttagcggctt

SEQ ID NO: 1154 - DNA, 401 bp, Cicer arietinum
acaaataaattcacatcacatgagatcacttgtctacaaaccatgaatgtagctggagaagaacaagaagtaacatacatgacaatttcttaccataactcacactaaatatacagaattagagcaacatttcttcatatggacataaccaactgctccaaatggaagaaactttctttctggaggtgattatcagaaacagcaacaacactcctctaccacgcaacagcaacaaagcgccgccaagcagccacggaagaatgaagaacaaccgtgatcatcatgacggtgatgatcaatatgttggtagtggtaatgagacggagccggaggaggaggcggtggtggatgaccgttgtcgaaataaccttgataggattcgtgcggcggacggtggtgat

SEQ ID NO: 1155 - DNA, 400 bp, Cicer arietinum
ggagtttaggaaacagttcaacaaggaaaaccctgacaacagagctgtgtctgcggtgggtaaagctgctggagcaaaatggaagtcattgactgatgctgagaaagcaccatatgctgctaaagcagaaaaaaggaaggcagaatatgagaagaacatgaaggcctataacaagaaacaggctgaaggtccagctgctgttgaagaggaagaatccgagaaatcagaatctgaggtgaatgatgagaatgatgatgatgatgatggcagtgatgaggaggatgatgacgagtagaagctcggactaagataacatttatgtaggaagttctgctaatgatttgatcatcttatgtagatggtttggccgttccttcataaacatatttcttgcttccag

SEQ ID NO: 1156 - DNA, 392 bp, Cicer arietinum
  misc_feature (392)..(392): n is a, c, g, or t
aagaaaacgtctacatccagaaatgggagcgggaaaggttggagaaactgaagctacagaatgataaggctaaggctgagaaggacaaagacactactgataagaaacctgatgggactcaaaagagctgactttaccagtcatgctatgctagccatgaaggtcacttgtgggaaacaatcatggggaataaaacacattgactctgagtgaactatggtctttgtatagattgtatgttttttttctctctcgtttatttgtagtttcttcaatggtgatggatgagaccatgttgcatccaacaaatttggtaaattatgttatgatgtaatcctcccatgatttttcaccttcctgccagtgcgaaacgaattagtaatcattattcn

SEQ ID NO: 1157 - DNA, 428 bp, Cicer arietinum
acaaatcgaggaaaagtctttactctgctcggtcaatcgcagctgctttccttgctaaaatccaatggtcccttgccatagttcgctccaagattcattctttcagagacctcaatgcgattctggtatatacaaatttctgcgaatattttttctcatttcatgaagaggctgggtattcgtggtgtagtaatggtatgtcggggcgtggtggaacgtttcatatcgtcattcggtgggataaatcccgacgcaatgggttaggacagtcatccagaagctgacaatgccttgtttgtggtggtgtgtgcgatgctatggccactactcatctattgtcggccagcagggatggagatgccagaccagcgaggagcggatgaaggctcaaagacgttggtgcccagaggagggtcacggctggtagt

SEQ ID NO: 1158 - DNA, 387 bp, Cicer arietinum
acaaaaggattaagcattcattgaactgtccccaaattcaactacttgtgttcactcctaaactatgatcagcgtgttttgccaaatcaattaaaagccatctcttatttgttagagctgcaatagttgtggaatgagcttgaaaagaaaagacagctcctgttgtgaaaactgaggctttgagttcacttgcaccttcccaatcccttcattcaaaccctcttcctctccaatctttgctggcttcatcatatccgcaacggcctctgttatttcttgcacaaaatctactatcaccccatcgattcccattaggtgctgcatgtaaaccgcttctggaacattgtttaatttgccatatgttaaaagagaaagatttgactcctt

SEQ ID NO: 1159 - DNA, 396 bp, Cicer arietinum
acacacttgacttacaatctcacacttccacaacaaaatgaaaggaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctatt

SEQ ID NO: 1160 - DNA, 265 bp, Cicer arietinum
tggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccacgacagtcgactacgagctacaacttggttactggagattgtggactgcgtcagcagatgtagcgatgcgtgggagaattctggtcggtggaaaaat

SEQ ID NO: 1161 - DNA, 373 bp, Cicer arietinum
gaacccagctttctcagttctgattggaggaatacttccttttggagctgttttcattgagctcttcttcatcctcacctcaatctggttgaatcagttttactacatcttcgggttcctctttttggtcttcatcatcctcgttgtcacttgtgctgaaatcaccattgtgctctgctacttccagttatgcagtgaggattacttgtggtggtggcggtcataccttacttctggttcttctgcactatacctctttctttatgcaacattctacttctttaccaagctagaaatcacaaagttggtgtctgcaatattttactttgggtacatgcttatagcttcttatgcgttttttgtggtaactggt

SEQ ID NO: 1162 - DNA, 410 bp, Cicer arietinum
tttgtttggagatggagctgctgcattgattgttggatctgatccaattcctgaaattgagaaaccaatatttgagtatggtttggactgcacaaacaattgctccagatagtgaaggcgctattgatggtcaccttcgtgaagcaggactcacatttcaccttcttaaagatgttcctgggattgtctcaaagaacattgataaagctttgattgaagctttccaaccattgaacatatctgattacaattcaatattttggattgcacatccaggtggaccagcaattctagatcaagtagaggaaaagttagcattgaagcctgaaaagatgagggcaacaagggaagtgttgagtgaatatggaaatatgtcaagtgcgtgtgtattgtttatattggatgaaatg

SEQ ID NO: 1163 - DNA, 424 bp, Cicer arietinum
ctcctgcaagggttttccccaaggatgcacggtcctaggttgcagctactggcgatcttaggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagacggaatcgcagttgcatggggatatgtcctgaatcacctgctttgacatccaagatgatgtgcttgaacctaccgtagggctggctacgagtaggaaggtgccctcgggggaaggagctcgagaggctctccgttgatgcgagtggacatggcgggtattctaggaggagtccagcgcgacagcaattgtagatagtttagctcagcacgt

SEQ ID NO: 1164 - DNA, 300 bp, Cicer arietinum
caaactgtataattcttattgttagtttttttttcttttataaaacaccacaagggaggtgagaggggttaacttaatttaattttttttaactttttgaaagagtgaaaaaaaaaatgttggggatcttcagcagctccgtggtgtctcctccagaagaactggtggccgccggtagccgaactccgtcgccaaagacgacggcgagtttgcttctgaaaaagttcgttgagaggaaagcgtcggcggtgtcactgcaggttggggagcacgtgcagttggcttacacacatcaagggg

SEQ ID NO: 1165 - DNA, 192 bp, Cicer arietinum
gatcaaggtgcggcagctgcgatacaacctgaggaggaagaggaagaggttgatgaaactggtgtggagccccatggcattgatttggtcatgactcatgcaggagtgtccaggagcaaggccgtcaaggctctcaagactcacaatggctacattgttggtgccattatggagctcactacttaattgggt

SEQ ID NO: 1166 - DNA, 149 bp, Cicer arietinum
gccaattaaatacgtccactattcacttatccataactagattatctccctgtctgatctccaaagcctaagcaaactcttgtttattttacatgttacaataatcaacaccaaaaaataatagcaattattaaacaaaaacaaactaa

SEQ ID NO: 1167 - DNA, 443 bp, Cicer arietinum
agtttctaaccccgaggctacctactaggttccatcatttctcctttccgatcgttctcctccgcggacccacgctactacgaccccggagcttttcagcactgtctcaattcaacatacctacctaatacgtttgtcccaggagaataaacgaatactacagccaaaatgtcgccaaccgaggagaagagtgacgatatcgatttcggtgacaacatcgatatgactactttcgagcagatcctcgaaatggacgagccaggcgattgtgaattcagctcttctattgtatttggcttcttcgagcaagcggaagaaacgtttgaacagataaaggaggcattggaagaggaagatcttgataagctctcgtctcttggacacttcctcaagggctcatcagcgaccctcggactcatcaaaatcagggatggttgcgaaaa

SEQ ID NO: 1168 - DNA, 437 bp, Cicer arietinum
gtcacgtttcctaactcggttactttgactcggaacgattctctaaatttgagtaactcggagcgattttctctttttttcctttcgattttctccttcttcgttcgtcatgccgaaggctaaagctgattccaaacccgctgataacaggttaaagcgcaaaggcgcaggaaccggaacgaagcagtcgaagaaagctgctaaggatcctaacaagccaaagaggcctccgagtgctttcttcgttttcatgtctgacttcagagaacaatataagaaggatcatcctaataacaaatccgtcgccgctgtcggtaaagcttgcggagaagaatggaaatcgttgtctgatgctgataaggctccctatgttgctagggcattgaagaagaaagcagagtatgagaaaaatgttcaggcttacaataggaaacagg

SEQ ID NO: 1169 - DNA, 403 bp, Cicer arietinum
acttcaaatttcaccagcattttcagcttatggaaaatgacattgaaaatgatggaaaacattctcagttgacaaagttagaagctattatttccttgcgatcaatcgcatgagaacaaacgaatcaggagtctacaggcatcaagaacatgatatataagaaacaaacaattacatgcatcgtttctaaaatatttcttctatgctctttgctcaacatatgaacccgcaagtccagaagttcccagaaccgtaacctttccccactcagaaccaaggccactgcatctcatctttaagtgtatcatctttgtccccaactcctgctccaccttcttccgcagatagttctcctcaggcccaaaagcattcaaataggtagtgtagcgatcaaaaatggtat

SEQ ID NO: 1170 - DNA, 107 bp, Cicer arietinum
atttatcagttgggggaactccacctgacttgaaattgcacttcttccactgcttgtctttttccataatctaaactattgtacctcggccgctaccacccctccat

SEQ ID NO: 1171 - DNA, 403 bp, Cicer arietinum
acttattattaataaaatagcatgcaattttgggatcattcttttttgtttcagccaaaactcttacataattcaagttggctagttgtgtgtccacctaaaattttttgcacggtcaatcataactgttaaatggttaaaaatattaaacttttactataatcactcctaaagccgtgtctaaaaataattgtgatgtgttgccaatataataaaaactataataccagtatatatataataattaaactcttttttaataaaaacagaaatgtgtaagtatatcatatactccatccatctggtcttaaggctaaatattatgatacttccttcatttaattaagacacgtattatgatactgtcaactaatatatacccctgaaggttccttctattttc

SEQ ID NO: 1172 - DNA, 265 bp, Cicer arietinum
accagaggccattcatgaagggcaagctttacatccactttacagtggagttccctgagactcttagtcttgaccaggtgaagggtttggaagctgttttgccagctaaaccttcatcgcagttgacagatatggagctggacgagtgtgaggaaactacacttcatgatgtcaatatggaagaggagacgaggaggaagcagcatcagcaacagcaagaggcatatgatgaggacgatgatatgcctggtggggcacagagggt

SEQ ID NO: 1173 - DNA, 146 bp, Cicer arietinum
gaaagaaattagggtattattgagtttgtgaaactagaacaaccaagccagtcaacaaacaaaataaaaaaggaaaagaaaaatctgaaatcataagtcttggtattttttttctactcgttatgcgactcttcttttatatgtaa

SEQ ID NO: 1174 - DNA, 355 bp, Cicer arietinum
acataattataaattaggcgtagtggccaatctccaaaatttagagttccactcatgcagtattttcaacttggccacatgtgaaggtaggagttaatcccaataatataaagttcagtgttcaaaaaatgctgtattacatcaactacagatatcatcgtaacacacaacacaatccatcacgctgcttgattttcactatttatccttcagttcacaaaacatgtcataacacaatcagagattttcttatccataatctcctcacagcaaatttgccagatgagtgtcgggcagtagaatataagttgaacaacacgagtggaaacagtgattccaagaatatgatgtacct

SEQ ID NO: 1175 - DNA, 458 bp, Cicer arietinum
gatcaaggtgcggcagctgcgatacaacctgaggaggaagaggaagaggttgatgaaactggtgtggagccccatggcattgatttggtcatgactcaggcaggagtgtccaggagcaaggccgtcaaggctctcaagactcacaatggcgacattgttggtgccattatggagctcactacttaattgggtgttgggttcaattgggtcgcatcctctttgtatctttttttgtggaataattttggaactagtatcttcaatttaccatagccagacaatatcaccttatcaagcgtctatatgtttaggtttaccatttgcctggtaattttgttgtttcctacaaaattctggggtgacattaaagatcacatccttattttgacagaacgatcacatgcttggttagatatgttgtttttgtcttccatatactcggaacaaccttcggtatg

SEQ ID NO: 1176 - DNA, 248 bp, Cicer arietinum
atctccgcttagtttgaaactgtggtttgttagcgttttccttggagtccttggcatgccaattggagcagctttaaagatgattcctgtgggatctgcctaaattaaattcagacaattaggttggttcccttgttcggaagaccggaacaatgttaattttgaatgctgcagttagccagggatgattgttaatacttgttggtgaagatcagaagggcagtgtcctttataaggaagtagaaagt

SEQ ID NO: 1177 - DNA, 390 bp, Cicer arietinum
acaagcttgttggaatcaaagtattgactcctacaaaggaatttgccgcacagcactatcacgacctgaaagaaagacccttcttcaatggattgtgtgacttcctaagctctggccctgttgttgcaatggtgtgggaaggacaaggggttattacctatggccggaaactaattggagccacagatccacagaaatctgagcctggaaccattagaggcgatctggctgttgttgttggaagaaatataatccatgggagcgatggaccagagactgcaaaggatgagattaagttgtggtttaagccagaggaattggttagtttcacaagcaattcagagaagtggatttatggtgacaactgaactgattgataatgttcttcgt

SEQ ID NO: 1178 - DNA, 188 bp, Cicer arietinum
  misc_feature (161)..(161): n is a, c, g, or t
acctatgataatcacctttcatcttaaggtagaaaaccttagagtcaccagaagcagcggaaggtatgaggcgagaatcaagtagtttgagaataccgttacagatgttggaaagttcggcttcgatcttagatctgtagtcacggatgactgccacgtgntcatcgttgcctctgctttcctccttt

SEQ ID NO: 1179 - DNA, 351 bp, Cicer arietinum
accaatatgtcaatcgacagcgttggtagcttgcaaacaagcaatggtggaggatcggttgcaatgtctattgataacagcagtgttgggtccaatgattcccatacccgcatgttggaccaccaagggttgaagaggcgtgccaatgataactactctgttgcacacagtgtcaatcgtcgtggaagagtcacacatgcattgagtgacgatgctttagctcaagctctgatggacaataattctcctactgaggggcttgaaaattttgatgagtggacaattgatttgaggaagctaaatatgggcgaggcttttgctcaaggagcttttgggaaactctacagaggt

SEQ ID NO: 1180 - DNA, 372 bp, Cicer arietinum
acccatcacctccaccgccaccatacaaatatccatcaccaccacctccagtttacaagtataagtcccctcctccacctgtttattcaccacctccaccacattatgtttatgcttcacctcctcctccggtctattcccctcctccaccgcattacatctatgcatcacctcctcctccttaccattaatagagagtggtttaccatatcatccatggatttgaggaatatatcgaaaataaagcgaagatagtgcacataaggaatatgcattgtgcaattatacaaaggaaaaatagtggaagcaaagtttctgaagatgtatcgcacaattattaatttgtctcataaaaagaaaaaagtgtcactc

SEQ ID NO: 1181 - DNA, 422 bp, Cicer arietinum
cgaggtacattttcgcttcgacgatttaagcactgctgatcttgttcttacctccaaaggcaaagtgacgctttgcaggagttcgtttgaatgccttcactcctaatgggttgttcttgcccttaagacaaagtccttgataaatgtcacaaactggatactcatgagggcagcaactgtaatgatcttcacaacaagtagcggactcaagaggacaacatccccattcaaagcaggaccttccatactcataaatacagcaacaagtggttccttcagcagagctatagtaactgtcacagacagatggtggcttcacaggtgaaggaggtgatggtccagggttaggaggattctgtccattcttaattggataagatggctcgatcgcgattccacatttgcctgatctgcttgaagct

SEQ ID NO: 1182 - DNA, 437 bp, Cicer arietinum
acataccagactaccacatttatcttgtctgcacttacaactgttccctaaacttgatcaatttgctgtcaaatgcaaaactaaactaaagggaaactttggttccccacaaccaagatagaatcatacatgttctataaacatgaacatgctaataaatctgcaaattgatgaccaagatcaaaatttcacaataactacactagatacaaaggcatgtttcctgctaagtctccactgattataaataacatggtatgtgaatgaatgtgataatgtgcattgtaaagttgagcgaccaagttctaccaaagaagaacaaccaactgaaagacgtaggacttgtcttttctcggataaaattttcaccataaccatccattctttcccaaccgagcgatgcaggattagtctttacagttacactctattcgaag

SEQ ID NO: 1183 - DNA, 442 bp, Cicer arietinum
gtgcttcgtttggctaaggatttggctgagaataacaaaggtgcacgtgcgttggttgtttgttctgaagtcactgcagtcacatttcgtggtcctagtgatactcatttggatagtcttgttggacaagctttgtttggagatggagctgctgcattgattgttggatctgatccaattcctgaaattgagaaaccaatatttgagatggtttggactgcacaaacaattgctccagatagtgaaggtgctattgatggtcaccttcgtgaagcaggactcacatttcaccttcttaaagatgttcctgggattgtctcaaagaacattgataaagctttgattgaagctttccaaccattgaacatatctgattacaattcaatattttggattgcacatccaggtggaccagcaattctagatcaagtagaggaaaagt

SEQ ID NO: 1184 - DNA, 365 bp, Cicer arietinum
actggatgtgtcttcaacaggacggctttatacggctacgaacctcctcttaagctgaagcataaaaagcctgggtttctatcatcaatctgtggtggaaatagaaagaagagttcaaagtctagtaagaaaggatcagacaagaaaaagtctagcaagcatgttgacccaactgtgccgattttcagtctcgaggatatagaagaaggagtagaaggcactggatttggtgatgagaaaacactacttatgtcacaagtgagccttgagaaaagattcggtcagtctgctgtttttgttgcttctacgttgatggagaatggcggggttcctcagtctgctactccagaaactcttctgaagga

SEQ ID NO: 1185 - DNA, 252 bp, Cicer arietinum
actaggttgtacccctattgcgacactgtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcaacgtctctatgaacgcttggctgccacaagccagttatccctgtggtaacttttctgacgcctctagcttcaaattccgaagga

SEQ ID NO: 1186 - DNA, 293 bp, Cicer arietinum; identical to SEQ ID NO: 671

SEQ ID NO: 1187 - DNA, 293 bp, Cicer arietinum; identical to SEQ ID NO: 671

SEQ ID NO: 1188 - DNA, 387 bp, Cicer arietinum
accaaatgtgtagatattacaacaaaacccctttacctacacaattcacttaaatgccatgtgttcatgactcaaatttgaatctctatcgaccatctatacatcccctcttgaggaactgggatggagaaggttgtcaacccggtttctgagtcatagttgaaatcggtatcaatgccatcgactgcacattgaagtggatgctgagaatagtaaaccccaaacttgccacttcctctggcctttagagcaacagttgctgttttcgttcggttaggactgagagaagttgtcagttcagatacaacctcgccgtcgaatagttcttgtttgttgtcggaggctttatggatttcaacctcttccacagctcctccagtgttgaac

SEQ ID NO: 1189 - DNA, 258 bp, Cicer arietinum
acagagaagttacgaacttttaagctatcctcttgtcactttcaataaagattcaacataaaacaataccaagggcagcataaaataccagaaacaaaatccttataaatactaaaaaaccagcttaaacgatagcattagcagcacttgcaatcctaggccacaaatcagcacactcctttccaattggaccagtgatagcagaacctttcatttctcctttaggattcacaatgacaccagcattatcttaaaagt

SEQ ID NO: 1190 - DNA, 254 bp, Cicer arietinum
attaccatcgttcggagaagcttgagagcgtagcgttcgttatcaaacatgagggctaagtggaagaagaagcgcatgaggaggttgaagaggaagcgccgaaagatgagacagagatccaagtaggtcgattggcagaagacatactttccatccttctatgacgtgcttcatgacttgttagatagttccagtctaatgttgtgaggtttggttgggaggggaagcttctctcaagacataggtttagctgt

SEQ ID NO: 1191 - DNA, 351 bp, Cicer arietinum
tgccatttcgagcggggaaacgggcaggtagagcttcaaatgatacaagttctccatttcttttcagcagaagatgaagtaatctttgctgatcgtattctctcatacaatgtctgatgaagtctaaatagcacataaaaggagtcatttccataaaaaatttgaacgttcttttctttcccatgcagcactgggccaacatgttttaccagaggcttaacagtgagaagaaagcattctgaatatggcaatgaggatccatctccttcaacatcattggcatcagtcattccttcagcttcaccttcactctcagccttgttaccatgttcatgatccccatcctcttca

SEQ ID NO: 1192 - DNA, 436 bp, Cicer arietinum
acataccagactaccacatttatcttgtctgcacttacaactgttccctaaacttgatcaatttgctgtcaaatgcaaaactaaactaaagggaaactttggttccccacaaccaagatagaatcatacatgttctataaacatgaacatgctaataaatctgcaaattgatgaccaagatcaaaatttcacaataactacactagatacaaaggcatgtttcctgctaagtctccactgattataaataacatggtatgtgaatgaatgtgataatgtgcattgtaaagttgagcgaccaagttctaccaaagaagaacaaccaactgaaagacgtaggacttgtcttttctcggataaaattttcaccataaccatccattctttcccaaccgagcgatgcaggattagtctttacagttacactctattcgaa

SEQ ID NO: 1193 - DNA, 221 bp, Cicer arietinum
cgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 1194 - DNA, 426 bp, Cicer arietinum
tgtcattagcgtggtcgaaaccgaggtactggaaatcagaatcaaacgagcttttacccttttgttccacacgagatttctgttctcgttgagctcatcttaggacacctgcgttatcttttaacagatgtgccgccccagccaaactccccacctgattatgtcttccgcccggattggccaaccgaagtcagccttggatccttaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggac

SEQ ID NO: 1195 - DNA, 405 bp, Cicer arietinum
actggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggacagtggg

SEQ ID NO: 1196 - DNA, 460 bp, Cicer arietinum
ggccacctcaattgtagctcctgctactctctacaaagctctagtgggggatggtgacaaccttactccaaaggttattgatgccattaagagtgttgaaattgttgaaggaaatggtggccctggaaccatcaagaaattcaccttcgtcgaagagggagaaaccaagtttgtgttgcacaaagtggacgcaatagatgatgctaattgggcttaccactacagcatagttggaggtgctgggcttccagacgcagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgctttta

SEQ ID NO: 1197 - DNA, 111 bp, Cicer arietinum
aaattgtttttatgactacctgatatcagaagctaaagaattgactgaggaacaactgctgatgctggtctgggagccaattgttgaggcatctgatactaccttagttac

SEQ ID NO: 1198 - DNA, 404 bp, Cicer arietinum
actggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggacagtgg

SEQ ID NO: 1199 - DNA, 364 bp, Cicer arietinum
acagtgtgaagcaaaacaaaagctgttttcacacacaacatttatttcattacaaaactataaattaactttgaactttcaaggaagtaatattaatgaaaaagcatttcattacctatgtagaacaatgtcaagaagttggcccaactaccaacaatagacaaaacccataatccagcaatcaccgagagaaactttttgagatcctttccagaagcaatatcccttaatacagcaaaaacccggttgatctcaattctaagagcagcggcaatctgtaaaacaggttcctcaggaatgtgcacttgtgggatctttggtggtgccttgctgatgaaagtggatgcatttgaccataagaaca

SEQ ID NO: 1200 - DNA, 380 bp, Cicer arietinum
gatttctctgctggtttgcacggttgggcatttactctgaccaactttgcaaaaatgtatgcctcaaagtttggcgttgatgaatccaagatgatggagaggctctggggtgaaaacttctttgatccagccacaaagaaatggaccacaaagaatactggttcaccttcttgcaagcgtggatttgttcaattctgttacgagcctatcaagcagattattaacacttgtatgaatgaccatatggacaagttgtggcctatgctaacaaagctaggagtcaccatgaaatctgaagagaaagacttgatgggtaaggcattgatgaaacgtggcatgcatacttgggtcccagctagcagcgcactattggaaatgat

SEQ ID NO: 1201 - DNA, 276 bp, Cicer arietinum
acttcagtgctttgaattacaggtagcaggaccaaatggacaaatattgaaaggtgctgatgctaaggttagcatggatgaaagacctggtctcactgttccaagagcacataatctcgtttgtgttccacttgcaagacctggtgctgctgctaaactcctttcctcctaaaacatacattcaaacacttaattcgtccatgtccgtttataaactaaataatcattttcaataaggtatcattgagagagtccacaatgtgtgctagtgatggt

SEQ ID NO: 1202 - DNA, 437 bp, Cicer arietinum
aaatatggaacatgaacaaatgtactggagttgttggtgtatttaactgccaaggtgctgggtggtgcaaggtagagaagaaaactcgcatccacgatacatctcctggtacactcactagctctgtcagtgcctctgatgttgatcaaatcaaccaagtagctggtgttgaatggcatggggagactattgtttatgcttacagatcaggtgaggtgatacggctaccaaaaggggtttcgattccagtgacactaaaggttctggagtttgaacttttccatttctgtccaatccaagaaatagcaccgagtatatcatttgccgcaataggcctaatggatatgttcaacactggaggagctgtggaagaggttgaaatccataaagcctccgacaacaaacaagaactattcgacggcgaggttgtatctgaa

SEQ ID NO: 1203 - DNA, 399 bp, Cicer arietinum
acctcagacgatgaaaccggcgctacccttcaaacaacacaggcagaaaccagccaccagtagttcaccagttacagaaagctcatattttccaccatagatgttaaaacagtgagtaaaatgctacataattttataataactacacaccaccactataaagtagggagataaaaaaattacaaaaatagataataaaaaaaaaaaaaaaaagataacggaagtgaaagtcaggctttttagtcatgtatggccttgtgtaggcaaaggttaagtagtggtagtatatatatatatatatatatatcaacaattaggatgcatggacgaaggtgtttatctcattcatgaggcaatagaaatgatcgttgttaggcaagaagtagaaaccaatagtgg

SEQ ID NO: 1204 - DNA, 357 bp, Cicer arietinum
acattagtgatgggtttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagtt

SEQ ID NO: 1205 - DNA, 376 bp, Cicer arietinum
agcgcccagggtttcgctcagatttcacatctagggtctatttttctccgccgacccatggctcccaaaggtgatgtttcaaagaagactgacccaaaggcacaggccttgaaagctgctaaagcagttaagtcaggcactgccattaagaagaaggcaaaaaagatccgaacatctgttacattccataggccaaagactttgacaaaggagaggaacccaaaataccctcgtattagtgctacaccaaggaataagcttgatcactatcagattctgaaatttcctctcactactgagtccgcaatgaagaagattgaagacaataacacattggttttcattgttgacttgcgagctgacaaaaagaaaatca

SEQ ID NO: 1206 - DNA, 359 bp, Cicer arietinum
agcgcccagggtttcgctcagatttcacatctagggtctatttttctccgccgacccatggctcccaaaggtgatgtttcaaagaagactgacccaaaggcacaggccttgaaagctgctaaagcagttaagtcaggcactgccattaagaagaaggcaaaaaagatccgaacatctgttacattccataggccaaagactttgacaaaggagaggaacccaaaataccctcgtattagtgctacaccaaggaataagcttgatcactatcagattctgaaatttcctctcactactgagtccgcaatgaagaagattgaagacaataacacattggatttcattgttgacttgcgagc

SEQ ID NO: 1207 - DNA, 430 bp, Cicer arietinum
aacacattcaacgccgcactcacctccgcattcgtcaccgacttccccggtgtcaacggactcggaatctccgcagcccgactagacatcgcagaaggcggatcgatccccatgcacacgcatcccggggctacggagttattgataatggttaaaggtgaaataacagctggatttatgacaactagtgctgtttattcgaaaaaattgaaagttggtgatgtaatggtttttccacaagggatgttgcattttcaagttaattctggtaaaggagaagccactgcttttcttagttttagtagtgcaaaccctggtgctcaattgcttgatcttcttttgtttgctaataatttgtcttctgatttcgttgcacaaactacttttcttgatgttgcacaagttaagaagttaaagactcgttttggtg

SEQ ID NO: 1208 - DNA, 385 bp, Cicer arietinum
acctccaattccccactaagcataccgacaacatctttcatcgaaggacgacgattagctgacttaaccaaacaaggcaatgcaattttgatgcatacaagagccttctctttatcatcatccaacaacaactcaacagatggatcaactagttcaagtagtttccccttgcgagcacaatgtctagcccaagacaccaaattggctctcttaaactctaacacatgtgtgaatccatcaccattcacctcaagtggcctcctcccagaaataataacaagcaataacaccccaaaactataaacatcacacttctctgttacatcaccactatagccattttcgggagcaacataaaaactgtccctctcatacttggtgaagt

SEQ ID NO: 1209 - DNA, 460 bp, Cicer arietinum
actgcacacttcttgctcaaagtgctgttcatggagcaatggcgggttacactggttatacaagtggacttgttaatggaagacaaacttatatacccttctatagaatcacagaaagacagaataatgttgtgataactgatagaatgtgggctaggctgttatcttcaacaaatcaacctagctttatgaacaccaaggatgccaatgaagataataaagaagaaaactcattggaccagttagcagatggacattgttccgaagacacttcggtcgatgaaatcagtcacattttccccgcgatttcttgctgattcttattttcttctcgctatcatttatcgtgcgttataatcagtatatattatagagttatcatttttgcacttccatgtccataagagatggctgaggaaaactcagcatgacatgatcaatatattagttttagttcatt

SEQ ID NO: 1210 - DNA, 157 bp, Cicer arietinum
actaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatctaagg

SEQ ID NO: 1211 - DNA, 318 bp, Cicer arietinum
acatgttgagtattttaccaaaggtgattatcaactcactgaggaggagctcaaagctggtaaagataaggttgaaggccttattaagatttgtgaaggttaccttttggctaatcctgattattgaatgtgtttcattaaggattaattaataaaactttgatatgctgccaaattaataatactcagatcaagtttctgttttaagctgaagcctaagaatgagttatgagtatgtttttgtatttgaagaaaatttatgtgttgagccatggactagtagtgattggaagggttgtattttctattttacaagag

SEQ ID NO: 1212 - DNA, 358 bp, Cicer arietinum
acgagtgtcggcaacggaggagttctgattgattccggaacggtgatcacgagactagctccatccgtctacaatgctttaaaggcagaatttttgaaacagttttctggttttccttctgcaccagggttatcaattttggatacatgttttaatctaactgggaatgaggaagttagcatacctactataagtatgcattttgaggacaatgttgagctgaatgtggatgcagctggcatattgtatatgacaaaagatgcttcacaagtttgtttggcatttgcaagtctttctgatgaaaatgacatggctatcattgggaattatcagcaaaggaatcagagggtgatttatg

SEQ ID NO: 1213 - DNA, 457 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccactttgtgcaacacaaacttggtttctccctcttcgacgaaagtgaatttcttga

SEQ ID NO: 1214 - DNA, 435 bp, Cicer arietinum
actgagctgaacaagaaaatttacaagcttggcaagtctggagaagagacccatgatgcccaaactgattatgataggactgagaaagacatcgccccgatgggtggattcccccactatggtgttgtgaaggaggattatctgatgatcaagggaggtgttgttggtcccaagaaaagggttattactttgcgtcagtctctactcaagcagacttctcgcaatgccttggaggatatcaaacttaagtttatcgatacctcttcaaagtttgggcatggtcgcttccagacaacacaagagaaacagaagttctatggacgcctcaaagcttagttatggctgctgctttgaaatgttggaaatcgttatttatgttatttttgttgccatccttttaaactctgttgtggtgtcttccgttagctattttgg

SEQ ID NO: 1215 - DNA, 120 bp, Cicer arietinum
cgaggtacatcatcttcatcgctatcatcttcatcaaagggcttctctttgtgaaagatacaacacttcttggaactctttttctgcataaattcattgtccacagtgccctctttccac

SEQ ID NO: 1216 - DNA, 240 bp, Cicer arietinum
actggatggatgagaattatctctacacctgcttcggtcaaaccggcgaggtaacatctctgaaagtgattaggaataagcaaaccagtcaatcggaaggttatggttttatcgagtttaattctcgtgctactgccgagagagtgcttcagacatataacggagccattatgcctaatggtggccagagctacagattgaattgggcgactttcattgctggggagaggtcgtctagac

SEQ ID NO: 1217 - DNA, 206 bp, Cicer arietinum
acatcgaatatcgacaattcaacttagacttttttccatacaaaatgtatatatagatgtcaatgttacaaaacttcacataactacatatctttacatcattacagttgattttctcatttttccctctctcattacaaaccaacaacgatcgatgcataaatcacaatataaaatattttagtcatacattatttagctaacgt

SEQ ID NO: 1218 - DNA, 436 bp, Cicer arietinum
tcagggtttcgctcagatttcacatctagggtctatttttctccgccgatccatggctcccaaaggtgatgtttcaaagaagactgacccaaaggcacaggccttgaaagctgctaaagcagttaagtcaggcactgccattaagaagaaggcaaaaaagatccgaacatctgttacattccataggccaaagactttgacaagggagaggaacccaaaataccctcgtattagtgctacaccaaggaataagcttgatcactatcagattctgaaatttcctctcactactgagtccgcaatgaagaagattgaagacaataacacattggttttcattgttgacttgcgagctgacaaaaagaaaatcaaggacgcagtgaagaaaatgtatgacatccaagccaagaaagttaacaccttgatcaggcctgat

SEQ ID NO: 1219 - DNA, 437 bp, Cicer arietinum
gtcgaaatggtacagagcttacatggagaccgtggaatgaggcgactacctcgtccacagagcagcgttctagccgccttggggttttctcctgcaagggttttccccaaggatgcacggttctagggttgcagctactggcgatctttggggatcatggacttcctgcctcagggtatggaaagctacttgatctatccgtgcaggagaattctaggctggagaggaatagtccccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctacgagtagagaggtgcctcttgggggtaatgagtactcggccg

SEQ ID NO: 1220 - DNA, 188 bp, Cicer arietinum
acatggttgagttggaaattcaagtccccacaccatttgatccatttgctgaggccaaagaatcggatgcccccggagcgaaagaggatgttcatagccgaattcgacagaggaatggaaaaaagaggctgactacagttcaagggctgaagaaagagttcagctacgagaagattctcaaagatctc

SEQ ID NO: 1221 - DNA, 266 bp, Cicer arietinum
acagggataccccgcttccttcatcatccagcataccaaggcagaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggataaaccttgggaaggaatcagaggccggcggtgcggcttgccttcaaaggga

SEQ ID NO: 1222 - DNA, 399 bp, Cicer arietinum
  misc_feature (329)..(329): n is a, c, g, or t
acttcctattgcggcaacaacaatttcagtcgacacaaacttgctgcatgcaaaaaccctagcaacacaacatctacctaagctcttccgtcctttggtcgaccaatcaaagggcatcagatcaaactagtcctgctaccttttttaagaaaatcctactatcaacagtcgcatgttattgtcttattaaacatacacgaaatcatgttactttgcctcttcgccatctccactgttatgtgcggctgcagctgagcttccttggccatctccaccagctgtcccagcttccgaaccatcttgtttgcttccaccaccacgtccatcgnttggattggaagccgaaggcggaccaccactgcctccacctccgagagaagcttcgttgtgcatggaatg

SEQ ID NO: 1223 - DNA, 351 bp, Cicer arietinum
accaatatgccaatcgacagcgttggtagcttgcaaacaagcaatggtggaggatcggttgcaatgtctattgataacagcagtgttgggtccaatgattcccatacccgcatgttggaccaccaagggttgaagaggcgtgccaatgataactactctgttgcacacagtgtcaatcgtcgtggaagagtcacacatgcattttttgacgatgctttagctcaagctctgatggacaataattctcctactgaggggcttgaaaattttgatgagtggacaattgatttgaggaagctaaatatgggcgaggcttttgctcaaggagcttttgggaaactctacagaggt

SEQ ID NO: 1224 - DNA, 372 bp, Cicer arietinum
tggtggtgatgttacgcttttgattcatgaaggtgttaaggctgaagagctttttgagaaaactggtgaggttcctgatccttcttctactgataacgctgagtttcagatcgtgcttagtattattagagagggtttgaaaactgatcctcaaaggtatcgtaagatgaagcaaaggcttgttggtgtttctgaagagacaactactggtgttaagaggctttatcagatgcaggctaatggaactcttttgttccctgctattaatgtcaacgactctgtcaccaagagcaagtttgacaacttgtatggatgccgtcactcacttcctgatggtttgatgagggctactgatgttatgattgctgggaa

SEQ ID NO: 1225 - DNA, 115 bp, Cicer arietinum
gattcaagtctcttcaggatatcattgccattctgggtatggatgagttgtctgaggccgacaagcttactgtcgagcgtgcccgtaagatccagcgtttcctgagccagccttt

SEQ ID NO: 1226 - DNA, 248 bp, Cicer arietinum
atccgaaacctgctatcaaattgctttggctatcaaggatgaagtagaagaccttgagagccaaagcaatttgatagcaggtttcggatctaggctggtcaactctaacgaaggaccagttgagaatggtgacagggccagtaagcattcccttcattggacgcttggtaaagctctgagcaagagatgaccagaagactttttttggttttgggcggctcacatcatcgtatatgattgggggcttg

SEQ ID NO: 1227 - DNA, 286 bp, Cicer arietinum
accttcaccacaaggggacttccttgtagtgatgttaagaactttagtaggcatcctgacaggtcccttaaccctaagatgcttgtccttggcaccgcgaaccaagtcagcacaaaccttctcgagatttttgacgtgtttcgaggagagggttatcctaatcttgtggatctgctcctgagactcttccaaaccaacctttgtgggtttcatagcagcatacgccattgttcagatttcaacgattgtttgttacgagacgagaaacgatgcgatgcttccgtgc

SEQ ID NO: 1228 - DNA, 429 bp, Cicer arietinum
acttggatgagaagactatctttcaccttaacccttctggccgatttgtcattggaggtccccatggtgatgccggtctgaccggaagaaagattatcattgacacttatggtggatggggtgctcacggtggaggtgccttttcagggaaggacccaactaaggttgacagaagtggtgcctatgttgtaaggcaggcagccaagagtattgtggctaacggtcttgctcgcagatgcattgttcaagtttcttacgctatcggtgtgcctgaacctttgtcggtctttgttgacagttatggaactggaaagattcctgataaggagattcttcaaattgtgaaggagaattttgactttagacctggaatgatcaccattaacttggacctaaagaggggtggacataggtttcttaagacagctg

SEQ ID NO: 1229 - DNA, 421 bp, Cicer arietinum
accttcttacaaggcaaacatagctgcatgtgtagtatatatataaatggtcagaatagaaaaaactagaagttttttgcagacactatttgcttgattctgctttgatgaattgtggctaagttccctactcaagtgaaactgcattcctctcttgcaaatccgattttgttctgtttggtatcataaatcaccctctgattcctttgctgataattcccaatgatagccatgtcattttcatcagaaagacttgcaaatgccaaacaaacttgtgaagcatcttttgtcatatacaatatgccagctgcatccacattcagctcaacattgtcctcaaaatgcatacttatagtaggtatgctaacttcctcattcccagttagattaaaacatgtatccaaaattgataaccctggtg

SEQ ID NO: 1230 - DNA, 356 bp, Cicer arietinum
tttcgtttcacctgaacactgatctgaaagctgaaagagttgttctgaatctgaaacctaaatgggttacgttcaagaggcacgcgagaatcacgtcaagaagaaagtcgaagaagctttacgaagcaaaatgaagcaaaaagcacttaaagagtgtgatgagtatacaaagaaatatgctgaatgtgctttggggagaacactttcagttgtttggcaatgtcgtcaacaagctaaagagttgaataactgtcttcatcaattcaccaatgattctgtcttggaggaaatgaagaaagaatacatgttaaaacaagatggagagggaactgttagaatctaaactatttaatttc

SEQ ID NO: 1231 - DNA, 433 bp, Cicer arietinum
gaccactagacaaaaccgctgggtcgaaatggtatagagcttacctggagaccgtggaatgaggcgactacctcgtccacagagcagcgttctagccgccttggggttttctcctgcgagggttttccccaaggatgcacggttctagggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggacgctgctggagggaagctctgcgaggatcaactgtattgatgtccaatgggacgtgcttcaccgacaactactgtagggcgagctacgagtagagaggtgcctc

SEQ ID NO: 1232 - DNA, 428 bp, Cicer arietinum
acattgctggaggtgctactcagaattccatcagggttgctcagtggattcttcaagctcctggggcaactagtttcatgggttgcataggaaaggacaagtatggtgaggagatgaccaagaactctaaacttgctggtgtaaatgttcactattatgaagatgaaaatacacctacaggaacttgtgctgtttgtgtggttggtggtgaaaggtctcttattgccaacttatcagctgcaaattgctacaaggttgatcatttgaagaaacctgaaaattgggcattagttgaaaaggccaaatatttttatattgctggctttttcctcactgtatcccccgaatccatacaattagttgccgaacatgcagctgcaaataacaaggtcttctcgatgaacctttctgcaccctttatttgtgag

SEQ ID NO: 1233 - DNA, 398 bp, Cicer arietinum
acaaaaacataaagcaactactatatagcataaagaaatacacatgactcatgaagaaacaaatgcttatatattactcaagaagatgccaagattttttcaaaaagaggcttcaaaaaagccacgaacttctcttggtgaggggtattttctttgatgacttgaacatccttgaaattattaaaccataaatgcaaatgggggaacctctcagtttgcaaaatttccacttcaaatgtattttccaaaacctcaataaatttgacaaaagatccgagagctatgtctacaatgttaatgttgtctcctccataaaatttattttcgtctttcaaacattgatcctcaacaactcctagccgttcccatagattctctttggccttctctcggtcttc

SEQ ID NO: 1234 - DNA, 426 bp, Cicer arietinum
tggttaccgtgagtgagagagaaaaaaaagagagaaaatgaagttcaacccgcgagtgtcaagcagccgccgcaagagccgcaaggctcacttcacggcgccatcaagcgtccgccgtgttctcatgagcgcacctctctcatctgacctccgatccaaatacaatgtccgctccatgccagtcaggaaggacgatgaagttcttgttgttcgtgggacctacaaaggccgtgaaggtaaggttacccaggtctaccgtcgcaagtgggtgattcacatcgaacgtatcactcgtgagaaagttaacggtcccaccgttaacgtcggtgttaacccttccaaggttgttatcactaagctcagactcgataaggatcgtaagtcgcttcttgatcgtaaggctaagggacgcgctgctgctgataa

SEQ ID NO: 1235 - DNA, 405 bp, Cicer arietinum
actacaagtctccactttgaaaatctcccaatgatatcaatgtcaatcatcagaaggagctgcagtggaacagtagcttccaggatagatggtagaacttgcactgctaaatcaggcatacgttgacaggatgtttttcttaagagtgaattcgtcggccttagcagggctgatagacttttcaaggatgcgctctaggcgctggatttcattcttagcataatcagaacctttctccctgtaattcttggcagctttcaagtaaatcttcccgcatcttgaagcagatcccttaagcttctcaacttcctcttccattcgggcaaagacggtcttcttttcttcgtcactagcagctacaaactcttttaccaagacgtccaaattttctactatgccagcctc

SEQ ID NO: 1236 - DNA, 407 bp, Cicer arietinum
actacaagtctccactttgaaaatctcccaatgatatcaatgtcaatcatcagaaggagctgcagtggaacagtagcttccaggatagatggtagaacttgcactgctaaatcaggcatacgttgacaggatgtttttcttaagagtgaattcgtcggccttagcagggctgatagacttttcaaggatgcgctctaggcgctggatttcattcttagcataatcagaacctttctccctgtaattcttggcagctttcaagtaaatcttcccgcatcttgaagcagatcccttaagcttctcaacttcctcttccattcgggcaaagacggtcttcttttcttcgtcactagcagctacaaactcttttaccaagacgtccaaattttctactatgccagcctcag

SEQ ID NO: 1237 - DNA, 402 bp, Cicer arietinum
acacgaacaagaaccagaaagccataacaaaacagataccataacagagactactagatcccaccatctaaaatctcaactaaacataattaaccataaaaacttcatcacgagacttagcttacaaaactactctctccagtttccaccaccaccgccaccgccgctgccacgtgagtaacgggaaccaccatcaccacctccgccaccgtatccacggtccctaccaccaccataaccacctccaccaccatagcctccaccaccaccactgcttcggttgtatccaccttcacgacgacctccaccgtaaccacctcctccaccgccacttgaacggttttgagcttcgttaagagtaatgttacgtccgtccatgtcctgtccgttcattccttcaat

SEQ ID NO: 1238 - DNA, 440 bp, Cicer arietinum
acttcaaaactataagaatcttcaagatatcattgccattttgggaatggatgagctcagtgaagatgataagttgaccgttgcccatgcccgtaaaattcagcgattcttaagccagcctttccatgtggcagaagtcttcactggtgccccaggaaaatatgttgaattgaaggagaacatcactagtttccagggtgtgttggatggcaaatatgatgacctttcagagcaggcattttacatggttggtggtattgacgaggtcattgctaaggcagagaagattgcaaatgaatcacatgcctcagcttaatcacaattttattatcctttctctataattgctaaatttaataatttaggaactctttcttggcaatgccaaacaacaaaattttccgttattaaattttttataatttgaatggtcattcctt

SEQ ID NO: 1239 - DNA, 134 bp, Cicer arietinum
cctagtagttatttaaaacgcattctacgggtcattaataaataatagctagatcttgtcatgataaagtttgtttcttatatcttctaaataagacccgtctggcttgaatggatgattttactattgcatgg

SEQ ID NO: 1240 - DNA, 288 bp, Cicer arietinum
acaaattcaccaagaagacatggctcgttggctactcgtggctcaacgttagcatctccaacgacggcgatgatgagattgatgttttcgctcaactgggcaaacaggatgcttcaggaactcagttagtcaacatgaacgttcctttaaaggaccttattcctcctgtcgacaggcacacagaagctgcagacacatgcttcctgaaatacctgggtcctacaggttccctacgaggtagtcatgctgccacaaaggtgacacctaagcctgggaggttcactggtg

SEQ ID NO: 1241 - DNA, 290 bp, Cicer arietinum
aacataaaaagaggtatttatatatgctctacataacataactcataatgacccaaaccattccggtatatccccaacgccgaaccatgatatcttaagcacgtctatcctctatgtttcttttctctaccattccggcgcaccgccgccacaaccattcgctgccatcataaggtcaagtggcttagtggtcatcttcgcaccaccagtcggcttgacatatggcttctttcccctcaacccaacaaacttgatcttgctgtcaagcttagcaagaggcgcctcaccgg

SEQ ID NO: 1242 - DNA, 198 bp, Cicer arietinum
caacactgaacttcacaaaccaaagcaatggctcctaaccatgctttcatctttttggttctattatccttttcaccacaactcttcttcactctttcttctgcacaacaagataatggtcttcttatgaactactacaaagaatcatgtcctcaagctgaagaaatcatcaaagaacaagtcaaacttctttacaag

SEQ ID NO: 1243 - DNA, 461 bp, Cicer arietinum
acaggcccgtgtgtatgctcagggtctgaccctcgctgttctcatcatctcagctgtctttgagatgaacgacgccaagaagggtgagggtcgctggcagaccgtcatggtcgtcgatcccgaggaccccgagcacaagcgacttattgagaagaagatccacaaggaggagtatgagggccaagacctctggaaggatatggtcgctgctgaggagcgacgcttggccgctaagaagcaagctgagaacaaggcttaaaataaacacgtcatcttcttataacgacaaaaacaactcaatgaaaaccattcctcgatacacattactttaaaactcatcattaatactacgccgagcacaagtcgacaaccacaggaggaaatcggaaattgtatataccaacaaaccgaagtttcatgagtcgatgagctgggatggaaaggaagtggctatcatcgat

SEQ ID NO: 1244 - DNA, 458 bp, Cicer arietinum
cttgttgggaacaagtcagatcttcgtcatcttgtagctgtatcaacagaagatgggaagtcttacgctgagaaagaatcactttacttcatggaaacctcagctcttgaggcctctaacgtagagaatgcatttgctgaagttctcactcagatctaccgtattgttagcaagaaagctgtagagggtgctgaaaatggaaacgcgtctgtgccagccaaaggagagaaaatagatcttaaaaatgatgtttctgccctgaagagagttggttgttgttcaagctaaagattggataatataattcaattgattgccatcggctctgttgtatgtgtaatattctaagagagagatacgaactagaagaagaagaaagaaaaatgtaatttaatttttcatagcatgttagactctgtgtgtaaccctaaaaaacaaagtttgatgtttcaatagga

SEQ ID NO: 1245 - DNA, 432 bp, Cicer arietinum
acactcctttggttcttaaaggcattactttaagcattaacggaggagaaaagatcggtgttgttggtcgaacggggagtggaaaatcaactttaattcaagttttcttcaggctggtggaacctaccggagggaaaataatcatcgatggcattgacatatgcgctttaggacttcatgatctcaggtctcgattcggtatcatccctcaagagcctgtccttttcgaaggaaccgtcagaagtaacattgatccaactggacagtatacagatgatgagatatggaagagtttggatcgttgtcaactaaaagatgcagtggcttctaagcctgagaaacttgactcattagtggttgacaatggagataactggagtgtgggacagaggcagttgctttgtttagggcgtgttatgcttaagcacagca

SEQ ID NO: 1246 - DNA, 406 bp, Cicer arietinum
acttcgctacatcaataaattttaataataacaaatattacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccactttgtgcaacacaaacttggtttctccctcttcgacgaaagtgaatttcttgatggttccagggccaccatttcct

SEQ ID NO: 1247 - DNA, 436 bp, Cicer arietinum
acactagatggacacggtgaactgtggtggcaaaagtttcaccatgggcagcttagttataccagaccttacctaattgaaatcatgtattcagataatattcagatatccaatctcactttggttaattctccctcctggaatgtccatcctgtttacagcagcaacgttattgttcaaggaatcacaattcttgcgcccgtgaactcgccaaatacagatggaatcaaccctgactcttgcacgaacacacgaattgaggactgttatatagtgtcaggggacgattgtgtggctgtgaagagtggttgggatgagtatggtatagcttatggaatgccaacgaagcaactggtaatcagaaggctcacttgtatttctccaacgagtgccgtgattgctttagggagtgaaatgtctggtggaatcgaagatg

SEQ ID NO: 1248 - DNA, 312 bp, Cicer arietinum
accagatcagaaatatggggaagagatacattgtgcaatcataccaagagaaggatcaaatattgatgaagaagaggtcctaatatattgcaagaagaatctcacatcttttaaagtcccaaaaaaggttttcattactgattctttgcctaagacagctactggcaagattttgcgtcggcttgtcgcagaacacttggttggagggaaacttgggatttaagaggaagatatttattgagtataataggttttgattattattgtgatgtgagaaacaatgcaatgtttaaagaatttttcatattgtgt

SEQ ID NO: 1249 - DNA, 284 bp, Cicer arietinum
acgtcaattctccaggagggtcagttacagctggcatggcaatatttgatactatgaggcacattcgacctgatgtgtccactgtttgtgttggattagcagcaagtatgggtgcttttctgctaagtgcagggaccaaaggaaaaagattcagcttgccaaattcaaggataatgattcatcaaccgctcggtggttttcaaggagggcaatctgacatagatattcaggcaaatgaaatgctgcatcacaaggcaaacctgaatggatatctctcctatcaa

SEQ ID NO: 1250 - DNA, 264 bp, Cicer arietinum
aggaaatcagctaaagatggactgaagacaacaggagaaggacttgaatggggtgtgttgtttggatttggaccaggacttactattgaaactgttgttctacacagtgtggctatatgaaatgttttattgttactttatttcattgtatgactttcaatcttgcttgagttttcatctatgaagaataaacatttggacttcaatatgtatcaacaatgtcaaattaatgtagcttttgtcctaaatacggttaattgtttg

SEQ ID NO: 1251 - DNA, 197 bp, Cicer arietinum
acatatatggtggaaatcacaatggtcgttaccttagtgatcttcatgttttggatttgagaagttggacttggtcaaaggtcgaggctaaggctggagatgagtcccctacaactttgaacccttgtgctggccattctttgattgcatggggaaataagctcctgtcaattgctggtcacacaaaagatccttcc

SEQ ID NO: 1252 - DNA, 427 bp, Cicer arietinum
gagaaaaaaaagaaagaaaaaaagaagaaaagatagagagactaataaagagacaaattcaaagaagaagaagaagggtttcgttgaaaaacacgatgcagagtgaaagcaacaacaataaccagttggtagttcagaattctggaagtttaagcttcagtagtcacttgtctaaggaagatgaagagatgtcaaaatctgctctttcaactttcagagctaaagaagaagaaattgaaaagaagaagatggaagtcagagaaaaggttcagcttcagttgggtcgtgttgaagaagaaaccaaacgtcttgctaccattcgtgaggagcttgaagcccttgcagatccaatgaggaaagatgtttcaattgtccgaaagaagattgattcaataaacaaagaattaaagccacttggtcatacctg

SEQ ID NO: 1253 - DNA, 406 bp, Cicer arietinum
actaccgtgtcgcccgcatttcgtgcacttcaggcgactctcagactgttatgaccctagatatcaacatcgagctctttccctgtgctgtttccgacactctgcacgtagttctgtctactactctctctctggacggaagcaaggaggacgagaagggctggcgagacgttggcaagggtggtgatgcgccagcgacagctgccgacctttatgactacgtgtgccatggaaagatctacaagttcgaggagacattcgatggaaataccatcaatgcctactgctctttcggcggtcttcttatgtcgcttcaaggccctatcaagaaactggctcccctccgtgtcgacaacgtctatctactcgtcaagaaataatcagaagcgcctaaacttgtccattc

SEQ ID NO: 1254 - DNA, 428 bp, Cicer arietinum
ctcgtttctgtgacaattctcgttttagaggtggttctccaagaggtggttcttcagatagtgacaaccgtgttcatgttggtaatcttgcttggggtgttgacaactcggcacttgagtcattgtttggtggacatggaacggttttggaagcaaaggtaatctatgacagggaaagtggaagatctagaggatttggatttgtaactttcagtagccctgatgaggtcaacagcgctattcagtccttagatggtgtggacttgaatggtagagctatccgagtctcgacagcagatactagaccaaagcgtcaattttgaggattttacctttcatctatatccgatcaagagaggacttcggtagttgtgaaagaatgcaattcatacttggtgacagtatctacaaacagtggctgtacctcg

SEQ ID NO: 1255 - DNA, 206 bp, Cicer arietinum
tggcaactgtgcctgagagagaaaaaaaagagagaaaatgaagttcaacccgcgagtgtcaagcagccgccgcaagagccgcaaggctcacttcacggcgccatcaagcgtccgccgtgttctcatgagcgcacctctctcatctgacctccgatccaaatacaatgtccgctccatgccagtcaggaaggacgatgaagttcagg

SEQ ID NO: 1256 - DNA, 344 bp, Cicer arietinum
acataaaacataaaccatcgtccgccactctatagtataaaccataaaccacttaaatcattattatgttctccaggaaccttttccaaaaccccgtctatcaaatttcactctttcttgagtaaccgtttagtgcttcttggcgttgttcctagcactggcctcggcagtcatgatcagagcgcgaggagcatcctctctgggcatgtagagctcgacgaattgcaagcactcagcagcgttgaactccttgttggtgaggagctcgttgagctcagtcttggtcttgatctggaaggtcttgcaggtcttctcgccgccgaagacgctgacgaggtccttgt

SEQ ID NO: 1257 - DNA, 224 bp, Cicer arietinum
acaagaacttacccaggtgcggggtatagcaccgcaaaatacctttccgtcacgctcgggagagtttaatcaaatgcctgacttatttgatgctctacatgctttcgtggggcacagaggttccgaaaacaggtttgggcttatggatgctgttgataacttcatgaggcatagaatggctggcatgcacccaaactttgatgttagagggaggtcaagttctg

SEQ ID NO: 1258 - DNA, 339 bp, Cicer arietinum
actgtataaaatcgaagtaaaaactatcaattgaaaaattagttatccaagcagaagaaaactaatatttgcataatccacaaattcagacatgttgaacaagcttcaaaaaataccagaatcaagatctagtaacttcttccccagtatgaccatttctttgcaggcttacctgacgcaaaacacgttgtgccttctgggagttctggctgatcaaagggactacaaagagtctttgctgctcccatctcaccctttgtccttgctttgacatctacttcaacatccttctcatcacaccaaggggctaatatcatctttttttgattcaaagcttgt

SEQ ID NO: 1259 - DNA, 346 bp, Cicer arietinum
gagaaagagttaacagagtaattgggtttttggaatggcgagttcaaaaaattcagatgagtcagagaagccacaaccagtgatgttggttgcaatcgatgagagtgagcacagtgcatacgctctgaaatggactctggatcactttttcaacaacaatagttctgctttcaggcttgttctggttcatgccagaccttccgctacttcttctgttggtctcgctggccctggagctgctgagattttgcccattgttgattctgatttgagaaagattgctgccagagttgctgatgctgctaaacaactttgcattaagaaatcggtaaatgatgtgatagtg

SEQ ID NO: 1260 - DNA, 410 bp, Cicer arietinum
attcgcgatgtgccaggaaaccagaacagccttgagatcgatagactcgcccgctatgctgttgaggaacacaacaaaaaacagaattctcttctggaatttgaaagggtgataagtgcaaaacagcaagtggtttctggaaccttgcatcacatcactcttgaggcaaaagatggggtgaataaaaaggtttatgaagtcaaggtttgggaaaagtcttggatgaacttcaaggaggtgcaggagttcaagcttgttgaagatgcatctgcggagtcaagtgcttaactaggttaataataattaataaaagtcatgttcctagcttggctcgaaggtgagacgcctaaggataatttaaaaccaggatatgtatgaaatagatccaactcttgctttcaggatttagt

SEQ ID NO: 1261 - DNA, 166 bp, Cicer arietinum
acaagaaattgactattacaagagacatatggaaaatccatatggaagattaaacatgaacaaagttcaaagtaaaacgacaacaaccaccaaaaccaatatgctagtctaaatccaccttattattgttgcaaaggaagatgaatcagccagaagctgacctgcc

SEQ ID NO: 1262 - DNA, 435 bp, Cicer arietinum
gagaaaaaaaagaaagaaaaaaagaagaaaagatagagagactaataaagagacaaattcaaagaagaagaagaagggtttcgttgaaaaacacgatgcagagtgaaagcaacaacaataaccagttggtagttcagaattctggaagtttaagcttcagtagtcacttgtctaaggaagatgaagagatgtcaaaatctgctctttcaactttcagagctaaagaagaagaaattgaaaagaagaagatggaagtcagagaaaaggttcagcttcagttgggtcgtgttgaagaagaaaccaaacgtcttgctaccattcgtgaggagcttgaagcccttgcagatccaatgaggaaagatgtttcaattgtccgaaagaagattgattcaataaacaaagaattaaagccacttggtcatacctgccagaaga

SEQ ID NO: 1263 - DNA, 404 bp, Cicer arietinum
acatttattggaattcaaccagttcagcaacaacttacaaaagaaaatatggaataacgtaattccaattcatcaacaaacaactggctcgccaaagagggattcactctctcaaatcaacttgaaatgtatttggtcacaaaggtgcatcaattaataattatgcgttgttattactgggtcttttctttgtagtgtatgcagcatactcctttccagtatcatgtttcattgtctgacctccaaaatcaaggactgcagatgtgaatgccagcgctgatccagcagaaattgcatttgggatgctccttcctctgtaaccaagaatagttgcaccagcaacaaatccaccaacggcgccatttacaagatccctcttgttcctgtagttctgcaccaactgt

SEQ ID NO: 1264 - DNA, 179 bp, Cicer arietinum
tcaaaatttacaagaaaatcagctttctattcttggtctaatcctagatccatgcctcttttgccattgaatgaggatcacgatgacggcgacgatgattattatgattataacgatgaagaagaaaaggttagaaaagtaccatctgcttcatcgccttcttcttcctcttcattggc

SEQ ID NO: 1265 - DNA, 277 bp, Cicer arietinum
gaaaagtatataaaagaaaagagaaagaaatcaaaagaaaaagaaaaggtaggttggagagaatatagcaaaactgcataaagcatcttcatcatcatcaccacaagaaaccgttgttcgatagatctgtggagaacaagatgggacacaaccagaaccaaaaatctctgatctacgctttcgtttctcgaggaagcgtgattcttgctgaattcaccgaattcagcggtaattttaattcgatcgcgtttcagtgccttcagaagcttccagcttc

SEQ ID NO: 1266 - DNA, 400 bp, Cicer arietinum
tgatcctgtgcagaagctttgctctggtggttgtgataatactgtgaaggtgtggaagctcaacaacggacactggaaaatggactgcttccctgcacttcagatgcatacagattgggttcgagatgttgcttgggcaccgaatttgggacttcctaaatctaccattgctagtgcatcacaggatggtaaagtcatcatatggactgtaggcaaagaaggggatcattgggatggcaaggttttgaatgatttcaagacacctgtttggagggtttcatggtcattgacaggaaatatactggctgtagctgatggaaacaacaatgtgacattatggaaagaagcagtagatggggagtggcaacaggtgacaacagtggagccatagaatctgatt

SEQ ID NO: 1267 - DNA, 440 bp, Cicer arietinum
gattagcggtcgcggccgaggtcctccaaccttcaatttcgcattttctatttcaattccaacaaagaaacatggaggtgggtcagatgcggagacaatgggtagactacatcaaatccttgttcaccgaggagtttttggatggtcaatttctgcaacttcagcagctacaagatgagaataaccctgagtttgttgttgaagtggtttctcttttctttgaaggttctgagaggattctcaaagatctctccttttctttggatcagcaaagtgttgacttcaaaaaagttgatgctcatgttcaccaatttaagggtagcagtgcaagcataggtgcacagagggtgaaaaactcctgcattgcttttcgcaacttctgcgaggaacaaaacatagatgcttgcctcagatgtttgcagcaagtgaagcaagagtac

SEQ ID NO: 1268 - DNA, 143 bp, Cicer arietinum
cgagagacctcctagcaactagtggagtgcgcctcgcatctttcaccatgggtatttctagggattctatgcacaaaaggcgtgccactggtggcaagaagaaggcatggaggaagaagagaaagtacgagcttggtcgccag

SEQ ID NO: 1269 - DNA, 254 bp, Cicer arietinum
gctttcttcatcccttattttccactccactaagataagcaagctaccaaccaaactttcaaatggcagccacaccagccgatcaacaggttcctcctcccggtgaaaccctcaagtatcatacgtgggttttgaaagtcttgatccactgcgatggctgcacaaagagagtcaagaaaattcttcagggaattgaaggggtttacacaacagaaattgattctcgggagcacaaggttacagttacaggtaac

SEQ ID NO: 1270 - DNA, 406 bp, Cicer arietinum
acatatatggtggaaatcacaatggtcgttaccttagtgatcttcatgttttggatttgagaagttggacttggtcaaaggtcgaggctaaggctggagatgagtcccctacaactttgaacccttgtgctggccattctttgattgcatggggaaataagctcctgtcaattgctggtcacacaaaagatccttccgaaagtatccaagcaaaagagtttgatctacaaacagcaacatggtcaactctaaagacttatgggaaagctccgatatcacgaggaggccaatcagtgacccttgttgggaatagcttagtaatttttggtgggcaagatgcaaagaggactctattgaatgacctgcatattcttgacttggaaactatgacatgggatgaaattga

SEQ ID NO: 1271 - DNA, 241 bp, Cicer arietinum
acttagaaatttagaatacaactttatgaaacagaaacaaccattcccaataagcagatgctggtggatcacaaatgtttaaaagtcccttgaaatactaacaacaatcgacacaccatagcatcatatttaaaattatacttccgaatgtgtcatcaattgttagaatttcatatgacttttaaacattaatccaaggtctagaattcccctcccgaataattattattttgaagtctgt

SEQ ID NO: 1272 - DNA, 461 bp, Cicer arietinum
acttgttcgccgactctcaacttatgcaagcttccgatgaaccctacgtcatgtcaagggttaactcgttatactgccttcttcagaaagacccttcaaccaccgaagacaaaactgttcacaatacggacgatgatagaaaagttgacgcgagtaataactctactcgatgcgaaactaaaatggttgatttggaaagcgaacaacgtgatgatgacgatgactctggtaatcagcaagaaattggcttgtctaggaaggaatcagctggagaattgcttatgaatcttccaaggattgcttcaatgccacattttctgtttcctatgtctgaagattctggtagacaagttagatagttatgatgtgataaaggttgaaacttgaaagaatcacaacaacaaaaaactctttttaagtagcttttctacagtgtgaatatttttatgtgcattcagttt

SEQ ID NO: 1273 - DNA, 405 bp, Cicer arietinum
ccggttcgatcccttcttcgttcggttcgtttaagtccaacccagatatctacctttcccacaacaacctcactgggcccatcccacccacattagggaacctcaatttaactaccatcgacttgtcgcggaacaagctcgagggagacgcgtcttcgattttcgggcccaataaaactgtccaaatagtggatctatcgaggaatcaactatcgttcgatctgtcggaggtggagtttcccgcgagtctaacgtcgttggatctaaatcataataaggtgtatgggaagcttcctgagggtttgaccgcactaaatctgcagtatctgaacgtgagttacaataggttgtgtggtcagattccggttggtggagatttgcaaagttttgatatttattcttatt

SEQ ID NO: 1274 - DNA, 431 bp, Cicer arietinum
acacgtgtcattgtcgtttactgtttcggaagaagttgttgttgtttcttttgtgtcatggaaatgaccttcaccccatgttaagaagatgttatctctttcgtcttttgttgtttgccaaaatatggcgtagacccaatggtttggttgggcttggagtaaaaattgaagtttttgttcaagggttggtatttgtggtggtggtggtgacggtgaagggtttttttcatggggaaatgatatcatagaagaggatgaagaaggtgagatgatgaaaccttccataggaaaaaatatacgaagagaaacaagagttggtttttttgttgttgttggtgaaattgtaaaagttgggggagaagggaacaaggggttgagattgattaatcgagtaataaaagtggaagtctttatgttgtacctcggccgcg

SEQ ID NO: 1275 - DNA, 329 bp, Cicer arietinum
ataagaagatgaaggaggccaagcctaagaccatcgccaagtccgtcgtcactcttgacgtcaagccttgggatgatgagaccgatatggttgccctcgaggctgccgtccgtgctattgagaaggacggcctcgtctggggtgcttccaagctcgtccccgtgggcttcggtgtcaagaagctccagatcaacatggttgttgaggacgagaagatttccgttgccgaccttgaggaggagacccaggagcttgaggattacgtccagtccactgacgtcgctgccatgcagaagctataaaaagcctgcggaaactacgtcaaactt

SEQ ID NO: 1276 - DNA, 467 bp, Cicer arietinum
gattttcgagcgggccgcccgggcaggtacttatcgtcaaacttatcaacattaactgaagaaacatctactttggttgatgtcccgataacataagactgattcacacgcctcaatgggactccattgatcttaaaaggaccagtaacaagaagaaggccagaaggaagctgtttcaaaaacacaaccctctttcccttgaatctaccggcaagaagaatcaacactgtccctggagtaatgttagccctgagcttagtaggcttaggtttgtgcttgttgcgaagtggcttcttgacatcatcggcggggtagaatttaggagccttctcagcgggagcttcaggcttaggtttgggatcatgtttagggaaagcgccgccgtgtttggccttgatggcccagagacctctcttgtggtacatggcagattttgagtattttccgattcccctgatcaaatcggg

SEQ ID NO: 1277 - DNA, 410 bp, Cicer arietinum
tcttctttgcagcctcggctgccgcccggaacacgaccgggcttcgacaatatgtctcactggctaagaccactagacaaaaccgctgggtcgaaatggtatagagcttacctggagaccgtggaatgaggcgactacctcgtccacagagcagcgttctagtcgccttggggttttctcctgcgagggttttccccaaggatgcacggttctagggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggacactgctggaggga

SEQ ID NO: 1278 - DNA, 240 bp, Cicer arietinum; identical to SEQ ID NO: 342

SEQ ID NO: 1279 - DNA, 433 bp, Cicer arietinum
ctctcctatcaacaatttttgtttcccgaaataccctcccaaatacgtcaaattcccttcgctgccactttctgcacttccgcgttcttcacctgctccgatggaagctcctcccgaaggttaccgcaggaacgttggaatctgtctcatcaataatcacaaaaagattttcgcagcttcaaggctagacattcccaatgcttggcaaatgcctcagggtggtattgatgaaggtgaggatccgagaaatgctgctattagggaactaagagaagaaacaggtgttagttcagcagaagtgattgcagaggcaccttactggttaacttacgacttcccaccaaaagtcagggagaaattaaacattcagtggggatctgattggaaggggcaggcacaaaaatggtttctttttaagtttactggagaagat

SEQ ID NO: 1280 - DNA, 223 bp, Cicer arietinum
ccggaaagagccataaggcgaacggaaaatcttcgccggagacaaggaaggatcggaaatcagcgacaggaacgagcggatcgccgaagaaaggaggacacggaggtaagtttacgtggatcggacgtggctacgaggatcttcaaattggacctgattacggagcattggattctaaggatccgaacttcgaagatcgtgaagaaatcgccgccgtctgagt

SEQ ID NO: 1281 - DNA, 433 bp, Cicer arietinum; identical to SEQ ID NO: 1279

SEQ ID NO: 1282 - DNA, 433 bp, Cicer arietinum
acgccgaaccctttatcccggacggttgtcatcgtcttctcgatgttgttaatggtgttgaaggatccacgcaatgtgatcttgatgagtctaagtttagagctcttgcgattcttgatctcgcttttgttcttcatgttatgtttgctatgattattgttttgattacttacgctcttgttgcggctactgttggtggtgttagaagggtgggttcatatgaggcattgcctactgctacttctcctacggattccaatcatattcagatgaaagctttggctggaacacaggcttgaataggagttaaaggtgaactgcttgatgaagaccagagggttcagattcacattagcgttaatgtctgactgcacgcatctatttttgctttggtgggaggaaaagatatgatgtgtgatgtgttgctggagat

SEQ ID NO: 1283 - DNA, 401 bp, Cicer arietinum
acaagtccaagtccaattatttaattatatgcaaatttctcatttgcaaattacataattattagaattaatcacgatttggtagccaaagattcaacttggactttaccacaaggtcctttcatcctaatataaagtctgtattcatcatatgtcattggtgggtaaagggctggcctctcctttgttacaagctcctttgcaggttcaattaacaaatcactctttgggttgtaaaacatggccaatgaaacacgatcttttattgagttcacaatcactctgtgttctacactcttgtatattgcattgctcagcacctgaatttggtcaccaatgttgatgataaaggcattagggataggcttaatagtgatccattcatttccttttcgtacctg

SEQ ID NO: 1284 - DNA, 270 bp, Cicer arietinum
ctctcctatcaacaatttttgtttcccgaaataccctcccaaatacgtcaaattcccttcgctgccactttctgcacttccgcgttcttcacctgctccgatggaagctcctcccgaaggttaccgcaggaacgttggaatctgtctcatcaataatcacaaaaagattttcgcagcttcaaggctagacattcccaatgcttggcaaatgcctcagggtggtattgatgaaggtgaggatccgagaaatgctgctattagggaactaag

SEQ ID NO: 1285 - DNA, 197 bp, Cicer arietinum
atcttcgaagttcggatccttggaatccaatgctccgtaatcaggtccaatttgaagatcctcgtagccacgtccgatccacgtaaacttacctccgtgtcctcctttcttcggcgatccgctcgttcctgtcgctgatttccgatccttccttgtctccggcgaagattttccgttcgccttatggctctttccgg

SEQ ID NO: 1286 - DNA, 248 bp, Cicer arietinum
aaatcattatagcttagaattcattgttttatgtttatgatgatgttggcaaaaattatatcattacatacaaaaacgtaataattttttaaaagcacaaccatgaaacatggccaaaatagccagcacatttaacatgttatactattctcattcaacaaatcattgctcccattgaatatgccctcccctcacacagcatagctcgcttctctttctcctttacctcttcttttttatacaattat

SEQ ID NO: 1287 - DNA, 271 bp, Cicer arietinum
acgaccacgacaaaaacggcctcatctcgactgaggaacttcacttggcgcttaaccgcctcggaatgaaatgttctgttgaggaatgccgtgatatgatcaattccgttgattctgacggtgacggtagcgtcggatttgatgagtttaagcagatgatgacatctaagagtcgcgccgttaatagctccgttaattagagagtagaaaatttctcagtcttcgccgctggtaaaaaaaccggtgaatctccggtaacagcttccacagt

SEQ ID NO: 1288 - DNA, 318 bp, Cicer arietinum
aaaatcttcaatcttcaaaaaaaaataatgtcagcaatgagaattcacaacgttattttctttgttcttctcttcctttccgtgtcggttttaaccgatgctttgaagaaggaagttcttgttggtgggtggaccccaatcaagaacatcacagacccacacgtggcggagatcgcggaattcgcggtaacagaatacgataaacaatctggtaagaatttgaagctggtgaaagtgatcaaaggtgagactcaggttgtgtctggaacaaactaccgtctattgttgactgttaagaatgaatccgttacaaagaat

SEQ ID NO: 1289 - DNA, 434 bp, Cicer arietinum
acaagaatgtggtgggatccagaagagcttcatggaggatcctatcatcaatagaacagaaagaggaatcaaaagggaatgagttgaatgcgaagcgtattaaggattacaagcacaaggtggagttggagctttccaacatttgcaatgacattatgattcttttagatgaacatcttattccatccactaatgttgctgaatccacagtgttttattataagatgaaaggagattattatcgatacttagctgaattcaaagatggtaatgaaaagaaagaggtagcagatcagtcacttaaagcgtatcagacagcttctaccactgctgagagtgaattacaacctacgcatcctattcgattgggtctggctctaaacttctcggtgttttattatgagataatgaattcacctgaaggggcctgccac

SEQ ID NO: 1290 - DNA, 288 bp, Cicer arietinum
agggaacctctctcctggttccttctgtccaagagttagtgaaacaacccattaccaaaattccagaacgatatgttcatccaaatcaagaccctattgttgtttctaacactacttctttaccacaagttcctgttatcgatctgcataaattgttttctcatgatacaattgagctacaaaagcttcaccattcgtgcacagaatggggtttctttcagttgattaatcatggagtggacccttcactggttgaaaacatgaagataggtgttcaaaaattcttca

SEQ ID NO: 1291 - DNA, 229 bp, Cicer arietinum
gtcaaaagctttgcttgttcggcacctcctttattctacgcactcctttctgcttatcctgcgctactttcacccgtttcgcggactcaaatcctcaattacgcgtcttcgcccttttccacactctcaccacctaccgcttcaagagtctcaactccacaatttcgctctttcgtctcatttcaggaaagaatcatgagttgtttcagctgttgcgaagaggatgagt

SEQ ID NO: 1292 - DNA, 435 bp, Cicer arietinum
agggaacctctctcctggttccttctgtccaagagttagtgaaacaacccattaccaaaattccagaacgatatgttcatccaaatcaagaccctattgttgtttctaacactacttctttaccacaagttcctgttatcgatctgcataaattgttttctcatgatacaattgagctacaaaagcttcaccattcgtgcacagaatggggtttctttcagttgattaatcatggagtggacccttcactggttgaaaacatgaagataggtgttcaaaaattcttcaacctttcaatggaagagaagaagaaattttggcaaacaccaaataatatggaggggtttggtcaattgtttgttgtatctgatgaacaaaagctagaatgggcagacatgttctatgttagcacttttccattgtacctgcccgggc

SEQ ID NO: 1293 - DNA, 229 bp, Cicer arietinum; identical to SEQ ID NO: 1291

SEQ ID NO: 1294 - DNA, 307 bp, Cicer arietinum
acaaaaattgtcgacagtgaacttataaatagtttaaacgagtgatcatcaacattacataaaactactaataaatgtctccatcatacacactataacatacatggaacttaaataagtcaaattcaaatactgatacacataattcacggccgaaacgaatggagacatatgttccctctttgctaagtgcccttcaaaactcaactttgctagttatcaattaagaacattagattagaaaccatatacctaaaaggcttggtcgcaacatgttgaaatgttgatcggctaggtcttgagttgt

SEQ ID NO: 1295 - DNA, 385 bp, Cicer arietinum
actgtccttgtaagaatcttcgtttagggtatccagctctgggacagcatcatcaaaggcttgctttgcaaggtggcaggccccttcaggtgaattcattatctcataataaaacaccgagaagtttagagccagacccaatcgaataggatgcgtaggttgtaattcactctcatcagtggtagaagctgtctgatacgctttaagtgactgatctgctacctctttcttttcattaccatctttgaattcagctaagtatcgataataatctcctttcatcttataatagaacactgtggattcagcaacattagtggatggaataagatgttcatctaaaagaatcataatgtcattgcaaatgttggaaagctccaactcc

SEQ ID NO: 1296 - DNA, 404 bp, Cicer arietinum
accatcgcccaaaagattaatttcttgatcttctccagtaaacttaaaaagaaaccatttttgtgcctgccccttccaatcagatccccactgaatgtttaatttctccctgacttttggtgggaagtcgtaagttaaccagtaaggtgcctctgcaatcacttctgctgaactaacacctgtttcttctcttagttccctaatagcagcatttctcggatcctcaccttcatcaataccaccctgaggcatttgccaagcattgggaatgtctagccttgaagctgcgaaaatctttttgtgattattgatgagacagattccaacgttcctgcggtaaccttcgggaggagcttccatcggagcaggtgaagaacgcggaagtgcagaaagtggcagcgaag

SEQ ID NO: 1297 - DNA, 304 bp, Cicer arietinum
acctcagtattccctgtttccaataacccttaagttgagtgatatcaaaggatttgacatcgtcgttatcatactgcttgctgcacataaatggttcttgacgagtgtgacgagcttcattccgatacttttcatagtgctgtggactgaggacggaagtcaaaccatctatgcattcaatactcagatcttgaagataaagagaaaagaaaacctctctgtcactaaaattgtgaggcaaaaagttaccaacctcatcaattctgtgaaaccagcgcaccacaaccatcttgttgcctctgga

SEQ ID NO: 1298 - DNA, 444 bp, Cicer arietinum
atcggatttatctcttccctatctctcataccaatttcactttcaggatttttaatatggcagatacaaaacaaggattgaggaagccagtgtttactaaggttgatcagcttcgccctgggaccagcgggcataccttaattgcgaaggtggttgattcgaagatggtgatgcagaagggtcgtcccgatggtcctcaacctcgtcaaatgcgaattgctgaatctttggtgggtgatgagacagggatgattatatttaccgcccgaaatgatcaagtggatctgatgaaagagggctctactgtcattttgcgaaacgctaaaattgacatgtttaaaggatcaatgaggcttgccgtggacaaatggggtcgtgtcgaagtcacagaacccgctgattgcaccgttaaggaagacaataacctttcccttatcgaatatg

SEQ ID NO: 1299 - DNA, 313 bp, Cicer arietinum
acatcgtccctattcctatttcacacaggcccgaagccgcggtataacaaattcatcatgaaaaccccatcccgatcatggggagattaaaaaaccttggtcaagagaggatttactcaaaagggttggttcgggttccccaccaggtgaggaagacggagagaccgagggtctcaacgagcttggtagccaggctgacgccgacggtgtcgagaggacgcttctcaacgaagatctgagcaatgtagccgggagcagaggtagcgaagaagatgagggatccgaggtaagcagcgcccttgtagctcagcgt

SEQ ID NO: 1300 - DNA, 366 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggt

SEQ ID NO: 1301 - DNA, 296 bp, Cicer arietinum
acaagggcagtcggtgatggtcaaggtggtctcagaggtgacggtgtaggtcttgtcaccgtaggtgagagtggtagcaccagggcagtaggttgtgatggcggtgacaacctcggtggtgtagtgagtgccgttggagggaggggcgtagtagggagaagcggtggcagctccgatgaggaggccagcagcagcaaccttgatagcaaccattttgaaggatttgggcgtgttgattaagttctgacttttaaaacgagtgaagtgcagaaaagcaagattgagctttgagcgag

SEQ ID NO: 1302 - DNA, 390 bp, Cicer arietinum
acacggatgagggagaagtatgggcttgatacttcagaatttacatacaacccgtcagagtcacaaagattccagcaagtaaactcacagccaactgaggagaagagccgctgcaccataatgtgatcacttcatggatgctattcaaagccatggcactggcaggttgacttccaattattgtttttgtagtcactgaatggtgttgagactggaagtttgagagaaatatatcttatgtggtgtttgtgttcaactctcactttatgggattattccttgacatggcaaaatcatgtttcattttggtgttaatattgtgctgaggcatcagaatttactgtggcgttgcttctgttcatagtttaagatagtcgtaaattgttaggt

SEQ ID NO: 1303 - DNA, 432 bp, Cicer arietinum
acttttggaggtgtggaagggaaataaagctcgtccgacatttggggctgcagatagtggcagttgggtggttcaagggtcttcaacaaccaatttagacggccgaagcggtcaactgttgaacatagttgatgatgtgaatccagggatatacaggataagtttcaacacagggaagtataatccaagtggtttctttccatatgtgtctattgtgtttgaaatcttggagtcacagaaaaaggagcattttcatgttcctctgctgttttcgccattttcattcagcacttaccgcggaagctagaagacatatgagtgagaactgttgcactatcaatgcataatgtgttccttatgtgctatgaatatttgcaagttttcatgaagtgaactttgtgtttgtgcccattgaacattggaaggatacca

SEQ ID NO: 1304 - DNA, 434 bp, Cicer arietinum
cttctgttcctcctcctccaacgccgagtttaacagttcacgaaatccaaactagggttctgttccccgtgctcaacgaaacaaaatcggagacggtaatcgcctgaaaccagcatagtaactgaatcgtaatcttctaaaaaatgtctggggaagaggaagaaaacgccgcagagctcaaaatcggagacgagtttttgaaagcaaagtgcttgatgaactgtgaagtttcgttaattctggaccacaaatatgagcagcttcagcagtcgtctgatgatcccatgaatcaagtttctcaggtatttgaaaagtcattgcagtatgtgaagcgtttcagtcgctataaaaatcctgatgctgttagacaagttcgagaaatccttgctagatatcagttggccgagtttgagctgtgcgtcctaggcaatctc

SEQ ID NO: 1305 - DNA, 349 bp, Cicer arietinum
acggaagtttgttccagcatacactgcttcagcaccaagctcctcctcaattctcaagagctggttatacttagcgagacgctctgacctgcatggagctcctgtcttaatttggcccgttgccaaaccaacagcaagatcagcaatgaaggtatcctcagtctctccacttcggtggctggtcatgacaccccatccagcctttttggacatcctcacggcttcgatactctcagtcacagatccaatttggttgaccttgagcagaagagcattgcatgcttttgaatcaattgccttctgaaccctcttggggttggtaactaagagatcatcaccaacaatttgt

SEQ ID NO: 1306 - DNA, 309 bp, Cicer arietinum
cgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagcggggtatcctgtacctagctagctcagcacgtcttttgctccagtaggagatttggcttcgttacagccacccagacgaaaaatacacataacataacct

SEQ ID NO: 1307 - DNA, 154 bp, Cicer arietinum
acacgaataacaaaaggcacgcttggtcggtgatgtctttacgagtgttgctgcaaattatgacacaatgaatgatctaatgagtgctgggttgcatagactgtggaaggaaaggctagtttctatgctgaatccttttcttggaatgaagcat

SEQ ID NO: 1308 - DNA, 433 bp, Cicer arietinum
acacgaagaagaaaaggcacgcttggtcggtgatgtctttacgagtgttgctgcaaattatgacacaatgaatgatctaatgagtgctgggttgcatagactgtggaaggaaaggctagtttctatgctgaatccttttcttggaatgaagcatcttgatgtggctggtggcacaggggatgttgcttttagaatcttggacaacataaacaaagttaagcagagtgggattcgaaataggtttcaagatggtttagaggaagaaactcagatatatgtatgtgacattaacccaaacatgttaaatgttggcaaacaacgggccaccgagaagggttatggagaagatggttccctcgtatgggtggagggaaatgctgaaagcttgagtttccaaaatgattcaatggatggttacactattgcatttgga

SEQ ID NO: 1309 - DNA, 344 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacgagtggggaagttgaagctgcgagagaactcgccgaaggtgcgctcggtgagccagtcct

SEQ ID NO: 1310 - DNA, 268 bp, Cicer arietinum
ctcttcacctcatcaccgccaagttgaatttttgtgaaattaacagttgaaaaaaatgagagaaatccttcatgttcaaggaggacaatgcggtaaccagatcggaacaaagttctgggaagttgtatgcgacgagcacggcatagatccaacgggaagatacgtcggaaactcagatctacagctcgagcgcgtgaacgtttactacaatgaagcatcatgcggaaggtttgttccacgcgccgttctcatggacttagagcctggt

SEQ ID NO: 1311 - DNA, 431 bp, Cicer arietinum
acggatgttaaaccttctgaaattgctaaacaaggttttgaagaggccaaaaagaagaaaattgatgtggttattgttgacactgctggtaggctgcagatagacaaaggaatgatggacgagttaaaagaagtgaagcgtgtattgaatccaatagaagtcttgttagttgtggatgctatgacagggcaagaagcagcagctttggtgactacattcaatcttgggattggaataactggtgccatattgacaaagctagatggtgattcaagaggtggagcggctttgagtgtcaaagaggtatctggaaagccaattaagttggtaggtcggggggaacgtatggaagatcttgaacctttttaccccgatcgaatggcaggacgcatactaggaatgggagatgttctctcatttgtggagaaggc

SEQ ID NO: 1312 - DNA, 431 bp, Cicer arietinum
atccgagtggcatcgctacaatctcaaacgcaaggtggctggggttcccggggtgacagaagcattgtttctagctagacaatctgcacttgctctagagaaagataaatctaatgaaacccctatgctctatagctgtggcctatgtggtaagggttataaaagctctaaagctcatgccgagcatcttaagtcgagaactcatatgatgcgggcttctgaaggagctagtcattctgatgggaaggctataattaagccacttccacaacgcgttgtgaataagcctcctcctagaaaagtgccagataactctgctgaaagtgaagaaagtgaagatgaatgggaggaggttggttccgatgatgatcttattgatgctgctgcaaagtccttgacagatatgaacatggacgagaatgctgataatg

SEQ ID NO: 1313 - DNA, 432 bp, Cicer arietinum
caacaaaggaaacaacagaaaaatggttcaaacgctgtcaatgcccgtggcaccttcactctctatcatctgcaatggccatttctccaacagagtttccttccctgttctcaacgctcccaaaccaaaggttcaaagattaagcattgtgtgcgttcgtgttggtggtgtggaaattccaaacaacaaacgaattgaattctcgctgcaatacattcatggagttggaaggaacagagcgcgaacgattctaagtgatatccaaatggaaaacaaagtgacaaaggaactgagtgaggaagagcttattattctcagagaggaagtatccaaatacaccactgaaggagatttgagaaggtttaatgcacttaatattaagagattaaaggagatccagtgttacagaggaataaggcatattcagggact

SEQ ID NO: 1314 - DNA, 311 bp, Cicer arietinum
cacaaatccatcctctgagatatcaataagctggtagtcagtgcgattgacgtgaggaacatcacagttatgagaagaaggaacaatatcttcaagttttttgccagtgaagatgtcaataccaacaaagtgacactttgcatgaccatgcttcccagtttttgaagttgaaacttccactaccttgcagggtctgtttttgataacaatgtgaccatttttgcgaatggtgccagcttgttgtggatatgtctttgatgctccagcatcagccttggactcgaaatggtgttcctcgtccgacatttttc

SEQ ID NO: 1315 - DNA, 287 bp, Cicer arietinum
acatttttgaagcaattggagaccaaattgcaaaatgtgtctgatctgaagcaatcatcaaccgtagcaccttatgggatcagtgcatcccttttcagcagattgattaaggcctttgcctccacccttctccaaatattgctgatgatattcctctgctctataaaatctctttgctggaagtatttctgttacaatcttgtccttgtgttccaattgtttagcttcttttgattcttgggctaaacgagcttgggtttcattgaagtagtatactcctgatctat

SEQ ID NO: 1316 - DNA, 422 bp, Cicer arietinum
acggttaatggggggcgagaaggccggccaattggtgcttatgaactagcaaaagctgttgaagagcttggtgctggagaaatactacttaactgcatcgattgtgatggtcaaggaaaaggatttgatgtagatttaataaagttgatctcagatgctgtaaatatccctgtgattgcaagtagtggtgctggcgttcctgagcacttttctgaggtgtttactaaaaccaatgcatccgctgcacttgctgctggcatttttcacaggaaggaggtgcctattcagtccgtgaaaggacatttgtcgaaagaagatatagaagtccgaatgtgatctttacattttagttcaagatgcactatataaaagcaaactatatagccctttaaactctcaaacttttttttttcttttccaaa

SEQ ID NO: 1317 - DNA, 271 bp, Cicer arietinum
acttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccct

SEQ ID NO: 1318 - DNA, 336 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgagctagatgggagacgctgctggagggaatctctgctgagatcaactgtatt

SEQ ID NO: 1319 - DNA, 154 bp, Cicer arietinum
accccttactcgatgagctggtgctccatatgattagataatactcacttcgcataagtagtatatctccatcattcaattgattgattattttctgtagaataattgtgtatattggaattatctgattatgatagatgtggattatcgctaa

SEQ ID NO: 1320 - DNA, 424 bp, Cicer arietinum
accccatactcgatgagctggtgctccatatgattagataatactcacttcgcataagtagtatatctccatcattcaattgattgattattttctgtagaataattgtgtatattggaattatctgattatgatagatgtggattatcgttaatttaattgatgagtttttttttttattaattattggaagtagttggttattatagagaaatcttagttatatcattaatagttctaaagaatatttttggatgaaggcgggtgccatgatcgactttttttccggttactgctccggctgagaacaatacttgttttaaaattgtgtgtattattcactgggatttagtatctcattaaagtgttgttgtcatatactgataccgttggggatgtcgagagttgagaagtcctacctccc

SEQ ID NO: 1321 - DNA, 429 bp, Cicer arietinum
acaacggcttcacttatcaacaacttctcaattccatgctcactactggatttcaagcttcaaaccttgctgatgccattaacgtcgttaatcaaatgctagattggaggctggttgatgaacctgtgactgaggattgtgctgacgaagagagagatttggattacagaaaatctgttaagtgtaaagtgtttttgggtttcacttctaatctcatttcatctggtgttagagatgttgttcgttacctttgtcagcatcacatggttgatgtgattgttacaactacaggtggtatcgaagaagatctcataaagtgccttgcacctacatataaaggagatttctctttgcctggagctcatcttcgctcaaaaggattgaatcgaattggtaatttattggtccctaatgacaattattgcaaat

SEQ ID NO: 1322 - DNA, 435 bp, Cicer arietinum
tagcattaacagcgaaatcgaaaaatgagaaagttcgatccatggcccgttttcttcaagcgagaatggaaacgtaactggccattcctcgttggattcgcagtcaccggagctgttatcaccaagttatctcttggctttaccgaggaagatgctaagaattcgaaattcgttcaggcgcacaagaggtaatttcggaatggggacactgcactggccttgcacctcatgttagttgtgtcaagattactcgtcttgattttttgcattgtaataacagaagagagatattctatatactccctctatcatcatattattattttcagttttggtcctttacctaaatctgcttgaaaagttcatactaagcaattattgattttctctattgtgatgcttatcctacttggaatttctcttttggtgtacctg

SEQ ID NO: 1323 - DNA, 425 bp, Cicer arietinum
ccgagaacgaggccggcgttgagttcgacgaccaaatcacccttactgctagcttcgaccacaaggtcgttgacggtgccgtcggtgctgagtggctcaaggagctcaagcaggttcttgagaaccctcttgagcttcttctgtagatcaggggtaggacgtcaagtggcccctgaaaaccgaattatgctgggaaagacgaaatggctggtcgagcgaggaatgacttttttatagaacaggaggagatgacctctgagggacggagatgcggtaaggagtttacttgggatatcgtggggacacccatgagagcattcctgggtaaggatcggtgaatcacgacgatgatgagcatctatgaggacacccacagagcttcttcgcctgatcacgccgcagcattcgtggaagatttacgaggc

SEQ ID NO: 1324 - DNA, 242 bp, Cicer arietinum
actcgtgctgcgcatgctcggccttttgcgaggcagtaatcgctcgctggtgggtgaaaccgtaaaagatacccaggtcaagggcggaccaccgcaaaacgttcactccggtcgaagccattgggaattagagtcgcaaaaaagggcgaacgggacgaagagcgaaaggatcggtattgacgatagtctgcggtcgacaatggcttgtcaatggacccagtcggagtggctcgaggggatta

SEQ ID NO: 1325 - DNA, 309 bp, Cicer arietinum
acggtcctaggttgcagctactggcgatcttaggggatcatggacttcctgcctcagggtatggaaagctacttgatctatctgtgcaagagaattctaggctggagaggaatagttcccgctgacgggatgacctcttgaaagtaaagcgccttcgtgccgatgatatgctggatgaactagatagaagcgttgctggagggaatctctgctgagatcaactgtattgatgtccaatgggacgtgcttcaccgacaactactgtagggcgagctacgagtagagaggtgcctcttgggggtaatgaat

SEQ ID NO: 1326 - DNA, 303 bp, Cicer arietinum
acagtcctcggttgcagctactggcgatcttaggggatcatggacttcctgcctcatggtatggaaagctacttgatctatctgtgcaagagaattctaggctggagaggaatagttcccgctgacgggatgacctcttgaaagtaaagcgccttcgtgccgatgatatgctggatgaactagatagaagcgttgctggagggaatctctgctgagatcaactgtattgatgtccaatgggacgtgcttcaccgacaactactgtagggcgagctacgagtagagaggtgcctcttgggggta

SEQ ID NO: 1327 - DNA, 423 bp, Cicer arietinum
acacagagacatcaaagccaaaaatatacttattgatcgaaattttactcctaaacttgcagactttggtttggccaaattaatgagagatgaaacatcttacattagcactagagttgcagggacattgggttatttggctccagagtatgctagttctggacaactaagaagaaaatcagatgtttatagctttggagtgttgcttttacaaattatcagtggtttggcggttgtagatgcctatacagatatcgaacgtttcattgtagaaaaggcgtggacagcttatgaggcaaatgatctattaagaatggtagatcctgtgcttaatacagactatttagaagaagaagccataaaattcctcaaagtgggtttactttgtgttcaagaaaccgcaaaacttaggccacgaatgtc

SEQ ID NO: 1328 - DNA, 425 bp, Cicer arietinum
ggatggtgctgggcggagcaatgtggaaaacaagctggtggtgcgttgtgccccggtggattatgctgcagcaaatttggttggtgtggttcaaccagtgactattgcggtgatggttgccagagtcaatgtggaagcggtggtggtggtgttggtagcatcatatcgagggacaccttcaaccagatgctgaagcatcgagacgatagtggttgtgaggggaaaggattctacacctacgaagctttcattgcagctgctaagtatttccctgatttgggtaataacggagatactgcaactaagaaaagagagattgcggctttcttgggacaaacatctcacgaaacgacaggtggatggtcaagtgcacctgatggtccatacgcttggggatattgccttttgagagaacagaacccaag

SEQ ID NO: 1329 - DNA, 432 bp, Cicer arietinum
cttctctgacggctacaaccctcgtcgtttccaaaccctaatggcaccgaagaaggaaaaggctccaccaccgtcgtcaaagccggcgaaatccggaggaggaaaacagaagaagaagaagtggagcaagggaaagcaaaaggaaaaagtcaacaacatggtcttgtttgatcaatctacctatgataagcttctcactgaagctcccaaatacaaactcatcactccttcaatcctctccgatcgtctcagggttaatggatctttggcacgtcgtgcaatcaaagacctaatggcgaaagggttgattaggttggtatctgcacatgctagccaacagatttacactagagccactaatacttgaacggcttcaaggtgcttatttgttatttagcttctgtttagagaacattgttatgaggatgttgt

SEQ ID NO: 1330 - DNA, 427 bp, Cicer arietinum
aaaacttcgtctttcagatccggatccacgcgccgccatcatggtgaacgttccaaagacgaagaagacatactgcaagagcaaggagtgcaagaagcacacactccacaaagtgactcaatacaagaagggtaaggatagcatcgccgctcaaggtaagcgtcgttacgatcgcaaacagtccggttatggtggtcagactaagcccgtcttccacaagaaggctaaaaccactaagaaaattgttctgaggctgcaatgccaaggttgcaagcatgtttcccaacatgctatcaagaggtgcaagcactttgagattggtggtgacaagaagggcaagggaacttctcttttctaggtggagaattaggatttattactgttttgatgtgttattttccgtgttgggatgttttgtttctctatg

SEQ ID NO: 1331 - DNA, 434 bp, Cicer arietinum
tgctccttctcgccatggcggaagcgggaattcgatttcgagcggccgcccgggcaggtctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgtacc

SEQ ID NO: 1332 - DNA, 250 bp, Cicer arietinum
gattcccctctgatctcaaaacaacaactctttgcaagaattgttggaggattaggtggtagggctgcagaagaaattatttttggtgagcttgaggttacaactggtgcagctggtgatttgcagcaaattaccggtttggcaagacagatggtaaccacatttggaatgtctgatattggtccatggtcacttatggacgcatcatcacaaggtggggatgttatcatgagaatgatggtaagaaact

SEQ ID NO: 1333 - DNA, 246 bp, Cicer arietinum
acttaaaggcaaatatatttttaaataattatatataagctaggtttgctttagtacaaaagaagaagtaaaacattgttgactaaaacaattcttgcaaaatatatttaaatgtggaattggtttattcaaactttttttatttcattgaagtggctcttctaataatattgtgtgctttgcgatatattataacattcattcgtgagtgatagtttgttaaattcaaaatattaaaacaattca

SEQ ID NO: 1334 - DNA, 437 bp, Cicer arietinum
acattcttcaacagactttcccctgttgtggaccccacaatggacaaaactttagcaaaaaaccttaaatcgacttgtcctaatgcaaattcaggtaatgttgcgaatttagacattagaacaccgacagtgtttgataacaaatattatcttgatttgatgaataaacaaggtttgtttacatctgatcaagatttgattaatgataagaggacaaaagggttggttaatgactttgctgttaatcagaatttgttctttgagaagtttgttgatgcttttttaaaggttagtcagttggatgttttgactggaaatcaaggtgaaattcgtgctaaatgtaatgtggtaaatagtaagaaatctgttttggaagatttggttgaagaggggatgagattaattaatcagttttaattaaattgaggcatagtttg

SEQ ID NO: 1335 - DNA, 335 bp, Cicer arietinum
  misc_feature (101)..(101): n is a, c, g, or t
tctgtttcccgagcgcaccttcggcgagttctctcgcagcttcaacttccccactcgtgtcgaccaggaaacgtctctgccaagtttaaggacgggtcctngagattgttgttcccaaggccaagaagacgagtctcgccgcatcaacgtcgagtaaacgcgacaacgcaccacgacccggaatcttgacgaccttattatccagctctcagatttcacgacaagtcaagatcaggaatgactcatctttacgactttacattgcatggatcggtgttgggaagtttcttacgtgaaatagcattgtaggcctggattggtcattcgctccttgt

SEQ ID NO: 1336 - DNA, 165 bp, Cicer arietinum
cgctttgccagggtagagaatttttgcaggctaaaatggcagcaaaagcagctgtggggctaacgggaccctaacagctgcctgaagaaagggattcagagagttgacctttcttcgcgacgagtgtctgcaacgacattgagcttcgcgagctcttgacaccgc

SEQ ID NO: 1337 - DNA, 370 bp, Cicer arietinum
gccgaggtacgagcatagtcaagagagtagacaaagaaaagggatgatgcaccagcagcacctcctgaggccaagttaccagcaaaccatttccagtaaccatccttgtccttcttgaaattgaagagcctcttgaagtagtccttgaatgcaaagttcaaagcctgagtcgggaaataacggatgacatttgcggtgttacctctccatagggcaacaacaccttcatcagccattgttcgcttaaaacagtcaccgattcccttgtagggctcagaaagtctaccggctttaatcatctcatcttggttctggatcaaaagcttaattcgttcaattggagcagcagcagttttagacacagcagctg

SEQ ID NO: 1338 - DNA, 196 bp, Cicer arietinum
gcagtttgcccttatgtctcagcttggtcagcagcaatcaacacaggaaccaggccaagcaggtggaggcactggatcagttaacaacttggggctggagatgttatcaagtatgtttggtggacttggagctggtagcctagctaatccaaacagatcaaatgagccaccatagcaactgtatgtcacccaactt

SEQ ID NO: 1339 - DNA, 435 bp, Cicer arietinum
acagtttcacccttcagactttcaactgttggtatttgtcgctctcctcaatattttgggcaaggtccgccactgcttgtgtgtgatgcattcgttgaggatgaagatgtcattgattcggcctctgttgacgaggcgaggattcagcacaagctctgacaaaatggttgccgctgtgctgtttgagagattgcctgtggttattcccaaagttgaccctgttgtttatgcatttcaagaattctcgtttcgatggcgaatgcagtatcaacgtagatatcccgatgaatttctagacagatctggtgcaagggggaaaggtgattatcagattgactatgtgccagcaccaagaatcaccgaagcagacaaaaaaaatgatcgaaggtcactgcaaagagctcttgacaaaagactctaccttcttctctatgg

SEQ ID NO: 1340 - DNA, 372 bp, Cicer arietinum
ctaatttccatcaattcctcaccaaatggaggtcaggttgttatagcagcctctctaactaaagaacagttggggaaatctgtccatcttgttaatttggagctcagcataacacacggtggtagtggggtggcagaagcattgttgaacgagatgtttggaaataatgtgctagaatcagaagagggtattagcctacacatcagtagaaagttgctaaagcttatgaatggagatgttcgttatttaaaagaagcaggcaaatcatcttttatcctatctgttgaacttgcagcagctcataagttgaaaggttaaaattttggataaattaataaaagatgatacaacatgatgatgtgtttgctttgt

SEQ ID NO: 1341 - DNA, 319 bp, Cicer arietinum
accccttcgccgatcttgggttctctgccaaggacggtatctacttcgacaagctaccggaactcggtccctcgccacttgttagcaaggaagaggtggactactacgccaaagaatatgcctcgaaagaaccccctgagctgcgtggccctctaaactattaccgtatgcaggagctcaaccaccgcgacgatgcagaggtagtcaagaagggtggccacaagttcgagatgccagctttgttcatcactgcaactgacgattcggttctcccaccgtctatgtccaagggaatggactcagcctttaccaacttaac

SEQ ID NO: 1342 - DNA, 165 bp, Cicer arietinum
cttgtgtcacaggagaggcaagaactcggccgcgagctaagaagtgagctcttgacagctgaaaagtttgtgctggtgattagtggacatgagaaacttcagcagaataataggagcttgaggaggttggttgagaatagacttccatttctcaatcctatgaac

SEQ ID NO: 1343 - DNA, 399 bp, Cicer arietinum
  misc_feature (293)..(293): n is a, c, g, or t
  misc_feature (326)..(326): n is a, c, g, or t
  misc_feature (378)..(378): n is a, c, g, or t
accctcactccggacgagttctacgctcaccactcagtgagtcacggttccgaatttgtaaccaaccctagagacctcaaactctttacgcagtggtggatcccccagcctccaactaacatcatcgggaccatcgccgtcgtccacggctacaccagcgagtccagctcgtttatccaactaaccgccgtttactttaccaaggccggattcgccacgtgcgctatcgaccaccagggacacggtttctccgacggtctaatcgctcacatccctgacatcaatcccgtggncgacgactgtatcacgttcttcgaatcatttcnctctcgcttcaattcttcgttgccttcttttctctactcggagtctcttggnggagctatcgcgcttttaacc

SEQ ID NO: 1344 - DNA, 432 bp, Cicer arietinum
actatgagcatagattatgaaaaatcagaatatttacaatgaacgcaagaaatttgatgctggcaggcaacacataagcacaagaactaagctataagaaacatagtaggtgttggtgaatactaataaccaagcaattaagcaaagagaaataagatagatttaattaaacacttagattggtaaatcacatgacagcacaggcggctgggttctcgtcgctgaaagcggtggtgtagcggacttcggtggagcttgcacgcgctagatttggatactgagactcaccgtatgtattccgaacgtaacctgaaggggctttcctatcgtaaacaccttgtgcgtagggatgagcaacggcgtcgtatgggatatatggccatatctctgccctcttcccagtgcggtgagcgatacgcgccaccactttgg

SEQ ID NO: 1345 - DNA, 421 bp, Cicer arietinum
acagagcttacctggagaccgtggaatgaggcgactacctcgtccacagagcagcgttctagccgccttggggttttctcctgcaagggttttccccaacgatgcacggttctaggttgcggctactggcgatcttaggggatcatggacttcctgcctttgggcatggaaagctacttgatctatctgtgcaagagaattctaggctggagaggaatagttcccgctgacgggatgacctcttgaaagtaaagcgcctttgtgccgatgatatgctggatgaactagatagaagcgttgctggagggaagctctgctgagatcaactgtattgatgtccatgggacgtgcttcaccgacaactactgtagagctggctacgagtagagaggtgcctcttggaggtaatgaatacagaaaa

SEQ ID NO: 1346 - DNA, 379 bp, Cicer arietinum
cataaacaacactaccaaatcaaatcaatggccactatcgccggtcaacatgttcgtgctcccccgttgacttcaacttccgaacaaccacctcttttcgatggaaccaccaggttgtataccagttatagttgcccttttgcacaacgtgtatggatcactaggaactacaaggggttacaagagaagatcaaattggttcctattgaccttcaaaacaggcctgcttggtataaggaaaaagtatatcctgaaaataaggtgccatctttggagcacaatggcaaggtattgggggaaagtcttgatttgatcaaatatgttgatgctaactttgaagggactcctcttcttcccaatgatctggccaggaaggagt

SEQ ID NO: 1347 - DNA, 427 bp, Cicer arietinum
actttcaggcggtggagatgcttcttgaccacctcgagctggccgttcaaggggtgataatcgaagagaatgacgaccatatcatggaagaggttcacctgttcgatgacatggatgcgaagacccggaagcttttgaagatttacatcaagttcggatggaagaagctgaatgactattatggcaagctgacctctaccgcctacgtagcggcagttgtattccacccgtgtaagaaatggcgaactctagagcagctttggaaccagctgccgtctcgtcagacgtcagaatggaggaagacctatgaaggaaacttaacgagagtctgggaagagaagtacaaggacatggctcatgaggtggcctgcaatgccgtttcagcatctgagagcaatagtgccttggactatattgagcgccgatt

SEQ ID NO: 1348 - DNA, 370 bp, Cicer arietinum
atacgtggtccggccgagtaatatggacccttgaaaaaaaggtttccagaaacagagctctggagtatctggacagcatgaaaaatactgcgagttatctcaaatttttcttgaattttgaattgctctcactcaaactgtctcattcttgaaagatcaagtcctttggaccaaatcccagctcagcccatgcctgctgtcttttctgactgtgatcacatccaactgcggaaggtggaaagtactgtgagagaatcaacttgaaaacttgggctcccttttaaaaacggtatagacagatttgaggtaacaaagttgccttttgggacataagaacagtactgcccgggggcgtcaatcctagtgaatc

SEQ ID NO: 1349 - DNA, 423 bp, Cicer arietinum
acagtataccccgcttccttcaccatccagcataccaaggcacaaaaggcgctgtattttctcgagcccgtcacccgtcagcgggttcgggggcatactgtcgacttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccaaaattccttctct

SEQ ID NO: 1350 - DNA, 432 bp, Cicer arietinum
tggtgaaggagaagatcgccatttgattctggagagatgtctagatacagctataccttcaatccttgtcagtgatatcctatggaagtatgatgatgaacctcaatctttgattgcatcacaccaaatattaaggagaaaagaagcctctcctgtttcgcagacaaataccgcatccattcagcagacactagaggaaagaaaagcagcttatttagctgctcgtgagcggattttttctatgagtttggaagatgccaaagagccggacgaacaaaagccacgaagcgtgccagtagttgcccgccgaatgattgcgcatgcactaggtcaaagaatcaatacaaagaatccaaatgagccagttagtgatagtatcaaggaaagagggctcgccgatgaatcaaatgctaaagataagaacagcggaaa

SEQ ID NO: 1351 - DNA, 403 bp, Cicer arietinum
tgctgagctagctaggtacaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggt

SEQ ID NO: 1352 - DNA, 125 bp, Cicer arietinum
acaaatttggctgctggggaggatttatatgcgctttttgctggagttctaacaatgagaccttggaatagagttgttgacccatccatggatcatttagttatacagggaagtgagagtgaccg

SEQ ID NO: 1353 - DNA, 356 bp, Cicer arietinum
gttttgatgggtgctgttgaaggttaccgtattgctggtgggcctcttggtgaggtcactgacccactctaccctggtggtagctttgacccattgggcttagctgacgaccctgaagcttttgcagaattgaaggtcaaagaacttaagaacggtagattagccatgttctctatgtttggattctttgttcaagctattgtcactggaaagggtcctttggagaaccttgctgaccatctttctgaccctgtcaacaacaatgcatgggcctatgccaccaactttgttcccggaaagtgaccttaattcggtttcattatgtgtttttggtgaagtttacgttcttgtaatgt

SEQ ID NO: 1354 - DNA, 426 bp, Cicer arietinum
acaacctctccaccaagatcacaggtggtcagcgtatcgacttgtttggtgcccagaagcaggaccttctcgacatctggggccagcttgttgctggtggtatggagtccggtcatgcttatgccaagtctctgcgaaccgtcaagagttgcgttggttctacatggtgtcgattcggtctgagtgacagtgttggtatggccgttcgtctggaggagcgatacaagagtattcgagctcctcataagatcaagggtggtgtgagtggttgtgtgcgagagtgtgctgaagctcaaggcaaagatttcggtttgattgccactgagaagggctggaacatcttcgttggcggtaacggtggtgcgaaccctcgccatgccgagcttctagccaaggatgtgcccccagctgatgtcgtgacaatcc

SEQ ID NO: 1355 - DNA, 424 bp, Cicer arietinum
ttttttttacagaaagtttactgaacctattcgaagactaattatgcatatatatataaccaacttcatagatggacaagacagaacagcaaataattactcagagtccacttctaaggacaccttccgagctaggtcgtaagataatttcaataacgtctttatgcccgtcatggtcgcttgtctgggcgtagaatttttgagctttggcatagtcctccgggtcgttgagcttgtagctcaatgcatcttcttcaatgctccgaagtactgtcatattggtcgtgcccccgacgatgccgtcgtgtacatctcctgcaatatgataccgtgcccatacggcatcgccgtatctgccatcgcgaactgcactgacatactgactagcccatggctcgactactgggatccaggaggtgttggt

SEQ ID NO: 1356 - DNA, 427 bp, Cicer arietinum
ctttatcaaactcaacaaacaaccataacaatttcatttcctttacttcaaaaaaaaaaaaaaacgataaacgctaaacgcaaacgcacttaatcactatgcaaaccgtttcggtttcacctcgcagcgaggtttctggaaagttcgaaaatgatttttttgaaaaacttaaaatcgaagatgaaaatgtagaaaacgaagttaagcacgatgaggtagaagaggaatacgacgaagaagaagagtttaccttcgttttcgcagatcctaatggctcgccgatttccgctgacgatgtgttcgatcacggtcagatacgtccgatttttcctattttcggtcaggatctaatgttcaccgacgagtatgacagcgaatctggtaaccgctcgccagtgaagaagatcttcgttgaatcgccgtcaaa

SEQ ID NO: 1357 - DNA, 314 bp, Cicer arietinum
acatcttccacgggaattcatttccaagctgttatccttttgttttcctgaaatcctgaataaaacaggtgatttatttaacaacttaagattctgattatatgtttgctgaaaaaaaaaaaaaaaaaaaaaaaaaaagcttgtacaaaaggcttgactgaataatgtgatcaagaaaataatccctttgaaaagtttggttgcttccgatcctgcattaacatctttggctcgttacctaattcacgaatcttctgaatatgttacgggtaacaattttattgttgattgtggagcaactttaccaggtgtac

SEQ ID NO: 1358 - DNA, 379 bp, Cicer arietinum; identical to SEQ ID NO: 1346

SEQ ID NO: 1359 - DNA, 428 bp, Cicer arietinum
acattagttaattgccttgtttttcttaacaaagaaaaagaaggataaaaataaaaatataaaataagaacccattggtcacctttataaaaaaaaactactattaatctatagtttttcttcatggtgatctccaacttcttaagccaatgtcattgtgtttccttgaaggagttgaatatggtatatgcatcctttttggcaagaatccaaaaaagtgaccttgatgttgagatttgggcttcactttgaacacatttgtggttcttgatccatgacaatggtccaatatgaagatgaacaaaagcaaccatataacaagaactagaggtcttctaaacaaacccatggtgtatcaaactttcactatattaatttctagattaaggatgtctttacaaagttgtaaagttgatgttttgaaacaa

SEQ ID NO: 1360 - DNA, 404 bp, Cicer arietinum
acaggccattcaagcggcgactggtaatggagttgaaggaagaacccggttttcggctggaatttcagcaaactctgatagtaatgcgcggaattcatctccactcaacgtctccttctcgaggaggacttccacgatcttatcaattgcttcacggttgttctttatatgtgtcaatgcaatttcatatgcttcatctgataacctcttgacagcggtatcaatgtcttctgcaagcttttctgacattgagtttcttgccatcattctcatgataacatccccaccttgtgctgatgcgtccataagtgaccatggaccaatatcagacattccaaatgtggttaccatctgtcttgccaaaccggtaatttgctgcaaatcaccagctgcaccagttgtaa

SEQ ID NO: 1361 - DNA, 433 bp, Cicer arietinum
gcgaggtcctccgacctccgcactaccccaactccttacccatgtccgatgattccctcccgccgtctccacctccttcctttctcttccaccgtccgccgcttcttaaacaggaattatcttctcccctccttaaacagcggtcgtggtcgccggatctttatcgcgacgaagcgtggcttcgtcgtaaaggaaactggaaaaaccggagaaatagaagtgaaagcgtcacggatgaagacgtggatgaacttaaagcttgcattgaattgggatttggatttgaatcttcgccggaagttgaaaccgatcgtcgtcttgttgatactttaccagctctcggcctttaccatgccgttaatagaagttacaatgattctattaaccctaaatccgccgccgtaactactccgtcttcttccgctgcttccga

SEQ ID NO: 1362 - DNA, 310 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttag

SEQ ID NO: 1363 - DNA, 435 bp, Cicer arietinum
cgaccaaagaagtcaccggaaatggcaggggtttcgctccagtgcggcgattgtggtgctctgttgaaatcggtagaagaagctcaagaacacgctgagctcacctcacactccaacttctccgaatccaccgaacccgttctcaacctcgtctgcaccacttgctccaaaccatgccgatccaaaaccgagagtgatttacacaccaagagaactgggcacactgagtttgttgataagacttccgaagcagcaaaaccaataagtttagaggttcttaagggtgattcagaatctcaagagggtggaaccactgaccaaaatgaagaaatggttgttcctgaagttgacaaaaatctgcttgaggaacttgaatcgatgggcttttcaacagcgagggcaacaagagcgcttcatttttctggtaatgctagt

SEQ ID NO: 1364 - DNA, 381 bp, Cicer arietinum
accctagctgagcatacattcctcttccttggtgctggagaagcaggaactggtatagcagagctaattgctcttgagatgtcgaagcagactaagacacctatagaagagactcgcaagaagatatggcttgtagactcaaagggtttaattgttagttcacgcgcaaattcactgcaacacttcaagaagccttgggctcatgaacatgagcctgtcggcactctcatagatgccgttaaggtaatcaagcctacagttctcattggatcatcaggagtagggaaaacatttacaaaggaagtaattgaggctatgacatcaaacaatgaaaaacctctcattttggctctttccaatccgacctcacagtctgagtgt

SEQ ID NO: 1365 - DNA, 433 bp, Cicer arietinum
actggggttggacagcatcagatgtggtctgctcaattttatagttataagagacctaggcagtggttgacttcaggtggtcttggtgctatgggatttggattacctgctgccatgggagctgctgttgctaatcctgactctgttgtggttgacatcgatggtgatggaagttttatgatgaatgttcaggagctggctacaataaaggtagagaatctccctgtaaagatattgttgctgaacaatcaacacttgggtatggttgttcagtgggaggatcggttctataaagccaatagagctcacacctatctgggagacccggctaacgagaaagaaatattccctaatatgttgaaatttgcagatgcttgtggtataccggcagctcgtgtgacaaagaaggcagaccttagagccgcaattcaga

SEQ ID NO: 1366 - DNA, 184 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagc

SEQ ID NO: 1367 - DNA, 175 bp, Cicer arietinum
gggaattcgattagctggtcgcggccgaggtgcgaggtcctccgacctccgcactaccccaactccttacccatgtccgatgattccctcccgccgtctccacctccttcctttctcttccaccgtccgccgcttcttaaacaggaattatcttctcccctccttaaacagcggt

SEQ ID NO: 1368 - DNA, 121 bp, Cicer arietinum
gtctaagagctcaacaatcacaaccaaccgaacacatacacaaagcacctacatcacctactacatcacctttcaaatattcacaatgggcggtgttatgtcttgtatccggacatgcctc

SEQ ID NO: 1369 - DNA, 417 bp, Cicer arietinum
acagagcttacctggagaccgtggagtgaggcgactacctcgtccacagagcagcgttctggccgctttggggttttctcctgcaagggttttccccaaggatgcacggttctagggttgcagctactagcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 1370 - DNA, 429 bp, Cicer arietinum
acagagcttacctggagaccgaggagtgaggcgactacctcgtccacagagcagcgttctggccgctttgggggtttctcctgcaaaggttttccccaaggatgcacggttctagggttgcagctactagcgatctttggggatcatggacttcctgcctcagggtatggaaagctacttgatctatctgtgcaagagaattctaggctggagaggaatagttcccgctgacgggaagacctcttgaaagtaaatgcgcctttgtgccgatgatatgctggatgaactacatgggagacgctgctggagggaagctctgctaagatcagctgtattgatgtccaatgggacgtgcttcaccgacaactactgtagggcgagctacgagtagagaggtgcctcttgggggtaatgagtacctcggccgcg

SEQ ID NO: 1371 - DNA, 364 bp, Cicer arietinum
acggatgttaaaccttctgaaattgctaaacaaggttttgaagaggccaaaaagaagaaaattgatgtggttattgttgacactgctggtaggctgctgatagacaaaggaatgatggacgagttaaaagaagtgaagcgtgtattgaatccaatagaagtcttgttagttgtggatgctatgacagggcaagaagcagcagctttggtgactacattcaatcttgagattggaataactggtgccatattgacaaagctagatggtgtattcaagaggtggagcggctttgagtgtcaaagaggtatctggaaagccaattaagttggtaggtcggggggaacgtatggaagatcttgaacct

SEQ ID NO: 1372 - DNA, 433 bp, Cicer arietinum
tctttctctcgcgctctcacttaaccaaaaaccacgagaagaggaacaagatgcagatcttcgtcaagactttgaccggaaagactatcactctcgaggttgagagtagcgacaccatcgataacgtcaaggccaagatccaggacaaggaaggtatccctcctgaccagcagaggttgatttttgctggtaagcagctggaagatggtcgcactcttgcagattataacatacaaaaggaatcaacacttcacttggtgttgaggctcagaggaggaaccatgattaaagtgaagactctaactggaaaagaaattgaaattgacattgagccaaccgatacaattgatcgtatcaaggaacgcgttgaagaaaaagagggaattccacctgtgcagcagaggctcatatatgctggtaagcagcttgctga

SEQ ID NO: 1373 - DNA, 352 bp, Cicer arietinum
acctgagatgggaggtgaatctgccggaacctcagcttctcgtccaggcaatggttcaactgctggtcctgaacgcgctcagggggccgtagagggtcaaaagaagagagggagaagcccagctgacaaagaaagcaaacggcttaagaggctactgaggaacagagtttcagctcagcaagcaagggagaggaaaaaggcatacttgagtgacttggaatcaaaagtcaatgacttagagaagaagaattcagagcttaaagaaaagctttcaactttgcagaatgagaatcaaatgctgagacaaatattgaagaacacaacagcaagtaggagagggaacaacagtggt

SEQ ID NO: 1374 - DNA, 364 bp, Cicer arietinum
  misc_feature (348)..(348): n is a, c, g, or t
attcgatatattcagttggaagaatgaagagtgtgtggggtgaagattgtatggagtttaaaccggagaggtggttatcggttcagggagaccggttcgaaccgcctaaagatgggtataagtttgttgcgtttaatgctggaccgaggacttgtttggggaaggatttggcttaccttcagatgaagtctgttgctgcggctgtgttgattcgttaccggatttcaccggttcccggtcaccgggttcagcagaagatgtctctcacacttttcatgaagtatggtctacgtgtgttcttgcatccacgtcagcttcagcaacccaagtaggatgtgtttgggtggntgtgtatttcactgat

SEQ ID NO: 1375 - DNA, 412 bp, Cicer arietinum
actaggttgaattactattgcgacactgccatcagtagggtaaaactaacctgtctcacgacggtctaagcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaa

SEQ ID NO: 1376 - DNA, 427 bp, Cicer arietinum
acaaaatctcagccttgtctaagagctcaacaatcacaaccaaccgaacacatacacaaagcacctacatcacctactacatcacctttcaaatattcacaatgggcggtgttatgtcttgtatccggtcatgcctccagaccattggggacgtgatcatggcaatcataggaggaatcggccggattatcacagcaatcgtcaatggcattgtagctttctgctcgattctggtccgcttccttacctgcggctattgcggttcgaagggaggccgagcgaagcgccgaggacactctcacatgaggacgacgagagtttagacgatgaactacacgggcgaacttcttttgtgataccaatttgagaaaggataggggaaggggggagagctttgttagtttgcggaggagtttgctacggccgt

SEQ ID NO: 1377 - DNA, 203 bp, Cicer arietinum
aacaatcacaaccaaccgaacacatacacaaagcacctaacatccccctactaactccctcttccaaatattcacaatgggcggtgttatgtcttgtatccggtcatgcctccagaccattggggacgtgatcatggcaatcataggaggaatcggccggattatcacagcatacgccaagggaacgaagccgcccgcccaaa

SEQ ID NO: 1378 - DNA, 150 bp, Cicer arietinum
acagagcttacctggagaccgtggagtgaggcgactacctcgtccacagagcagcgttctggccgctttggggttttctcctgcaagggttttccccaaggatgcacggttctagggttgcagctactagcgatctttggggatcatgga

SEQ ID NO: 1379 - DNA, 429 bp, Cicer arietinum
cggggggccaaaggccccgaaaagtctcctactggagcacaggacgtgctgagctaaactatctacaattgctgtcgcgctggactcctcctagaatacccgccatgtccactcgcatcaacggagagcctctcgagctccttcccccgagggcaccttcctactcgtagccagccctacggtaggttcaagcacatcatcttggatgtcaaagcaggtgattcaggacatatccccatgcaactgcgattttgtctaactcatccagcatatcatcggcacgaaggcgcattactttcaagaggtcatcccgtcagcgggaactattcctctccagcctagaattctcttgcacagatagatcaagtagctttccatgcccaaaggcaggagaaccataacccctaagatcgccagtagctgcaaccc

SEQ ID NO: 1380 - DNA, 346 bp, Cicer arietinum
atgttatgttatgtgtatttttcgtctgggtggctgtaacgaagccaaatctcctactggagcaaaagacgtgctgagctagctaggtacaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgacctcggccgcg

SEQ ID NO: 1381 - DNA, 433 bp, Cicer arietinum
cggggggccaaaggccccgaaaagtctcctactggagcacaggacgtgctgagctaaactatctacaattgctgtcgcgctggactcctcctagaatacccgccatgtccactcgcatcaacggagagcctctcgagctccttcccccgagggcaccttcctactcgtagccagccctacggtaggttcaagcacatcatcttggatgtcaaagcaggtgattcaggacatatccccatgcaactgcgattttgtctagttcatccagcatatcatcggcacgaaggcgcattactttcaagaggtcatcccgtcagcgggaactattcctctccagcctagaattctcttgcacagatagatcaagtagctttccatgcccaaaggcaggagaaccataacccctaagatcgccagtagctgcaaccctaga

SEQ ID NO: 1382 - DNA, 412 bp, Cicer arietinum
acagaatcaaaaaggggaatccctctatacccaattgataaaaaatgaatgatctaatgacaaaatcattcaccagctacgtagatctaaaaaaagcagctatgaaagatgaagttgatttagaagctggtattccaaaagaaggtgttaatgttgaattaacatcttcaataacccatttggaaaccgatatgaatttgttcttagaagaggcagagaaagtaagaacagaaatgggtcaaattcgcgatatcctaacaaagcttgaacaatcaaatgaagagagcaagtcacttcacaaaacggaagctttgaaatcattgagggaaagaattaacactgatattgtaactgttttgaagaaagcaaggtgtatgaggactcaattggaagaaatggatcgtgctaatga

SEQ ID NO: 1383 - DNA, 392 bp, Cicer arietinum
acagaacttcctcaacacgtgaaaccgatgctttcattcgattacctcaagaaatcaattcagagaggtttagataattacagcgaaaagtatatcgaaacaagttcgattcaacctcttctccatgtctgttatggtggaatgatcttctcttaccttgttgctcttcctaatgagcgtcgtcatctcgctcacaaagagcacgccgaatctcatcactgattcaggatcctgattgttgaattggagatggttggcttgcttgatctttttgttttaaaatttgaaaaatcaaggcagaaagatactgtcagcttcaatgtgtttcatcgtttagatgataaaataatatctatttgatacaataaactcgaattttttgcactttaaat

SEQ ID NO: 1384 - DNA, 381 bp, Cicer arietinum
tgtagaactttttggcaggaaggatctcagtaacaatcttcctgtttaacttcttttgttgttgttctaacgattctcgggccgctttctcttgttcaggggtataatagtatattcctgaccggtattgtgttcccacatcattcccctgtcggttcagtgtggttggatcatgtctaacccagaacgcatcaagcaatgtctcatagctacattctttaggatcatactggaccctgacaacctctgagtgtcctgtggtccctgaacagatactctcgtagctcggattatgcaaaagtccctggctataacctacctcggtcttggtcaccccagctaccctctggaaggccagctcaacactccaaaagcagccag

SEQ ID NO: 1385 - DNA, 301 bp, Cicer arietinum
cattttattcctctcttcctccttcttcttcgatttcttcaatcttctcaatttcgttcttccactagactttggtttggtagcacaacaaaggcaacagggaacatggattcatccattgctcaaggaccagatgatgacagaccagcactaggtcaacagtttgcccagtttggcgctggctgcttttggagtgttgagctggccttccatagggtagctggggtgaccaagaccgaggtaggttatagccagggacttttgcataatccgagctacgagagtatctgttcagggacca

SEQ ID NO: 1386 - DNA, 430 bp, Cicer arietinum
cattttattcctctcttcctccttcttcttcgatttcttcaatcttctcaatttcgttcttccactagactttggtttggtagcacaacaaaggcaacagggaacatggattcatccattgctcaaggaccagatgatgacagaccagcactaggtcaacagtttgcccagtttggcgctggctgcttttggagtgttgagctggccttccagagggtagctggggtgaccaagaccgaggtaggttatagccagggacttttgcataatccgagctacgagagtatctgttcagggaccacaggacactcagaggttgtcagggtccagtatgatcctaaagaatgtagctatgagacattgcttgatgcgttctgggttagacatgatccaaccacactgaaccgacaggggaatgatgtgggaacac

SEQ ID NO: 1387 - DNA, 346 bp, Cicer arietinum; identical to SEQ ID NO: 1380

SEQ ID NO: 1388 - DNA, 436 bp, Cicer arietinum
acagaatcaaaaaggggaatccctctatacccaattgataaaaaatgaatgatctaatgacaaaatcattcaccagctacgtagatctaaaaaaagcagctatgaaagatgaagttgatttagaagctggtattccaaaagaaggtgttaatgttgaattaacatcttcaataacccatttggaaaccgatatgaatttgttcttagaagaggcagagaaagtaagaacagaaatgggtcaaattcgcgatatcctaacaaagcttgaacaatcaaatgaagagagcaagtcacttcacaaaacggaagctttgaaatcattgagggaaagaattaacactgatattgtaactgttttgaagaaagcaaggtgtatgaggactcaattggaagaaatggatcgtgctaatgatgctaatagaagactctctggact

SEQ ID NO: 1389 - DNA, 384 bp, Cicer arietinum
acagaacttcctcaacacgtgaaaccgatgctttcattcgattacctcaagaaatcaattcagagaggtttagataattacagcgaaaagtatatcgaaacaagttcgattcaacctcttctccatgtctgttatggtggaatgatcttctcttaccttgttgctcttcctaatgagcgtcgtcatctcgctcacaaagagcacgccgaatctcatcactgattcaggatcctgattgttgaattggagatggttggcttgcttgatctttttgttttaaaatttgaaaaatcaaggcagaaagatactgtcagcttcaatgtgtttcatcgtttagatgataaaataatatctatttgatacaataaactcgaattttttgca

SEQ ID NO: 1390 - DNA, 292 bp, Cicer arietinum
ctctgcctcactacaacatgctccggagccatgtaaagaagaagttatccattctgagctctccttcacctcctcccgaccttccagttcctgcaaatgagaaattggttgcttgggttggtgatgagattgtgacacgtgagagtgctaaggtttctgtgtttgactcagttgtccaaggaggtgactcagtttgggagggtcttcgagtgtatgataaaaagatatttaaacttgaggagcatctagataggatgtttgattcagctaaagcattggcttttgaaaatgt

SEQ ID NO: 1391 - DNA, 433 bp, Cicer arietinum; identical to SEQ ID NO: 1372

SEQ ID NO: 1392 - DNA, 448 bp, Cicer arietinum
acaggataccccgcttccttcaccatccagcataccaaggcacaagaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgacctgcccgggcggccgcccgggcaggtactaacatcagtatctgtaataaccaaagtaatttgtcatgatgtttgtgattgtgaaacaattaatgaatgatgtgcagagggagaaaccaagtttgtgttgcacaaagtggacg

SEQ ID NO: 1393 - DNA, 431 bp, Cicer arietinum
taccatgttggtgatattctccgagtaactgggtttcataactctgctcctcagtttcactttgtgcgtcgaaagaacgtgttgcttagtattgactctgataaaacagacgagtcagagctacagagagctatggaaaatgcttcaaagttgcttgtggagttcaacacgagtgtggtcgaatacacgagctatgcagacacaaagacaataccaggtcactatgtgatatattgggagttgttgaccaaggacatttcaaactcaccgagtaacgaggtgcttaatcaatgttgtctggaaatggaggaatcattgaactcggtttataggcagtgtagggtcgctgaccattcgattggaccactagaaataagggttgtgaagaaaggaacttttgaggagcttatggattatgcaatctcaagagg

SEQ ID NO: 1394 - DNA, 349 bp, Cicer arietinum
acaaattgttggtgatgatctcttagttaccaaccccaagagggttcagaaggcaattgattcaaaagcatgcaatgctcttctgctcaaggtcaaccaaattggatctgtgactgagagtatcgaagccgtgaggatgtccaaaaaggctggatggggtgtcatgaccagccaccgaagtggagagactgaggataccttcattgctgatcttgctgctggtttggcaacgggccaaattaagacaggagctccatgcaggtcagagcgtctcgctaagtataaccagctcttgagaattgaggaggagcttggtgctgaagcaatgtatgctggaacaaacttccgc

SEQ ID NO: 1395 - DNA, 349 bp, Cicer arietinum
acaaattgttgccgatgatctcttagttaccaaccccaagagggttcagaaggcaattgattcaaaagcatgcaatgctcttctgctcaaggtcaaccaaattggatctgtgactgagagtatcgaagccgtgaggatgtccaaaaaggctggatggggtgtcatgaccagccaccgaagtggagagactgaggataccttcattgctgatcttgctgctggtttggcaacgggccaaattaagacaggagctccatgcaggtcagagcgtctcgctaagtataaccagctcttgagaattgaggaggagcttggtgctgaagcagtgtatgctggaacaaacttccgc

SEQ ID NO: 1396 - DNA, 338 bp, Cicer arietinum
atgttatgttatgtgtatttttcgtctgggtggctgtaacgaagccaaatctcctactggagcaaaagacgtgctgagctagctaggtacaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcaaaggccggcggtgacct

SEQ ID NO: 1397 - DNA, 434 bp, Cicer arietinum
gggaagctcttctcattcgttttcgccgcttccctgttctttctcttcgctataacagactcctttgcggactataaagactagtcaaaatggtgaagttcacagctgatgagttacgtcgcattatggactataagcacagcattcgtaatatgtctgtcattgctcatgttgaccacggaaaatcaacattgacagattcccttgttgctgctgctggaattattgcacaagaggttgctggtgatgtccggatgacagatacccgtgcagatgaggctgagcgtggtatcactattaagtctactggtatctctctatactatgaaatgtctgatgagtctctcaagagttacaagggggaacgtaatgggaatgagtatctcattaatctcattgattcacctggacacgttgacttctcatctgaggtt

SEQ ID NO: 1398 - DNA, 216 bp, Cicer arietinum
gatttgccaatcgattatcgcgtgtcttgtttttcttgaatctcgaaactacataagccaatcgatttaccaatcgattctttaaacaaactctttttagtgattatgttaagacttatatgcatcgatttcgtaatcgattgcaggtgttatgttcaaagtaaaaatcacaccaatcgatttcgtaatcgatttattacgtctcataatcgatta

SEQ ID NO: 1399 - DNA, 435 bp, Cicer arietinum
cgggaccccaagccgtggaactttgaagatataaagaaccatgttgagaaatctgaccagggcgatgtagtcctcatcgacgtccgagaaccagtcgagcttttcgagacgggcaagatccccggtgcgatcaatattcctatcacatcggcagctcagagcctccacatctccgacgaggattttgaggacatgtatggcttccagagaccggcaaagaacaaagagcttgtgttttattgcaaagcaggagtgcgtgcaagggcggctgcgcaactggctcatcatgctggctggaacaagatcggcgactatgcaggcagctggctggactgggaagctcagaaaggaccagttgagaaggttaagaaaccatattgaacagacagagcttgatgaagacatccattggcagaatggttggtcaaataaaag

SEQ ID NO: 1400 - DNA, 145 bp, Cicer arietinum
acatgcggcccttgataataccggaatcggttgggtgaatgtcgttgtgtcggagagtgggtggccgtcggatggagggtcggctacttcgtatgataacgcgcgtatttatcttgataatttgattcgtcatgttggtaaaggt

SEQ ID NO: 1401 - DNA, 410 bp, Cicer arietinum
agaatatggacaccttggagaaaaaaggtttcacagaagagcaagaagctctggtagttaagtcatggacagcaatgaagaagaatactgcagagcttagtctcaaatttttcttgaaaatatttgaaattgctccatcagctcagaaactgttctcattcttgaaagattcaaaagttcctttggaccaaaatcccaagctcaagccacatgccatgtctgtctttctcatgacatgtgaatcagcaatccaactgcggaaggctggtaaagtaactgtgagagaatcaaacttgaaaaaacttggtgctacccattttaaaaacggtgtagtagacgagcattttgaggtaacaaagtttgcacttttggggacaataaaagaagcagtacctgcccgggcgggccgc

SEQ ID NO: 1402 - DNA, 355 bp, Cicer arietinum
tcaatggccactatcgccggtcaacatgttcgtgctcccccgttgacttcaacttccgaacaaccacctcttttcgatggaaccaccaggttgtataccagttatagttgcccttttgcacaacgtgtatggatcactaggaactacaaggggttacaagagaagatcaaattggttcctattgaccttcaaaacaggcctgcttggtataaggaaaaagtatatcctgaaaataaggtgccatctttggagcacaatggcaaggtattgggggaaagtcttgatttgatcaaatatgttgatgctaactttgaagggactcctcttcttcccaatgatctggccaggaaggagt

SEQ ID NO: 1403 - DNA, 310 bp, Cicer arietinum; identical to SEQ ID NO: 1362

SEQ ID NO: 1404 - DNA, 278 bp, Cicer arietinum
acagagcttacctggagaccgtggagtgaggcgactacctcgtccacagagcagcgttctggccgctttggggttttctcctgcaagggttttccccaaggatgcacggttctagggttgcagctactagcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgc

SEQ ID NO: 1405 - DNA, 244 bp, Cicer arietinum
accctgatgtcaaccacgctactgttaaaaccacttctgcggaaaagcctgtccgtgaactcatagctgatgatgcgtggttgaatgcggaattcataactaccgtccaacaactaggtgctgcaattattaaagctagaaagctttcaagtgcattatctgccgctagcgctgcttgtgaccacattagagattgggttcttggaactcctgatggaacctgggtatccatgggagtttattc

SEQ ID NO: 1406 - DNA, 432 bp, Cicer arietinum
acggatgttaaaccttctgaaattgctaaacaaggttttgaagaggccaaaaagaagaaaattgatgtggttattgttgacactgctggtaggctgcagatagacaaaggaatgatggacgagttaaaagaagtgaagcgtgtattgaatccaatagaagtcttgttagttgtggatgctatgacagggcaagaagcagcagctttggtgactacattcaatcttgagattggaataactggtgccatattgacaaagctagatggtgattcaagaggtggagcggctttgagtgtcaaagaggtatctggaaagccaattaagttggtaggtcggggggaacgtatggaagatcttgaacctttttaccccgatcgaatggcaggacgcatactaggaatgggagatgttctctcatttgtggagaaggca

SEQ ID NO: 1407 - DNA, 437 bp, Cicer arietinum
ctttagggctaaatctcgtaagaatagtgtcgaatctgaatctgatcagagtcatagtagtccgaaaccgaactcacaagagaagcctgttttggattggaacatggggtatagaattgcacttggtgtggcaaggtctattgcatatctacatgaggagtgtttggaatgggttttgcattgcgatattaagccggagaatattctcttaggcgacgattgttgccctaagatatcggattttggattggcgaaactaaggaaaaaagaagacatgatgactatatcaagaaggaggggaactcccggttatatggcacctgaatggataacggccgatccaataacctccaaagccgatgtctatagctttggcatggtgctattggagcttgtgagtggagtgaggaactttgagattcaaggttctttggtga

SEQ ID NO: 1408 - DNA, 435 bp, Cicer arietinum
attctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgac

SEQ ID NO: 1409 - DNA, 434 bp, Cicer arietinum
acaggataccccgcttccttcaccatccagcataccaaggcacaaaaggcgctgtattttctcgagcccgtcacccgtcagcgggttcgggggcatactgtcgacttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccaaaattccttctctgaaaactgctg

SEQ ID NO: 1410 - DNA, 410 bp, Cicer arietinum
cttcttcgatttcttcaatcttctcaatttcgttcttccactagactttggtttggtagcacaacaaaggcaacagggaacatggattcatccattgctcaaggaccagatgatgacagaccagcactaggtcaacagtttgcccagtttggcgctggctgcttttggagtgttgagctggccttccagagggtagctggggtgaccaagaccgaggtaggttatagccagggacttttgcataatccgagctacgagagtatctgttcagggaccacaggacactcagaggttgtcagggtccagtatgatcctaaagaatgtagctatgagacattgcttgatgcgttctgggttagacatgatccaaccacactgaaccgacaggggaatgatgtgggaacacaata

SEQ ID NO: 1411 - DNA, 254 bp, Cicer arietinum
acagagcttacctggagaccgtggagtgaggctgactacctcgtccacagagcagcgttctggccgctttggggttttctcctgcaagggttttccccaaggatgcacggttctagggttgcagctactagcgatctttggggatcatggacttcctgcctcagggtatggaaagctacttgatctatctgtgcaaaagaattctaggctggagaggaatagttcccgctgacgggatgacctcttgaaagtaa

SEQ ID NO: 1412 - DNA, 414 bp, Cicer arietinum
acagagcttacctggagaccgtggagtgaggcgactacctcgtccacagagcagcgttctggccgctttggggttttctcctgcaagggttttccccaaggatgcacggttctagggttgcagctactagcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactacatgggagacgctgctggagggaagctctgctaagatcagctgtattgatgtccaatgggacgtgcttcaccgacaactactgtacggcgagctacgagtagagaggtgcctcttgggggtaatg

SEQ ID NO: 1413 - DNA, 434 bp, Cicer arietinum
acaacctctacaccaagatcacaggtggtcagcgtatcgacttgtttggtgcccagaagcaggaccttctcgacatctggggccagcttgttgctggtggtatggagtccggtcatgcttatgccaagtctctgcgaaccgtcaagagttgcgttggttctacatggtgtcgattcggtctgagtgacagtgttggtatggccgttcgtctggaggagcgatacaagagtattcgagctcctcataagatcaagggtggtgtgagtggttgtgtgcgagagtgtgctgaagctcaaggcaaagatttcggtttgattgccactgagaagggctggaacatcttcgttggcggtaacggtggtgcgaaccctcgccatgccgagcttctagccaaggatgtgcccccagctgatgtcgtgacaatccttgaccga

SEQ ID NO: 1414 - DNA, 433 bp, Cicer arietinum
ttttttttagagaaagtttactgaacctattcgaagactaattatgcatatatatataaccaacttcatagatggacaagacagaacagcaaataattactcagagtccacttctaaggacaccttccgagctaggtcgtaagataatttcaataacgtctttatgcccgtcatggtcgcttgtctgggcgtagaatttttgagctttggcatagtcctccgggtcgttgagcttgtagctcaatgcatcttcttcaatgctccgaagtactgtcatattggtcgtgcccccgacgatgccgtcgtgtacatctcctgcaatatgataccgtgcccatacggcatcgccgtatctgccatcgcgaactgcactgacatactgactagcccatggctcgactactgggatccaggaggtgttggtgaggacttc

SEQ ID NO: 1415 - DNA, 435 bp, Cicer arietinum
ctttaacaaactcaacaaacaaccataacaatttcatttcctttacttcaaaaaaaaaaaaaaacgataaacgctaaacgcaaacgcacttaatcactatgcaaaccgtttcggtttcacctcgcagcgaggtttctggaaagttcgaaaatgatttttttgaaaaacttaaaatcgaagatgaaaatgtagaaaacgaagttaagcacgatgaggtagaagaggaatacgacgaagaagaagagtttaccttcgttttcgcagatcctaatggctcgccgatttccgctgacgatgtgttcgatcacggtcagatacgtccgatttttcctattttcggtcaggatctaatgttcaccgacgagtatgacagcgaatctggtaaccgctcgccagtgaagaagatcttcgttgaatcgccgtcaaaggcgacga

SEQ ID NO: 1416 - DNA, 433 bp, Cicer arietinum
actttcaggtggtggagatgcttcttgaccacctcgagctggccgttcaaggggtgataatcgaagagaatgacgaccatatcatggaagaggttcacctgttcgatgacatggatgcgaagacccggaagcttttgaagatttacatcaagttcggatggaagaagctgaatgactattatggcaagctgacctctaccgcctacgtagcggcagttgtattccacccgtgtaagaaatggcgaactctagagcagctttggaaccagctgccgtctcgtcagacgtcagaatggaggaagacctatgaaggaaacttaacgagagtctgggaagagaagtacaaggacatggctcatgaggtggcctgcaatgccgtttcagcatctgagagcaatagtgccttggactatattgagcgccgattagcatt

SEQ ID NO: 1417 - DNA, 324 bp, Cicer arietinum
actatgatgaagcccttgtgtcacaggagaggcaagaactcggccgcgagctaagaagtgagctcttgacagctgaaaagtttgtgctggtgattagtggacatgagaaacttcagcagaataataggagcttgaggaggttggttgagaatagacttccatttctcaatcctatgaacctgttgcaggtggagatactgaagaggttaaggcgtgatgatgacaaccttaaactcagggatgctttgcttattactgtgaatggtattgctgctgggatgaggaataccggttgaagttgcttctcaacaactacaataatgt

SEQ ID NO: 1418 - DNA, 262 bp, Cicer arietinum
acagagcttacctggagaccgtggaatgaggcgactacctcgtccacagagcagcgttctagccgccttggggttttctcctgcaagggttttccccaacgatgcacggttctaggttgcggctactggcgatcttaggggatcatggacttcctgcctttgggcatggaaagctacttgatctatctgtgcaagagaattctaggctggagaggaatagttcccgctgacgggatgacctcttgaaagtaaagcgcctttg

SEQ ID NO: 1419 - DNA, 436 bp, Cicer arietinum; identical to SEQ ID NO: 1388

SEQ ID NO: 1420 - DNA, 145 bp, Cicer arietinum; identical to SEQ ID NO: 1400

SEQ ID NO: 1421 - DNA, 145 bp, Cicer arietinum; identical to SEQ ID NO: 1400

SEQ ID NO: 1422 - DNA, 433 bp, Cicer arietinum
acttgctccagcggcttgcatcttatctgggattgctctttctcaagcatttgatgttttcactagatcaattaagcttcagctacccagtctatcagttgattcccatgttgatgctggaaatgccagttccgaaagtgttgtgccaaatgatacggtgaagactgataaaatcgaggacacacctaaggagcggacctcatattaagagcaagaagaaggaaaaggaacctgtggaaaagcctcctagcaagtcacaaattaagaaaaagcttttggttttacctttggaaacatccatcattgctattatcttacttgtgttgctgggtgccttctatgtggttcacagtgtatgggcagcagcagaagcctattcagccccttctatcgttctaacatcacattcaaatgatggactacatgtttttga

SEQ ID NO: 1423 - DNA, 288 bp, Cicer arietinum
gcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccct

SEQ ID NO: 1424 - DNA, 434 bp, Cicer arietinum
acttgctccagcggcttgcatcttatctgggattgctctttctcaagcatttgatgttttcactagatcaattaagcttcagctacccagtctatcagttgattcccatgttgatgctggaaatgccagttccgaaagtgttgtgccaaatgatacggtgaagactgataaaatcgaggacacacctaaggagcggacctcaaagaagagcaagaagaaggaaaaggaacctgtggaaaagcctcctagcaagtcacaaattaagaaaaagcttttggttttacctttggaaacatccatcattgctattatcttacttgtgttgctgggtgccttctatgtggttcacagtgtatgggcagcagcagaagcctattcagccccttctatcgttctaacatcacattcaaatgatggactacatgtttttgatg

SEQ ID NO: 1425 - DNA, 355 bp, Cicer arietinum
acctctgctgctggattagcacttgaagcactagccggagtgatctcattagcatcttctgaaattgatcagtctagggtaaatacggtgaaaagtgatatactgaagctttttgacagcatccagaaatatgacgatggaacattttattttgatgagaaatttggtggtggtcgcgagcatcagggttctcttaccacaacttcttcagttattcgaggggttacatcatttgctgctgtaacttctggaaaaatcgatcttccaggggataaaatattgggtctagcaaacttttttctagccattgcagtcccacgaagtgccaaggacttcttcaatcaagttgaatcat

SEQ ID NO: 1426 - DNA, 305 bp, Cicer arietinum
acactacaaagaaacagactaatgcaaaaacaataacatggacaatatggtttgaaccactttggatgatgctcttgttcaatcttcttaaattattcttcactccagcttgagcctttatcattgtcgtttgcagctgttccagaaaatctttctgatacttcatttctgtcccaatctcctcagcaacatttctcaaccttctaacttggcgatgaagaccagttaattcatcatccaagtccattggatcaatacgcaattggatctcttcggaagcagcaccgggtcgggtacctgcccgg

SEQ ID NO: 1427 - DNA, 326 bp, Cicer arietinum
tcagagcagaggtgagcatccggtcgcgcgagaatagactgactgagtattcatccatccatccggtggatagtgattgtaattctgatggcggctgcttcattcaatgttacaacaacaccgcttttttcactgtcatcaaatgtcgcagaagcaagaattagagctctgaaccctaaccctaacagtatcgccatcggcgtgaggggatttggcggcggtgtgaaacttcaacaacagaattggaatgttaatgctgctgcgagagtgaggaaaacaatgaaagtgagggcgggcagtagctcatcagaggaagaagtaatagt

SEQ ID NO: 1428 - DNA, 261 bp, Cicer arietinum
acttaaaattggcgaagaagcatggcctgaagatttcacagccgggtttagaacctaataaaggtttgacatggcaaatgacaaaaagaagaggagataaagaagttcacaaagtgacggaggagaaaccaggatggtgttctgaccctcatttacctccttgtgccgcgtttgttgagattatggctccagtcttctcacgagaagcttggcgctgtgtgtggcatatgattcagaatgacttggtccatgggtggggtc

SEQ ID NO: 1429 - DNA, 425 bp, Cicer arietinum
gcttttggagcagcatgagaaattaaggggtaaggttgttttggttcagattttgaatccagctaggagcagagggaaagatattcaagacgtgaagagtgagattgaagctattgctaaagagattaatggtaaatatggtgatgataaagataactacaagccaattgtttgtataaagggtccggtttcgactcaggagaaggttgcatactatgcgatatcggaatgttgtattgtgaatgctgtgagggatggaatgaatttgatgccttatgagtatactgtttgtagacaaggaagtgttgaattggataaagcacttggattggaaaaagatgaggctaaaaagagtgttatcattgtttctgagttcattggttgttcgccttcgctcagcggtgcgattcgtgtgaatccttgga

SEQ ID NO: 1430 - DNA, 422 bp, Cicer arietinum
gcttttggagcaccatgagaaattaaggggtaaggttgttttggttcagattttgaatccagctaggagcagagggaaagatattcaagacgtgaagagtgagattgaagctattgctaaagagattaatggtaaatatggtgatgataaagataactacaagccaattgtttgtataaagggtccggtttcgactcaggagaaggttgcatactatgcgatatcggaatgttgtattgtgaatgctgtgagggatggaatgaatttgatgccttatgagtatactgtttgtagacaaggaagtgttgaattggataaagcacttggattggaaaaagatgaggctaaaaagagtgttatcattgtttctgagttcattggttgttcgccttcgctcagcggtgcgattcgtgtgaatcctt

SEQ ID NO: 1431 - DNA, 462 bp, Cicer arietinum
  misc_feature (21)..(21): n is a, c, g, or t
gattagcgtgggtcgcggccngaggtacaaaacggaaatctgaataaagatgtattaggaaaaggaaattgagtgaagtgatagaagagaccttcatgaaaattaatggaaaactctgtctaatccatcacaaccacaaccattacacaataaaccctacttcgaataaagctttaatcaatttgagatatcgacgtgaagattatgggttgggatgcaatgataagaatccaatgcagaaagaaaaaccaccctgcagcgaggatgatggcagcgttgatggagcttgaccttgaagtgcaccatgccagtgtgacagtggggaatgatttgatgatacgacaagcaacagtgaagatggggggtcgattttacacccaggagcagcttagggcagcattgtcatccaaagttgggggtgtttcatgagtctgcaaatttgctgcaatgagaaattgggaa

SEQ ID NO: 1432 - DNA, 432 bp, Cicer arietinum
accaccatcaaatggaggttgtggtttcatcattcgaacaagttgcagggattggttccgcaaggacatacactgcccttgcactacaaacaatctccaagcaatttaggtgtttgaaagatgccatagctggacaaattcgtgctacaaataagagtttgggagaagatgattgctttggagttaaaattgaaggttcaaggcttaaatatgtagatcatcaattacgtcaacaacgtgctcttcaacagttgggaatgatccagcataatgcttggagaccccaaagaggattgcctgaaagatctgtttctgttcttcgcgcttggctctttgaacacttccttcacccttatcccaaggattcagataagctcatgcttgcaaaacaaacaggacttactaggagtcaggtttcaaattggtttataa

SEQ ID NO: 1433 - DNA, 428 bp, Cicer arietinum
accaccatcaaatggaggttgtggtttcatcattcgaacaagttgcagggattggttccgcaaggacatacactgcccttgcactacaaacaatctccaagcaatttaggtgtttgaaagatgccatagctggacaaattcgtgctacaaataagagtttgggagaagatgattgctttggagttaaaattgaaggttcaaggcttaaatatgtagatcatcaattacgtcaacaacgtgctcttcaacagttgggaatgatccagcataatgcttggagaccccaaagaggattgcctgaaagatctgtttctgttcttcgcgcttggctctttgaacacttccttcacccttatcccaaggattcagataagctcatgcttgcaaaacaaacaggacttactaggagtcaggtttcaaattggttt

SEQ ID NO: 1434 - DNA, 427 bp, Cicer arietinum
acaatgggacatattgctccagagtatttgtccactggaaaatcttctgagaagacagatgtttttggatatggcattacacttcttgaactaatcaccggtcaacgtgccattgatctctctcgtctcgaagaggaggaggatgttcttctcattgatcatgtaaaaaatctactaagagacaataggctagaggacatagtggataacaatttggagacatatgatcccaaagaagctgagacaattcttcaagttgcattactttgcacacaagggtatccggaggatcgaccgaccatgtccgaggttgtaaaaatgttgcagggagtagggttggcagatagatgggctgattggaaacaacttgaagaagctagaaataaagaaattgaattatcactcatgactcatcaatttccttgga

SEQ ID NO: 1435 - DNA, 426 bp, Cicer arietinum
acaatgggacatattgctccagagtatttgtccactggaaaatcttctgagaagacagatgtttttggatatggcattacacttcttgaactaatcaccggtcaacgtgccattgatctctctcgtctcgaagaggaggaggatgttcttctcattgatcatgtaaaaaatctactaagagacaataggctagaggacatagtggataacaatttggagacatatgatcccaaagaagctgagacaattcttcaagttgcattactttgcacacaagggtatccggaggatcgaccgaccatgtccgaggttgtaaaaatgttgcagggagtagggttggcagatagatgggctgattggaaacaacttgaagaagctagaaataaagaaattgaattatcactcatgactcatcaatttccttgg

SEQ ID NO: 1436 - DNA, 356 bp, Cicer arietinum
accttgcttcgcttgaggcttcatatctaaaccttcctgattctactttcaaggatcttcggaggaagcttccagtcacccgcaccttatttccatggcataacactttgcaatttagcttgtcaagagatatctcaaaagaacttggcattggaaagtaaatacatacacatacacaacaaattaaagttgtgtttagtcgaacctggtggcgacaagtttcctatatataaagttattcaacacatgtaactgatcaaatcaacgatcaatcattcttagggttgactttatcttcacacatttgcttcctgtagtgcacttctttgtgtgagtctctttcaccggtatactgt

SEQ ID NO: 1437 - DNA, 356 bp, Cicer arietinum
acagtataccggtgaaagagactcacacaaagaagtgcactacaggaagcaaatgtgtgaagataaagtcaaccctaagaatgattgatcgttgatttgatcagttacatgtgttgaataactttatatataggaaacttgtcgccaccaggttcgactaaacacaactttaatttgttgtgtatgtgtatgtatttactttccaatgccaagttcttttgagatatctcttgacaagctaaattgcaaagtgttatgccatggaaataaggtgcgggtgactggaagcttcctccgaagatccttgaaagtagaatcaggaaggtttagatatgaagcctcaagcgaagcaaggt

SEQ ID NO: 1438 - DNA, 429 bp, Cicer arietinum
ggattacttgatgaccctcggaataagcttgattatgtcttagctcttaccgttgagaatttccctgagcgtcgtcttcagacacttgtttttaaatctggtatggctaagtctattcatcatgctagggttctcatcagacagaggcatatcagggttggtaggcaggtggtgaacatcccctctttcatggttagggttgactcacagaagcacattgacttttcactcacaagtccccttggtggtggacgtcctggaagagtgaagagaaggaatctcaaggctgccgccaagaaagcatctggtggtgacggagatgaggaggatgaggattaaactgttgctgccattatcatagttgcattctctattgaagttaaatcttttgtcagccgttatgattttgtccctagtctatcattattg

SEQ ID NO: 1439 - DNA, 310 bp, Cicer arietinum
cggccgagccactaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacttgccagttatccctgtggtaacttttctgacacctctagcttcaaattccgaaggactaaaggatcgataggccacgctttcacggttcgtattcgtacctgcc

SEQ ID NO: 1440 - DNA, 157 bp, Cicer arietinum
acagattttccagaagtagaatgcttctccatatggtctgacgtcggctgcaagtttagattctttttcttttttttctttctctcctcaataacagaagtcttggagttcaagtcatctacaggtcgcttttggccttttatcttcttcactgcac

SEQ ID NO: 1441 - DNA, 297 bp, Cicer arietinum
acctctgctgctggattagcacttgaagcactagccggagtgatctcattagcatcttctgaaattgatcagtctagggtaaatacggtgaaaagtgatatactgaagctttttgacagcatccagaaatatgacgatggaacattttattttgatgagaagtttggtggtggtcgcgagcatcagggttctcttaccacaacttcttcagttattcgagggggtacatcatttgctgctgtaacttctggaaaaatcgatctgccaggggataaaagattgggtctagcgaacttt

SEQ ID NO: 1442 - DNA, 410 bp, Cicer arietinum
acctctgctgctggattagcacttgaagcactagccggagtgatctcattagcatcttctgaaattgatcagtctagggtaaatacggtgaaaagtgatatactgaagctttttgacagcatccagaaatatgacgatggaacattttattttgatgagaagtttggtggtggtcgcgagcatcagggttctcttaccacaacttcttcagttattcgaggggttacatcatttgctgctgtaacttctggaaaaatcgatcttccaggggataaaatattgggtctagcaaacttttttctagccattggagtcccaggaagtgccaaggacttcttcaatcaagttgaatcattagctcttctggagagcaaaagggttcccatcccattggtgctgtcacttcctga

SEQ ID NO: 1443 - DNA, 431 bp, Cicer arietinum
aaaaattctttcttggcacccactgttagtgcggtgctaggagcgggattttctacgggctatgcgactacacaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaa

SEQ ID NO: 1444 - DNA, 382 bp, Cicer arietinum
aaaaattctttcttggcacccactgttagtgcggtgctaggagcgggattttctacgggctatgcgactacacaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccgatcaacgacgccgattgcgatgggtttttcccctttgaaggcaagccgcaccgccggcctctgattccttcccaaggtttttccctgccgccacgacatacgactacgagctacaacttggttactggagattgtgga

SEQ ID NO: 1445 - DNA, 427 bp, Cicer arietinum
acagagcttacctggagaccgtggaatgaggcgactacctcgtccacagagcagcgttctggccgctttggggttttctcctgcaagggttttccccaaggatgcacggctctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctcggccg

SEQ ID NO: 1446 - DNA, 399 bp, Cicer arietinum
gtcggatctaatggcggcacctcagaaccagaacgtcttagatatcggaggacgatgccccgggcattcgtagcgacatccttccgatcaacgacgccgattgcggtgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgacaatagattgcccccgaacccgctgacgggtgacgggcttgagaaatacagcaccttttgtgccattggtatgctggatggtgaaggaagcggggtttcctgttaacctgcccgggag

SEQ ID NO: 1447 - DNA, 386 bp, Cicer arietinum
gtcggatctattgccggcacctcagaaccagaacgtcttagatatcggaggacgatgccccgggcattcgtagcgacatccttccgatcaacgacgccgattgcggtgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgacaatagattgcccccgaacccgctgacgggtgacgggcttgagaaatacagcaccttttgtgccattggtatgctggatggtgaaggaagcggggtttccctggt

SEQ ID NO: 1448 - DNA, 434 bp, Cicer arietinum
gcttcagggggcagagaaggggatgagaaatgtagaaactctaatgttgctgaaatattttctaggactagctttcctaaaggtcctttacttgatttgccaagaactattctagaccatgatcatgtaatattgcttggagatttaaattataggatttctcttccagaagaaacgacacgcttacttgttgagaaaagagactgggattctttattagaaaatgaccagctaattatggagctaatgaacggcaacattttaagaggatggcatgaaggaccaatcaattttgctcctacctacaaatattgtcctaactcagacatatactatggatgttgttgtcatggaaataagacacaaaagaaacgagcaccggcatggtgtgatcgaatagtatggtatggaaaaggtttgaagcaacatgagta

SEQ ID NO: 1449 - DNA, 427 bp, Cicer arietinum
  misc_feature (401)..(401): n is a, c, g, or t
gcttcagggggcagagaaggggatgagaaatgtagaaactctaatgttgctgaaatattttctaggactagctttcctaaaggtcctttacttgatttgccaagaactattctagaccatgatcatgtaatattgcttggagatttaaattataggatttctcttccagaagaaacgacacgcttacttgttgagaaaagagactgggattctttattagaaaatgaccagctaattatggagctaatgaacggcaacattttaagaggatggcatgaaggaccaatcaattttgctcctacctacaaatattgtcctaactcagacatatactatggatgttgttgtcatggaaataagacacaaaagaaacgagcaccggcatggtgtgatcgaatagnatggtatggaaaaggtttgaagcaac

SEQ ID NO: 1450 - DNA, 430 bp, Cicer arietinum
gcttcagggggcagagaaggggatgagaaatgtagaaactctaatgttgctgaaatattttctaggactagctttcctaaaggtcctttacttgatttgccaagaactattctagaccatgatcatgtaatattgcttggagatttaaattataggatttctcttccagaagaaacgacacgcttacttgttgagaaaagagactgggattctttattagaaaatgaccagctaattatggagctaatgaacggcaacattttaagaggatggcatgaaggaccaatcaattttgctcctacctacaaatattgtcctaactcagacatatactatggatgttgttgtcatggaaataagacacaaaagaaacgagcaccggcatggtgtgatcgaatagtatggtatggaaaaggtttgaagcaacatg

SEQ ID NO: 1451 - DNA, 313 bp, Cicer arietinum
acatcgtccctattcctatttcacacaggcccgaagccgcggtataacaaattcatcatgaaaaccccatcccgatcatggggagattaaaaaaccttggtcaagagaggatttactcaaaagggttggttcgggttccccaccaggtgaggaagacggagagaccgtgggtctcaacgagcttggtagccaggctgacgccgacggtgtcgagaggtcgcttctcaacgaagatctgagcaatgtagccgggagcagaggtagcgaagaagatgagggatccgaggtaagcagcgcccttgtagctcagcgt

SEQ ID NO: 1452 - DNA, 428 bp, Cicer arietinum
acgatatagaaatcagacctccagaagacgaatcacgtcttgtcagctggaagtctcaattggaagaggatatgaagatgattcaagttcaggataacaagaatcacatcacggaagtgcttgcagccaatgatcttgattgcgatgacttggattccatctgtgtggcagacacaatggttctcagtaactatatagaagagattattgtgtcagcattgtctcaccatttgatgaaaaacaaagatcttgaatacagaaacgggaagctaattatttcttgcaatagtttgtcgcatgcattgaatatattccaaaagaaggaaaaattctgtggaaaagatacatcaaagtcagaagatcaagctctaaagtctgagactccaagtgttggagagactgttgtgaaaccagcagtgaaggctgaa

SEQ ID NO: 1453 - DNA, 300 bp, Cicer arietinum
acagagcttacccggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcggcctttgtgccgatgatatgctggatgaactagatgggagac

SEQ ID NO: 1454 - DNA, 429 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctcggccgac

SEQ ID NO: 1455 - DNA, 430 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctcggccgacc

SEQ ID NO: 1456 - DNA, 432 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctcggccgacctc

SEQ ID NO: 1457 - DNA, 238 bp, Cicer arietinum
  misc_feature (201)..(201): n is a, c, g, or t
actatttacctgagcatgagcgtgcaaaaaaacagttctttgagtatttgcaaggtgaagcagaatctggtctagagagacttcatcaatgtgctgaaaaagaactacaacagtttctcagtgctgatggcccatctaaagaattcaatgacttccgtacaaagttagctggattgactagtgtgacaaaaaattacttcnagaacttagtgagggcactagagaatggtctatctga

SEQ ID NO: 1458 - DNA, 392 bp, Cicer arietinum
actatttacctgagcatgagcgtgcaaaaaaacagttctttgagtatttgcaaggtgaagcagaatctggtctagagagacttcatcaatgtgctgaaaaagaactacaacagtttctcagtgctgatggcccatctaaagaattcaatgacttccgtacaaagttagctggattgactagtgtgacaaaaaattacttcgagaacttagtgagggcactagagaatggtctatctgatgtggatggtaatggagctgccatcagcaaagcaacaagctcaaaaaatgctgcagggagcagcaaggggagaactgggagaggaaagggagctttccgaaccaccatgaccagcagaacgtctgatgatagtcactggtgctgtgaccattgt

SEQ ID NO: 1459 - DNA, 392 bp, Cicer arietinum; identical to SEQ ID NO: 1458

SEQ ID NO: 1460 - DNA, 353 bp, Cicer arietinum
accagatgctatttgccttaaggattctcttgatgctgtccgtaatgctacccaagctgctgatagaatacatcaagtatatagaatgcagtcatttcaaaggaaacagttagctcagtatgaagatgatgacgagtttggattgttagatcagcaagctcttttgcttctagcttctaagggaagaaaatctggacatggggagggttcagccaatgctgctgcaatacaaatacagaaaaaatttcgtggttggacaaagagaaaagaattcttgttcattcgtcaaagagttgttaaaatccaggcccttgtaagaggtcaccaggtaagaaagaagtacctgcccgggc

SEQ ID NO: 1461 - DNA, 349 bp, Cicer arietinum
ccttccaatgtgcctggaactgtgggatatatagcacctgagtatcatcagatattcaaattcagtgacaagtgtgatatatatagttttggggttatgcttggtgtattggtaatagggaagcttccttctgatgaattttttcagaatacagatgagatgagtttggttaagtggatgagaaatgtgatgacttcggaaaatcccaaggccgccttcgatgcgaggctcattggtaatagttatgaggaacaaatgcttttggttttgaagattgcttgcttttgcaccatggagaatcctaaggagaggcctgacagtaaggatgttaggtgtatgttgttccaaa

SEQ ID NO: 1462 - DNA, 239 bp, Cicer arietinum
accaatatttagcactctaagaccagagctgttcaggtttatgggtgcgagaaaaagcctatcctgaagcacgagtctgagggcgtggtgaaccaggtcgaggcgatcttgctcctgctcgtcgtttgggtagttatatgacccttggtggtagctgtggtaggttcgcccgtgtttctgctcgtatctaagtatatagctgtcgatggaggcggtcaccactgaaaactcatcgccgt

SEQ ID NO: 1463 - DNA, 430 bp, Cicer arietinum
acatgggaggatactgcaatgatatctgataatatcaccggtgttaaaagataccgagacgatgatgttaaaccattttctgcagctgaaattaagaatgaaacaggaggccagcagcctaatgctcctttggctcatcagatgagtttgccgaatactacggcggaattggcagccattgagaaatttttgcagttctctgattctgttccgtgtaaaattcgtgccaagcgcggttgtgccactcacccaagaagcattgcagaaagggtgagaagaactaaaattagtgagcgtatgaggaaactacaagatctggtgccaaacatggataagcaaacaaacacatcagatatgttggacttggctgttgagtacggatctcttgtcgttaacattggtgatattctgcagcttttaacaaatgaca

SEQ ID NO: 1464 - DNA, 427 bp, Cicer arietinum
acagagcttacctggagaccgtggaacggggcaattgcctcgtctacagagcagcgttctggccgccttgggtttttcccctgcaaggggtttccccaaggatgcatagtcctaggttgcagctactggcgatcttagaggatcatggacttcctgcctcagggtatggaaagctacttgatctatccgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagagctggctacgagtagagaggtgcctcttggggggatgagtacctcggccgcg

SEQ ID NO: 1465 - DNA, 423 bp, Cicer arietinum
ctcgcaagattgaagagctcaagccatgctcctctgctgagatatgttggtatttcacagattcctgggagcaattccggataaatggacatgtagatatcatcgatgggacgaatcctgatctgctaaaacttaagcaaagagaaaaatcctggtttgccagttccacgagatcaaggtcgcaatatttgtggccgaacccaggacttccctgtctaaatgaacaaacacaaccagaaatgtcattggatccttctataggtccagttgatgctttttgtctcctgattctagaaccagatcaggttgattacttgaatctaaagagtaaccagaggctaacattcagatcaagtttgagtgatgcatcaaagaaatgctggattatggagagggtcaacctgtgatttcttatctgtcata

SEQ ID NO: 1466 - DNA, 424 bp, Cicer arietinum
ctcgcaatattcaagagctcaagccatgctcctctgctgagatatgttggtatttcacagattcctgggagcaattccggataaatggacatgtagatatcatcgatgggacgaatcctgatctgctaaaacttaagcaaagagaaaaatcctggtttgccagttccacgagatcaaggtcgcaatatttgtggccgaacccaggacttccctgtctaaatgaacaaacacaaccagaaatgtcattggatccttctataggtccagttgatgctttttgtctcctgattctagaaccagatcaggttgattacttgaatctaaagagtaaccagaggctaacattcagatcaagtttgagtgatgcatcaaagaaatgctggattatggagagggtcaacctgtgatttcttatctgtcatat

SEQ ID NO: 1467 - DNA, 303 bp, Cicer arietinum
acgaatacgaaccgtgaaagcgtggcctatcgatcctttagtccttcggaatttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggattagaccgtcgtgagacaggttagttttaccctactgatgacagtgtcgcaatagtaattcaacctagtacctcggccg

SEQ ID NO: 1468 - DNA, 430 bp, Cicer arietinum
cgggaccccaagccgtggaactttgaagatataaagaaccatgttgagaaatctgaccagggcgatgtagtcctcatcgacgtccgagaaccagtcgagcttttcgagacgggcaagatccccggtgcgatcaatattcctatcacatcggcagctcagagcctccacatctccgacgaggattttgaggacatgtatggcttccagagaccggctaagaacaaagagcttgtgttttattgcaaagcaggagtgcgtgcaagggcggctgcgcaactggctcatcatgctggctggaacaagatcggcgactatgcaggcagctggctggactgggaagctcagaaaggaccagttgagaaggttaagaaaccatattgaacagacagagcttgatgaagacatccattggcagaatggttggtcaaat

SEQ ID NO: 1469 - DNA, 436 bp, Cicer arietinum
tggtgaaggagaagatcgccatttgattctggagagatgtctagatacagctataccttcaatccttgtcagtgatatcctatggaagtatgatgatgaacctcaatctttgattgcatcacaccaaatattaaggagaaaagaagcctctcctgtttcgcagacaaataccgcatccattcagcagacactagaggaaagaaaagcagcttatttagctgctcgtgagcggattttttctatgagtttggaagatgccaaagagccggacgaacaaaagccacgaagcgtgccagtagttgcccgccgaatgattgcgcatgcactaggtcaaagaatcaatacaaagaatccaaatgagccagttagtgatagtatcaaggaaagagggctcgccgatgaatcaaatgctaaagataagaacagcggaaaattt

SEQ ID NO: 1470 - DNA, 426 bp, Cicer arietinum
cacaataattctcacttgtttgtttcaatcatcatccatgtcgactactgctggtcaagtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaagggtcagactcctatgtttcctcgtatatttggtcatgaagctggagggattgtggagagcgtaggggagggtgtgactaatctgaaaccaggggatcatgctctgcctgtattcactggggagtgtggggaatgtccacattgtaagtctgaggaaagcaacatgtgtgatcttcttaggatcaacacagataggggtgtcatgatcaatgataa

SEQ ID NO: 1471 - DNA, 434 bp, Cicer arietinum
cacaataattctcacttgtttgtttcaatcatcatccatgtcgactactgctggtcaagtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaagggtcagactcctatgtttcctcgtatatttggtcatgaagctggagggattgtggagagcgtaggggagggtgtgactaatctgaaaccaggggatcatgctctgcctgtattcactggggagtgtggggaatgtccacattgtaagtctgaggaaagcaacatgtgtgatcttcttaggatcaacacagataggggtgtcatgatcaatgataaccagtcaa

SEQ ID NO: 1472 - DNA, 437 bp, Cicer arietinum
acagtttcattcttcagactttcaactgttggtatttgtcgctctcctcaatattttgggcaaggtccgccactgcttgtgtgtgatgcattcgttgaggatgaagatgtcattgattcggcctctgttgacgaggcgaggattcagcacaagctctgacaaaatggttgccgctgtgctgtttgagagattgcctgtggttattcccaaagttgaccctgttgtttatgcatttcaagaattctcgtttcgatggcgaatgcagtatcaacgtagatatcccgatgaatttctagacagatctggtgcaagggggaaaggtgattatcagattgactatgtgccagcaccaagaatcaccgaagcagacaaaaaaaatgatcgaaggtcactgcaaagagctcttgacaaaagactctaccttcttctctatggta

SEQ ID NO: 1473 - DNA, 406 bp, Cicer arietinum
acatcctcttgcctcttccacttattaaacaacacaacggaaaaaagtgggcagttgaccaaagaacttggttcatctcaccgtcggcaacaacactcaaatgaaaggaatgaccattcaaattataaaaaatttaataacggaaaattttgttgtttggcattgccaagaaagagttcctaaattattaaatttagcaattatagagaaaggataataaaattgtgattaagctgaggcatgtgattcatttgcaatcttctctgccttagcaatgacctcgtcaataccaccaaccatgtagaatgcctgctctgaaaggtcatcatatttgccatccaacacaccctggaaactagtgatgttctccttcaattcaacatattttcctggggcaccagtgaag

SEQ ID NO: 1474 - DNA, 339 bp, Cicer arietinum
gccggcctctgcttccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgtacctagctagctcagcacgtcttttgctccagtaggagatttggcttcgttacagccacccagacgaaaaatacacatatttaacacgaaggcttta

SEQ ID NO: 1475 - DNA, 420 bp, Cicer arietinum
acctcaacgaattccaggattccgttgtctccggtttccaatgggccacccgtgagggtcccgttgctgaggagcccatgcgatcttgccgcttcaacatcctcgatgttaccctccacgctgatgctattcaccgtggtggtggtcagatcatccccactgcccgtcgtgtcctgtacagtgttggaaaatgtggtgtttgatgagcataatagagaagttgattactctgacaaatcagttacagaaaatactcgtgcagcctatcctattgagttcataccaaatgcaaaattaccatgtgttggtcctcatccaaagaatgttattcttttggcatgtgatgcatttggtgtgcttccacctgttagtaagctaagcttggcacaaaccatgtatcatttcatcagtggatatact

SEQ ID NO: 1476 - DNA, 431 bp, Cicer arietinum
cgggaccccaagccgtggaactttgaagatataaagaaccatgttgagaaatctgaccagggcgatgtagtcctcatcgacgtccgagaaccagtcgagcttttcgagacgggcaagatccccggtgcgatcaatattcctatcacatcggcagctcagagcctccacatctccgacgaggattttgaggacatgtatggcttccagagaccggcaaagaacaaagagcttgtgttttattgcaaagcaggagtgcgtgcaagggcggctgcgcaactggctcatcatgctggctggaacaagatcggcgactatgcaggcagctggctggactgggaagctcagaaaggaccagttgagaaggttaagaaaccatattgaacagacagagcttgatgaagacatccattggcagaatggttggtcaaata

SEQ ID NO: 1477 - DNA, 433 bp, Cicer arietinum
tttgactaccggtcatttaaggcaattccagccttggcatcaaagatacttgacctagtatcaccaatgaagtcggtggagaccacatcatcttcagtgtatccgagaatgcctttcaacttgccctcagactcctccttgatagcagccttgatttcgtcgtaggtagcggccttctcaagcttcactgtaaggtcaacaactgatacatcaacagttgggacacggaatgccattccggtcaattttccattcaaaacaggaagcactttgccaacagccttagcagctccggtactgctaggaatgatgttaaatgaggcagctcttccacctctccagtctttggctgatggcccatcaacagtcttctgagtggcagtgatggaatggacggtggtcatcaaaccctcaacaatgccaaacctgtcat

SEQ ID NO: 1478 - DNA, 401 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggt

SEQ ID NO: 1479 - DNA, 435 bp, Cicer arietinum
acggtgttggaacatgatgtggtggcagagaaagtgagtaatcacaaaggatgctgcaaatcagggccaggttatgcttctcctcttgaagccatgtctggtcccagagagactctcatttatgtcactgctgtctattcaggaacaggaatagagaagcctgattatttggctacagtggatttggatccaaactctccaacttattcaaaagtgatccatagactacctgttcctaatttaggtgatgaattgcatcatactggttggaattcttgtagctcttgctttggagacccatcggcacagaggagatttcttattgcacccggtcttgtatcgggtcgcgtaccgtttcgacccaacggtttggtctagaggtctcagccagtgagacagattgtcaaagcctggtggtgttccaggcagcagccg

SEQ ID NO: 1480 - DNA, 229 bp, Cicer arietinum
acatccttttgcttcttccacttataaaacaacacaacggaaaaaagtgggcagttgaccaaagaacttggttcatctcaccgtcggcaacaacactcaaatgaaaggaatgaccattcaaattataaaaaatttaataacggaaaattttgttgtttggcattgccaagaaagagttcctaaattattaaatttagcaattatagagaaaggataataaaattgtgat

SEQ ID NO: 1481 - DNA, 285 bp, Cicer arietinum
actccttaactttctttttcgctaattttggtccaaatgctaccacatttgttgttccggctgagattttcccagctaggctgagatcgacttgtcatgggatctcagctgctgcgggaaaggccggagcaattgttggtgcatttggattcttatatgctgcacaaagtaagcataaaaatgagactgatgaaggttatccaactggtattggtgtgaagaattctcttattatgctcggtgttgttaacttcctgggaattgtattcacctttttagtgcctg

SEQ ID NO: 1482 - DNA, 415 bp, Cicer arietinum
acagagcttacctggagaccgtggaacggggcaattgcctcgtctacagagcagcgttctggccgccttgggtttttcccctgcaaggggtttccccaaggatgcatagtcctaggttgcagctactggcgatcttagaggatcatggacttcctgcctcagggtatggaaagctacttgatctatccgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagagctggctacgagtagagaggtgcctcttggggggatgagt

SEQ ID NO: 1483 - DNA, 415 bp, Cicer arietinum; identical to SEQ ID NO: 1482

SEQ ID NO: 1484 - DNA, 406 bp, Cicer arietinum
acatcctcttgcctcttccacttattaaacaacacaacggaaaaagggggggaggtgaccaaagaacttggttcatctcaccgtcggcaacaacactcaaatgaaaggaatgaccattcaaattataaaaaatttaataacggaaaattttgttgtttggcattgccaagaaagagttcctaaattattaaatttagcaattatagagaaaggataataaaattgtgattaagctgaggcatgtgattcatttgcaatcttctctgccttagcaatgacctcgtcaataccaccaaccatgtagaatgcctgctctgaaaggtcatcatatttgccatccaacacaccctggaaactagtgatgttctccttcaattcaacatattttcctggggcaccagtgaag

SEQ ID NO: 1485 - DNA, 420 bp, Cicer arietinum
acagaatcaaaaaggggaatccctctatacccaattgataaaaaaggaatgaggtaatgacaaaatcattcaccagctacgtagatctaaaaaaagcagctatgaaagatgaagttgatttagaagctggtattccaaaagaaggtgttaatgttgaattaacatcttcaataacccatttggaaaccgatatgaatttgttcttagaagaggcagagaaagtaagaacagaaatgggtcaaattcgcgatatcctaacaaagcttgaacaatcaaatgaagagagcaagtcacttcacaaaacggaagctttgaaatcattgagggaaagaattaacactgatattgtaactgttttgaagaaagcaaggtgtatgaggactcaattggaagaaatggatcgtgctaatgatgctaata

SEQ ID NO: 1486 - DNA, 204 bp, Cicer arietinum
atccgagttttcccgctacaatctcaaacgcaaggtggctggggttcccggggtgacagaagcattgtttctagctagacaatctgcacttgctctagagaaagataaatctaatgaaacccctatgctctatagctgtggcctatgtggtaagggttataaaagctctaaagctcatgccgagcatcttaagtcgagaactca

SEQ ID NO: 1487 - DNA, 350 bp, Cicer arietinum
cggggacgttttccgctccctaacaggaaatttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgtcggcctctgattccttcccaaggtttttccctgccgccgcgacatacgactacgagctacaacttggttactggagattgtggactgcgtcagcagatgtagcgatgcgtgagagaattctggtcggtggaa

SEQ ID NO: 1488 - DNA, 253 bp, Cicer arietinum
  misc_feature (6)..(6): n is a, c, g, or t
agaagncgcatgctcccgtccgccatggcggaagagggaattcgatttcgagcggccgcccgggcaggtactggattacctgattgccatgagaaccagacaaatgctattatgacagcatttttgccttgtgtaatatttggacaaatagcagaagtattggatggtggagaattgagttgtccgttgggaagcttcatttacctgctaatgatgcctgctttgtgcactcaatggattatggggtcaaagt

SEQ ID NO: 1489 - DNA, 417 bp, Cicer arietinum
acagttctcacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 1490 - DNA, 435 bp, Cicer arietinum
acagaatcaaaaaggggaatccctctatacccaattgataaaaaatgaatgatctaatgacaaaatcattcaccagctacgtagatctaaaaaaagcagctatgaaagatgaagttgatttagaagctggtattccaaaagaaggtgttaatgttgaattaacatcttcaataacccatttggaaaccgatatgaatttgttcttagaagaggcagagaaagtaagaacagaaatgggtcaaattcgcgatatcctaacaaagcttgaacaatcaaatgaagagagcaagtcacttcacaaaacggaagctttgaaatcattgagggaaagaattaacactgatattgtaactgttttgaagaaagcaaggtgtatgaggactcaattggaagaaatggatcgtgctaatgatgctaatagaagactctctggac

SEQ ID NO: 1491 - DNA, 430 bp, Cicer arietinum
acagaatcaaaaaggggaatccctctatacccaattgataaaaaaggagggaggtaatgacaaaatcattcaccagctacgtagatctaaaaaaagcagctatgaaagatgaagttgatttagaagctggtattccaaaagaaggtgttaatgttgaattaacatcttcaataacccatttggaaaccgatatgaatttgttcttataagaggcagagaaagtaagaacagaaatgggtcaaattcgcgatatcctaacaaagcttgaacaatcaaatgaagagagcaagtcacttcacaaaacggaagctttgaaatcattgagggaaagaattaacactgatattgtaactgttttgaagaaagcaaggtgtatgaggactcaattggaagaaatggatcgtgctaatgatgctaatagaagactctc

SEQ ID NO: 1492 - DNA, 383 bp, Cicer arietinum
tgctcagcattgactgatggagaaacatatctgtttgcttttggtggctacaatgggaggtatagcaacgaggtttttgttatgagacccaaggcaaaggacactttgcgtcccaagattttccagtcaccagctgccgcagctgcagctgcttctgttacttctgcctatgcattgtctaaatctgagaagttggatttcattcaactagatgatataaattccaagtcatctgtaaatggtcatcatgaagacaacgtcactgttaaaattgatgccattaaagaagaaaagcggttattggaattgtcaattacagaagtcagggccgaaaattctaagcttggaggtgagatacatgaagcaaatagtacctgcccggg

SEQ ID NO: 1493 - DNA, 200 bp, Cicer arietinum
gaaagggcattgacctattgaattgagcggcgaggggaagagaggagaggtggtttgaagtttgaattgaaatttgaaagcaaagcataaaagagatttggcgacgtaatgagcaacgaatacgattacctatttaaggttcttataatcggagactcctccgttggaaagtcttgcttgcttctcagattcgccgatga

SEQ ID NO: 1494 - DNA, 402 bp, Cicer arietinum
acatggcgagctgagaagatctctaaacgctcccgaacattcaatgcccgtgtaattgaatgaaaccatgaattccagcgtgtcgagttgttctggataagctcgagtccgtcgaattcagagagatctccgccgataatgattgcagcaaactcctcacggcgttgtggagtaagcctaatgtatcgcacgaggttgtgaagccgacccaaacacccaaatcttttccagagctcttccaccttcgcatagtctccgcgttgatagtgtttttcgagctttgctagatacctttcacagtcccgtcccataaggaatgcctggcagcagagattgataatatggcccaagcaactaatccggcgatggcggcgttgcttgggcgtcatccatgggcagagc

SEQ ID NO: 1495 - DNA, 312 bp, Cicer arietinum
gcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaagcgcctttgtgccgatgatatgctggatgaactagatagaagcgttgctggagggaagctctgctgagatcagctgtattgatgtccaatgggacgtacttcaccgacaactactgtagagctggctacgagtagagaggtgcctcttggaggtaatgagt

SEQ ID NO: 1496 - DNA, 410 bp, Cicer arietinum
ggaaaaaccatcacccttgaggttgaatcgtctgatacgattgataatgtcaaggccaagatccaggacaaagagggtatccctcctgatcagcagaggcttatctttgcagggaaacaacttgaggatggtagaaccctagctgattacaacatccagaaagagtctacccttcatttggtgcttcgattgagaggtggcatgcaaatttttgttaagactttgacagggaagaccattaccctcgaggttgaatcttctgatacgattgataatgtcaaagccaagatccaggacaaagagggtatccctcctgatcagcagaggcttatcttcgccggtaagcaattggaagatggtcgcaccctagctgattacaatatccaaaaggaatccacccttcatttggt

SEQ ID NO: 1497 - DNA, 422 bp, Cicer arietinum
ggaaaaatccccacccttgaggttgaatcgtctgatacgattgataatgtcaaggccaagatccaggacaaagagggtatccctcctgatcagcagaggcttatctttgcagggaaacaacttgaggatggtagaaccctagctgattacaacatccagaaagagtctacccttcatttggtgcttcgattgagaggtggcatgcaaatttttgttaagactttgacagggaagaccattaccctcgaggttgaatcttctgatacgattgataatgtcaaagccaagatccaggacaaagagggtatccctcctgatcagcagaggcttatcttcgccggtaagcaattggaagatggtcgcaccctagctgattacaatatccaaaaggaatccacccttcatttggtacctcggccgcg

SEQ ID NO: 1498 - DNA, 461 bp, Cicer arietinum
accctcgccgactacaatatccagaaggaatctacccttcatctcgtcctccgtcttcgtggaggtatgcagatctttgtgaagaccctcaccggtaagaccatcactctcgaagttgaaagctctgacaccatcgacaacgtgaaggctaagatccaagacaaggaaggaatcccaccagaccagcagagactcatcttcgccggaaagcagcttgaagatggccgcaccttagctgactacaacatccagaaggagtcaacccttcaccttgtgttgcgtcttcgtggtggtatgcaaatcttcgtgaagaccctcactggtaaaactattacccttgaggtggagagttctgacacaatcgacaacgttaaggccaagatccaggataaggaaggtattcccccagatcagcagaggttgatcttcgccggaaagcatctggaagatggaaggaccct

SEQ ID NO: 1499 - DNA, 337 bp, Cicer arietinum
actggcttatagtggcggcttagacacgtcagtcattgtgccttggctgagagagaattatggctgtgaggttgtttgcttcactgctgatgttggccaaggtataaaagaattggatggtctagaagccaaagccaaagccagtggagcctctcaattagttgtaaaggacttgagggaggaatttgttaaagattacgtatttccttgcctgcgtgctggtgccatttatgagaggaagtatttgcttgggacctcaatggcccgccctgtaattgcaaaggccatggtggatgttgccaaagaagttggagccgatgctgtctcccacgggtgt

SEQ ID NO: 1500 - DNA, 439 bp, Cicer arietinum
tccttcttggcacccactgttagtgcggtgctaggagcgggattttctacgggctatgcgactacacaaaactgcggggatgctatcggctccctaacagcagctttcggagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgacaatag

SEQ ID NO: 1501 - DNA, 341 bp, Cicer arietinum
actggctcacttaccgcaccttcggcgagttctctcgcagcttcaacttccccactcgtgtcgaccaggacaacgtctctgccaagtttaaggacggtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgtaggcctggcttggtcattcgctccttgt

SEQ ID NO: 1502 - DNA, 376 bp, Cicer arietinum
tgctcagctttccctgatggagaaacatatctgtttgcttttggtggctacaatgggaggtatagcaacgaggtttttgttatgagacccaaggcaaaggacactttgcgtcccaagattttccagtcaccagctgccgcagctgcagctgcttctgttacttctgcctatgcattgtctaaatctgagaagttggatttcattcaactagatgatataaattccaagtcatctgtaaatggtcatcatgaagacaacgtcactgttaaaattgatgccattaaagaagaaaagcggttattggaattgtcaattacagaagtcagggccgaaaattctaagcttggaggtgagatacatgaagcaaatagtacct

SEQ ID NO: 1503 - DNA, 377 bp, Cicer arietinum
tgctcagcattgattgatggagaaacatatctgtttgcttttggtggctacaatgggaggtatagcaacgaggtttttgttatgagacccaaggcaaaggacactttgcgtcccaagattttccagtcaccagctgccgcagctgcagctgcttctgttacttctgcctatgcattgtctaaatctgagaagttggatttcattcaactagatgatataaattccaagtcatctgtaaatggtcatcatgaagacaacgtcactgttaaaattgatgccattaaagaagaaaagcggttattggaattgtcaattacagaagtcagggccgaaaattctaagcttggaggtgagatacatgaagcaaatagtacctg

SEQ ID NO: 1504 - DNA, 187 bp, Cicer arietinum
cgagctaccacttggttactggagattgtggactgcgtcagcagatgtagcgatgcgtgagagaattctggtcggtggaaaaatttgacagactgcccccgaacccgctgacgggtgacgggcttgacaacaacagcgccttttgtgccttggtatgctggatggtgaaggaagcggggtatcctgt

SEQ ID NO: 1505 - DNA, 315 bp, Cicer arietinum
  misc_feature (312)..(312): n is a, c, g, or t
cgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgtaccttgcccgggcggncgc

SEQ ID NO: 1506 - DNA, 270 bp, Cicer arietinum
acaaaatctcttccctgtctaagagctcaacaatcacaaccaaccgaacacatacacaaagcacctacatcacctactacatcacctttcaaatattcacaatgggcggtgttatgtcttgtatccggtcatgcctccagaccattggggacgtgatcatggcaatcataggaggaatcggccggattatcacagcaatcgtcaatggcattgtagctttctgctcgattctggtccgcttccttacctgcggctattgcggttcgaagg

SEQ ID NO: 1507 - DNA, 233 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaagg

SEQ ID NO: 1508 - DNA, 436 bp, Cicer arietinum
  misc_feature (412)..(412): n is a, c, g, or t
accttgcgtttccgtctctcaaatgaaaaaaaagttcaggcagaagaattaacgagagaggactttcagggctccaagtggttggtgttgagatatgcaatacttaatttggaagttattcaagcagccattcttttagccaaacaggaaggtctttttgtttccttggatttggctagttttgaggtggttagaaatttcaaacagccacttctgaagctattggagtctggaaacatagacctttgctttgctaatgaggatgaggcaacagagcttctaagaggtgaacagaatgctgatccagtagctgctgtagaatgtctggccaaatactgtcaatgggctgtagtaacattgggttctaatggatgcatagctaaacataaaaatgagattgtatgcgttccancgataggtgaagcaaaggcaattg

SEQ ID NO: 1509 - DNA, 435 bp, Cicer arietinum
accatgcgatcacgtctctcaaatgctgtcaaagttcaggcagaagaattaaccaaagaggactttcagggctccaagtggttggtgttgagatatgcaatacttaatttggaagttattcaagcagccattcttttagccaaacaggaaggtctttttgtttccttggatttggctagttttgaggtggttagaaatttcaaacagccacttctgaagctattggagtctggaaacatagacctttgctttgctaatgaggatgaggcaacagagcttctaagaggtgaacagaatgctgatccagtagctgctgtagaatgtctggccaaatactgtcaatgggctgtagtaacattgggttctaatggatgcatagctaaacataaaaatgagattgtatgcgttccagcgataggtgaagcaaaggcaatt

SEQ ID NO: 1510 - DNA, 135 bp, Cicer arietinum
acatcgtccctattcctatttcacacaggcccgaagccgcggtataacaaattcatcatgaaaaccccatcccgatcatggggagattaaaaaaccttggtcaagagaggatttactcaaaagggttggttcggg

SEQ ID NO: 1511 - DNA, 416 bp, Cicer arietinum
gtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatgtcatactctcttcttcttttcattttgttgtggaagtgtgagattgtaagtcaagtgtgt

SEQ ID NO: 1512 - DNA, 416 bp, Cicer arietinum; identical to SEQ ID NO: 1511

SEQ ID NO: 1513 - DNA, 405 bp, Cicer arietinum
tgtacctcaatcaatctgttttagagggtcgctatatcactgtagagcggtcacggagaaagcgaccaagaactcccacacctgggcactatcttgggctgaaaaataccagagacgatggttatcgtggtgaccggggaaggcataggggtggacctggtcgtgatgattatcaatatcggaggtctccaaggcgctcaccaccatatcgaggtgggagggatatttcaccaaggcactctccctacggtggaagatataggagggacatgtctaggtcaccacctccttatccccaatatggtagcccagataggaggtatgctcgtgggcctaggtgatattttacattagtttgttttgacatttgaagagtgaaagcaaaaactgtgtaattggtatggt

SEQ ID NO: 1514 - DNA, 307 bp, Cicer arietinum
tttgtcattagcgtgggcaaggccgaggtacactagactatggggcggcgcaaacagtaatcgaataccggtcatcttctgacctatcccccagtatgacctatctatagcttcaacacagaaacaaccagtaatgcaacattagtattacattactcgtccatgacagccgcaaacttgtctgtcatcttctgttgaatctcctcgtatctcttggagatcacatcctggccgtcggtgggaacctcaaacttcaactgtcgtaggttggctagcaggtcagaagtagcctctcgtacctgcccgg

SEQ ID NO: 1515 - DNA, 419 bp, Cicer arietinum
acggattttacaccttctgaaattgctaaacaaggttttgaagaggccaaaaagaagaaaattgatgtggttattgttgacactgctggtaggctgcagatagacaaaggaatgatggacgagttaagagaagtgaagcgtgtattgaatccaatagaagtcttgttagttgtggatgctatgacagggcaagaagcagcagctttggtgactacattcaatcttgagattggaataactggtgccatattgacaaagctagatggtgattcaagaggtggagcggctttgagtgtcaaagaggtatctggaaagccaattaagttggtaggtcggggggaacgtatggaagatcttgaacctttttaccccgatcgaatggcaggacgcatactaggaatgggagatgttctctcatt

SEQ ID NO: 1516 - DNA, 430 bp, Cicer arietinum
caaaatctcacccttgtctaagagctcaacaatcacaaccaaccgaacacatacacaaagcacctacatcacctactacatcacctttcaaatattcacaatgggcggtgttatgtcttgtatccggtcatgcctccagaccattggggacgtgatcatggcaatcataggaggaatcggccggattatcacagcaatcgtcaatggcattgtagctttctgctcgattctggtccgcttccttacctgcggctattgcggttcgaagggaggccgagcgaagcgccgaggacactctcacatgaggacgacgagagtttagacgatgaactacacgggcgaacttcttttgtgataccaatttgagaaaggataggggaaggggggagagctttgttagtttgcggaggagtttgctacggccgtttga

SEQ ID NO: 1517 - DNA, 437 bp, Cicer arietinum
accatgcgaccatgtctctcaaatgctgtcaaagttcaggcagaagaattaaccaaagaggactttcagggctccaagtggttggtgttgagatatgcaatacttaatttggaagttattcaagcagccattcttttagccaaacaggaaggtctttttgtttccttggatttggctagttttgaggtggttagaaatttcaaacagccacttctgaagctattggagtctggaaacatagacctttgctttgctaatgaggatgaggcaacagagcttctaagaggtgaacagaatgctgatccagtagctgctgtagaatgtctggccaaatactgtcaatgggctgtagtaacattgggttctaatggatgcatagctaaacataaaaatgagattgtatgcgttccagcgataggtgaagcaaaggcaattga

SEQ ID NO: 1518 - DNA, 405 bp, Cicer arietinum
acagcaaaagacctggttgaacctgttcctgacccaaaaccccatgctttcactgatatgaactgtgattcaccagggcttggccgaaacactgtgttggattctcaagtggcggataatgctttgtctttcaaagagtttgatataaatgatgccgatgttgaggttcttgaagctggtcctttagtgaatttgtctcaagggaacaataccaaagagggtaatgaaaacgtagatgtctcttgttctgttcttaatcatgctggtgagagttccttgcaggtaaaatctgatttgaatggtgaagttgcatatgagggggaaaataatttacatttggacagagaagttgcttcaaatgaaatgcattctgatgaaactggcctaaatccttctggtgacagt

SEQ ID NO: 1519 - DNA, 427 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctcggccg

SEQ ID NO: 1520 - DNA, 427 bp, Cicer arietinum
acagagcttacctggggaccgtggaacgaggcgactgccttgtctacagagcagcgttctagccgccttgggtttttccctgcgaggggtttccccaaggatgtacggtcctaggttgcagctactggcgatcttaggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggaggaaagctctgctaagatcagctgtattgatgtccgatggaacgtgcttcaccgacaactactgtagggcgagctacgagtagagaggtgcctcttgggggtaatgagtacctcggccgcg

SEQ ID NO: 1521 - DNA, 378 bp, Cicer arietinum
acagagcttacctggggaccgtggaacgaggcgactgccttgtctacagagcagcgttctagccgccttgggtttttccctgcgaggggtttccccaaggatgtacggtcctaggttgcagctactggcgatcttaggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggaggaaagctctgctaagatcagctgtattgatgtccgatggaacgtgcttcaccgacaactactgtagggcga

SEQ ID NO: 1522 - DNA, 439 bp, Cicer arietinum
ccccaacttgcatcaatctaaccaaagaaaaaagaaagttggtcacaaaagtggtagtgcaggcaaggacaatggaacaaataggagtaatactaagaatgaccatactgcccttacatatttcaagtctgttgtcaaggtatgtggaagcctttttacattgtttcttcctgggaatacaaaaacaacctcagaagctgctgaaaataattccacaaggaacaaagttagaggagtatcatcttcaacagatgtatcatctgatagttctaagagttcatcaaaatggaaatcttctcaatcctcagcagcatcatctagcacttcaagtattcagcttggaatgggaaactttacctttgaggaaatttacaaggcaacagcaaaattctctgtagataataagattggtgaaggagggtttggaatagtatacaag

SEQ ID NO: 1523 - DNA, 279 bp, Cicer arietinum
actagacaagctttagcgaaggcacttgcagcagcaccatcaatgtggactcttggaaatgcagggatgggggcattacagaggcttgcggaggatagtaacccggccattgcagctgcagcatccaaagctatttatgaactgaaaaagcaatgggaaatagaggaaggcgataactggaggtttatgatggatgaaagcaccaaggaagaaaatgaaagctgagaatctgataattaagaagataccaattcataaatctttaaaactttacactgt

SEQ ID NO: 1524 - DNA, 351 bp, Cicer arietinum
acatgggaatcaatcatgtggtgaccacataatttcttttctcattcaagcctacaaaagagcgctacctgtttatcttccagtttatctgatacctgccctaatagttcacagaaaaggacttttaataaggcctattacaatattgagaaagagtcttattggcactgcaagatcaagcttgtttctgtctgtgtattgtgcatctgcctggatgtggacgtgttttctctttaggatcttcaaacgatgtaatgttccaatggtggccatgggaacgttcccaactggcctagcattggcgattgagaagaaaagcaggcgaatagagatatcgttatactgccttgc

SEQ ID NO: 1525 - DNA, 354 bp, Cicer arietinum
acatgggaatcaatcatgtggtgaccacataatttcttttctcattcaagcctacaaaagagcgctacctgtttatcttccagtttatctgatacctgccctaatagttcacagaaaaggacttttaataaggcctattacaatattgagaaagagtcttattggcactgcaagatcaagcttgtttctgtctgtgtattgtgcatctgcctggatgtggacgtgttttctctttaggatcttcaaacgatgtaatgttccaatggtggccatgggaacgttcccaactggcctagcattggcgattgagaagaaaagcaggcgaatagagatatcgttatactgccttgcccg

SEQ ID NO: 1526 - DNA, 448 bp, Cicer arietinum
gagtaaactaagttttcaactcaacaagaacaaatcatggcattgatggcagcaacagcaagctcagcaactgttgttaaacaatctcctttccttggacaaaggaaaggtgccagtgccaatcctcttagagatgttgtctccatgggaacttctaaattcaccatgggaaatgaattgtggtatggaccagacagagtgaaatatttaggacccttttcagctcagacaccttcatacttaactggagaattcccaggagattatggatgggacactgctggtttatctgctgatcctgaagcatttgccaagaacagggctcttgaggtgatccatggaagatgggcaatgctaggagcactaggttgcataacaccagaagtgttagaaaaatgggtgagagttgacttcaaagaaccagtttggttcaaagcaggatcccaga

SEQ ID NO: 1527 - DNA, 278 bp, Cicer arietinum
ccgggcaggtacgagaggctacttctgacctgctagccaacctacgacagttgaagtttgaggttcccaccgacggccaggatgtgatctccaagagatacgaggagattcaacagaagatgacagacaagtttgcggctgtcatggacgagtaatgtaatactaatgttgcattactggttgtttctgtgttgaagctatagataggtcatactgggggataggtcagaagatgaccggtattcgattactgtttgcgccgccccatagtctagtgt

SEQ ID NO: 1528 - DNA, 403 bp, Cicer arietinum
acaccaaacacccaatcgagaacattcaaatatttggatctgaacacttccctctcttgtgcatagcagtgcattatgatggctgttgacaagctgaaaactacgacatctgctctcttgatagttctagactgcggcagatacccagcatcagctatgcatgtgaagaaactctcaatagcccgggcaaggcagtataacgatatctctattcgcctgcttttcttctcaatcgccaatgctaggccagttgggaacgttcccatggccaccattggaacattacatcgtttgaagatcctaaagagaaaacacgtccacatccaggcagatgcacaatacacagacagaaacaagcttgatcttgcagtgccaataagactctttctcaatattgtaatag

SEQ ID NO: 1529 - DNA, 410 bp, Cicer arietinum
cacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatgtcatactctcttcttcttttcattttgctgtggaagtgtgagattgtaagtcaagtgtgt

SEQ ID NO: 1530 - DNA, 262 bp, Cicer arietinum
caacaaaccaccaacctcaacataaccaactcaattatctttttctttttaaacaagaaaactatataaaccagcaatggataccatcaagaacaccgttaaccaagctaccgagaaggtccaggagggtatctctggcaccagcaaggaggctaacaaggaggttgccaaggactccaacgccggcattggcactcgtgcttccgctgccaaagatgcagttggcgacaagatcgatgagagcacccatggagctaaggga

SEQ ID NO: 1531 - DNA, 264 bp, Cicer arietinum
ggccacacaatactgcggggacgccatcggctccctaacagcagttttcacagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccc

SEQ ID NO: 1532 - DNA, 390 bp, Cicer arietinum
acctaacaatttacgactatcttaaactatgaacagaagcaacgccacagtaaattctgatgcctcagcacaatattaacaccaaaatgaaacatgattttgccatgtcaaggaataatcccataaagtgagagttgaacacaaacaccacataagatatatttctctcaaacttccagtctcaacaccattcagtgactacaaaaacaataattggaagtcaacctgccagtgccatggctttgaatagcatccatgaagtgatcacattatggtgcagcggctcttctcctcagttggctgtgagtttacttgctggaatctttgtgactctgacgggttgtatgtaaattctgaagtatcaagcccatacttctccctcatccgtgt

SEQ ID NO: 1533 - DNA, 400 bp, Cicer arietinum
acttgaggatggtgttcttgatccagagacaacagtagtatcaatattcccatctcccatgcactatgccggaccaactgaggtgcagtggcatgcaaaggctaggatcaatgctggggctaacttctacattgttggccgagaccctgccggcatgagccatccagttgaaaaaagagatctatacgatgctgaccatggaaagaaagtattgagcatggcgcctggacttgagcgcctaaatattcttcctttcagggttgctgcatatgacaagactcagggtaaaatggcattctttgatccctcaaggcctcaggatttcctcttcatatcaggcacaaagatgcgcacccttgctaggaacaaagaaagtcctcctgatggatttatgtgccct

SEQ ID NO: 1534 - DNA, 298 bp, Cicer arietinum
gcctccgcccacctttatccttcggcaaatgctccccatcctcttccttaggtgtatcttcatgatgctcgtgtgaaccatgattctcctcatctctagtttgctcagctacatggcttgagctattcttctcagtatttgatcccttccaagcttgttttttgtgtccattcttccccattcgattgagaaatttaacccgcattccattcctccagtcttgttcattatttaacattgccacagctttctcagccgcctcaatagtctcatattccacaagagcatgtaacttagt

SEQ ID NO: 1535 - DNA, 360 bp, Cicer arietinum
gattcccagagttcgacattgtttccaacgctagttgtaccaccaactgccttgccccacttgctaaggttatcaatgacaggtttggcattgttgagggtttgatgaccaccgtccattccatcactgccactcagaagactgttgatgggccatcagccaaagactggagaggtggaagagctgcctcatttaacatcattcctagcagtaccggagctgctaaggctgttggcaaagtgcttcctgttttgaatggaaaattgaccggaatggcattccgtgtcccaactgttgatgtctcagttgttgaccttacagtgaagcttgagaaggccgctacctacgacgaaatcaagg

SEQ ID NO: 1536 - DNA, 239 bp, Cicer arietinum
  misc_feature (186)..(186): n is a, c, g, or t
acattgccttagaaggcctaggcattgtgaacacagaaacaatgcaacctgttcctgctgatggtaaaactggttggcgagatcgtgatgcggggtaatgctgtgattaaaggctacttatagaaccctaaagctaatgaagagtcctttgctaatggatggtttcattctggtgatcttgctgtnaagcatccagatggatacatagaaattatagacagatcagaggacatcatcat

SEQ ID NO: 1537 - DNA, 203 bp, Cicer arietinum
acagaatcaaaaaggggaatccctctatacccaattgataaaaaatgaatgatctaatgacaaaatcattcaccagctacgtagatctaaaaaaagcagctatgaaagatgaagttgatttagaagctggtattccaaaagaaggtgttaatgttgaattaacatcttcaataacccatttggaaaccgatatgaatttgttc

SEQ ID NO: 1538 - DNA, 296 bp, Cicer arietinum
acaaaatctcagccttgtctaagagctcaacaatcacaaccaaccgaacacatacacaaagcacctacatcacctactacatcacctttcaaatattcacaatgggcggtgttatgtcttgtatccggtcatgcctccagaccattggggacgtgatcatggcaatcataggaggaatcggccggattatcacagcaatcgtcaatggcattgtaactttctgctcgattctgggccgcttccttacctgcggctattgcggttcgaagggaggccgagcgaagcgccgaggacac

SEQ ID NO: 1539 - DNA, 336 bp, Cicer arietinum
acagaatcaaaaaggggaatccctctatacccaattgataaaaaatgaatgatctaatgacaaaatcattcaccagctacgtagatctaaaaaaagcagctatgaaagatgaagttgatttagaagctggtattccaaaagaaggtgttaatgttgaattaacatcttcaataacccatttggaaaccgatatgaatttgttcttagaagaggcagagaaagtaagaacagaaatgggtcaaattcgcgatatcctaacaaagcttgaacaatcaaatgaagagagcaagtcacttcacaaaacggaagctttgaaatcattgagggaaagaatta

SEQ ID NO: 1540 - DNA, 403 bp, Cicer arietinum
accatctttaagtccagagagtcttctattagcatcattagcacgatccatttcttccaattgagtcctcatacaccttgctttcttcaaaacagttacaatatcagtgttaattctttccctcaatgatttcaaagcttccgttttgtgaagtgacttgctctcttcatttgattgttcaagctttgttaggatatcgcgaatttgacccatttctgttcttactttctctgcctcttctaagaacaaattcatatcggtttccaaatgggttattgaagatgttaattcaacattaacaccttcttttggaataccagcttctaaatcaacttcatctttcatagctgctttttttagatctacgtagctggtgaatgattttgtcattagatcattcatt

SEQ ID NO: 1541 - DNA, 322 bp, Cicer arietinum
actgtttttgattcaagctttgaaagaaataatccaattgactttgagcttggtagtggccaagtgatcaaaggatgggaccaaggattattgggaatgtgtctcggtgagaagcggaaactgaaaataccagcaaaacttggctacggagagcagggctccccacccactattccagggggtgcaacacttatatttgataccgagcttgtgggagtgaacgacaaaagtttaagcgaagaaaaatcaaactccgaactgtagacaaatcaaaagaaatggataactagactttcgggaatatttgatagcttatttgtgt

SEQ ID NO: 1542 - DNA, 427 bp, Cicer arietinum
ttccgaggcggccgccccgggcaggtactcgacacactcaaacacttcaacattgtattccacacctaaaccaaaaaagaagcaatcaaagaataaatgttgcccactctcatcaccaccactcccaaaaaacacagaactatatgaattcactactccacattttgtcaagttatcctttgtagaaatgcgattattaaataatcttcaagcaaaaagttccactttcagaggaaccgccttgttccaaatgaatttgatcaagggcaaatctccaacctccacttcgttagataatgtcgagtatgcacttttgactaaatacacaccactattttcaagtctccaagaccacctatctagaaaaccttcatgcaaaaaaacattagatagcaaaacacaacattcacgcaacaaatcctcctcc

SEQ ID NO: 1543 - DNA, 298 bp, Cicer arietinum
actaagttacatgctcttgtggaatatgagactattgaggcggctgagaaagctgtggcaatgttaaataatgaacaagactggaggaatggaatgcgggttaaatttctcaatcgaatggggaagaatggacacaaaaaacaagcttggaagggatcaaatactgagaagaatagctcaagccatgtagctgagcaaactagagatgaggagaatcatggttcacacgagcatcatgaagatacacctaaggaagaggatggggagcatttgccgaaggataaaggtgggcggaggc

SEQ ID NO: 1544 - DNA, 280 bp, Cicer arietinum
acgggaattcccggggcgcagagcccggattgtcgaaggctcgcgaagccgtaatgtcgaggtaggaagaagccacagatatcacaaaggaaaaggtgcccgaaggcgatgtcaagagctcgcggagctcagtgtcgttggagacacatgtcacgaagaaaggtcaactctctgaatccctttcttcaggcagctgttagggtcccgctaagcccacagctgtctttgctgccattttggcctgcaaaaactttctgccctagcagcgcgctaacagcgg

SEQ ID NO: 1545 - DNA, 252 bp, Cicer arietinum
acatcaaccagacaacgaatttctgaactacttataggatagaaaagaattggcgaaggatctccaagtatgacgtggccatgattggcacatggaagttcacagttctctaaaactaagccaacaaaacaagagggactgtctaccttagggttgcaaagagaacggcgcaagtttgagaaacatccatcacaaacaatggtaagaggagcatatgctgtcaattcctgaccatctttattcttgtattgt

SEQ ID NO: 1546 - DNA, 439 bp, Cicer arietinum
acctcctacgacatcctcaaagatgaaaaggctcgaaagttattcgacgaccttctccgcgtcaagcgcgataaccagcgccgtcaatctcagcgcgacggaaaacgccgcaaaatggtttccgatctcgaaaagagagagcgcgaagctttttccgtcgatcctgctgcgaaggggaaggaagaggaggagaggattgcgaaacagttaaaggatgagattgcgaggattcgtgctgtgcacgctaagaaagtggtgccggatttgggtggaatgaaagagagcgttggttccggcggtggtggcggtggagttgatcaagagaaggttttgaaagtttcgtgggagaaggttggtgaagattattcagcggataagttgagggaattgttttcaaagtttggtgaagttgaagatgttgttatcaaagggagtaaga

SEQ ID NO: 1547 - DNA, 360 bp, Cicer arietinum
acaggataccccgcttccttcaccatccagcataccaaggcacaagaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcaaaggccggcggtgcggcttgccttcaaaggggaaaaacccatcgcaatcggcgtcgttgatcggaaggatgacctgcccgggcggccgcccgggcaggtactaacatcagtatctgtaataaccaaa

SEQ ID NO: 1548 - DNA, 439 bp, Cicer arietinum
acggtccggacgtgctcaagaaagaagttgaaaaatacaagagatatgctgagaggttggaaccttatattgctgacactgtgcatgttgtgaacgaagctattacacaaaagaagaagatcttggttgaaggaggacaagcaaccatgttggacgttgattttggcacttacccctttgttacttcatctagcccatcagctggcgggatatgcaccggtcttggtatcgctccaagagtagttggtgatttagtcggagtggtgaaagcatacactacaagagttggttctggcccttttccaactgaattgttgggtccaggaggtgatctcctaagatttgctgggcaggagtttggcactactactggccgtcctcgacggtgtggttggctcgatatagttgcattacgatacgcatgtcagatcaatggttt

SEQ ID NO: 1549 - DNA, 438 bp, Cicer arietinum
acacaagtgagctgctagctcttcttatccactataaacaacaacaaagttacaagacaactcaaagaagctgtgataatcaccatactagtagctaacagcaacgatgcatatcccatttatctttgttttcagcaataacctcaactctatcaaggcagagtgtaaggtccacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttgtgacacacttgcattttcatcttgtgctgcacttgcacaaggagctagcttaaaagcttcattatctggtgtagtggattttccacattcaccagcactttcc

SEQ ID NO: 1550 - DNA, 319 bp, Cicer arietinum
ccacgctgcttttactcttcctgggctctacagggttgttcatggcattgatgtctttgatcccaagttcaatattgtctctcctggagcagatatgacaatatatttcccctactctgaaaaggagaaaagactcacgtccctgcatggttcaattgaaaagctattatatgataccgagcagactgacgagtgcattggttcactgaaggaccggtcaaagcctataattttctccatggcaaggctagacagagttaaaaacataactggtttggtagaaagctatgctaagaacagcaaattgagggaactggtc

SEQ ID NO: 1551 - DNA, 442 bp, Cicer arietinum
ccacgctgcttttactcttcctgggctctacagggttgttcatggcattgatgtctttgatcccaagttcaatattgtctctcctggagcagatatgacaatatatttcccctactctgaaaaggagaaaagactcacgtccctgcatggttcaattgaaaagctattatatgataccgagcagactgacgagtgcattggttcactgaaggaccggtcaaagcctataattttctccatggcaaggctagacagagttaaaaacataactggtttggtagaaagctatgctaagaacagcaaattgagggaactggtcaaccttgtcgttgtagctggttatattgatgtgaagaagtccagtgacagagaagaaattgcagagattgagaagatgcacgatctcatgaaggagtataatttgaatggtgagtttcggtgg

SEQ ID NO: 1552 - DNA, 436 bp, Cicer arietinum
acatgatcggtcaacatcccggttccgatgacaattctcgtccaccttttctccgtcgaacccgccgcaacggaggtgaccggtcacctttcaatccggtgatcgtcctacgcggaagtggatcaacggaggtaacagaaggtggtagcacaggagagagtcgtgggtttgagcttttctatgatgatggtgctggttctggtcttagacctttaccaccaagtatgtcagagtttcttttgggatctggatttgatagactgttagaacaactttctcagattgaaatcaacggtattggaagatatgaacatccaccagcttcaaaaacagccgttgattcattaccaactattgaaatcaatgggtgtcatttggatatggaatcacactgtgcagtttgcgaagaggcttttcagttaggtacctgcccggg

SEQ ID NO: 1553 - DNA, 402 bp, Cicer arietinum
ctgctcttctgttcggccgggagggcgtttcggatattgtcattgcttatctaccagaagaagagaaggatgctcaggacaccaaaaagcaggttgagaacgagggtgccaaggtccatcttatctctcttgacctctcgaaacaagagaattgcaagaaacttgttgactttgccgtggagaaaatgaacgggattgacattctattcaacaatgcagcttaccagatgatggtccaggatatcaaagacctccccgaggagcaatggattcacaccttcaacatcaacatccactccttcttctatatctctaaatacgccctccctcacatgaagacaggagctactattattaacaatgcttccatcaacgcctacatcggtcgccctgatctcctcg

SEQ ID NO: 1554 - DNA, 334 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccagcctctgattccttcccaaggtttttccctgccg

SEQ ID NO: 1555 - DNA, 438 bp, Cicer arietinum
acagtcaaattgctccaaagcctagtaattctctaaagcgttcgagaccagctaatggccagcttgcaacgtatgatgattttgatgatgatgctgtggatgttaaggggccagctggacagtctaaaggtctctccagtaaaatttcacagttcgttaatgctaattatctgaagaaacccaaggtggtttccggtgatgaggatttacctaagagagatagcattcgtgcacaacggaaaaaaaatgaggatcgggtgttgaatggtgctggaattaaaactgagggtgacgacaatgatgatcaaatgggtgatcttggatctcatgaagttgacgaggaagaagacattggaagtggggaggactcaggaaatgaattttacgaacaagcggaaaaattgcgagcagcaaaacttgctgcaaaagctgggacct

SEQ ID NO: 1556 - DNA, 382 bp, Cicer arietinum
cgaaagacatcgtcaatcaagatgagagccaaatggaggaagaagcgggttcgccgcctcaagcgcaagagaagaaagatgagggctcgatccaaataaacacctcgcacctcaacctgacttgactcatctttcatgatgttacgacttcacacgcacaacgatactctggccgaagctgcgaacgctactctggcgcctatgggatgtcccgcaacgtactgagctgggatttgacttcgggaactacgtcacggtggtggaaccccgcacttgagcggctgttgggcactcaatgaacattatgggaatggggattatgacaattggacggtcgggaaccaggcggtgttaggatcaaagaccatcagtcatgctcgca

SEQ ID NO: 1557 - DNA, 424 bp, Cicer arietinum
acttgttgggtatccaagtatctcaaccaaatcaaggaatgttttagtaaatcaggttctgttccatcagcccagcagggtccgtagatcactgccaagtttcatgtgatgccaacgcaaccaatcggcagccccaacttaaaagagtgacacactcctaaacgctggttccctcattcttaccggcgtgagcctcagaatcaatggtagtctcagggttgttggcatagtcatcctcaccactgagctcctcaagagtcttacgggcagtctcagggataaggagagtagtgaagataccgagaagcatgaagagagcatagatctcgaggacgtggtccatccagggggcctcgttcttgtcggtggcaccgtgggtgcggaggatggagatggcaccctggccaatgatggaaccaatctt

SEQ ID NO: 1558 - DNA, 282 bp, Cicer arietinum
acatgggaatcaatcatgtggtgaccacataatttcttttctcattcaagcctacaaaagagcgctacctgtttatcttccagtttatctgatacctgccctaatagttcacagaaaaggacttttaataaggcctattacaatattgagaaagagtcttattggcactgcaagatcaagcttgtttctgtctgtgtattgtgcatctgcctggatgtggacgtgttttctctttaggatcttcaaacgatgtaatgttccaatggtggccatgggaacgtt

SEQ ID NO: 1559 - DNA, 422 bp, Cicer arietinum
aagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatgtcatactctcttcttcttttcattttg

SEQ ID NO: 1560 - DNA, 455 bp, Cicer arietinum
acggtccggacgtgctcaagaaagaagttgaaaaatacaagagatatgctgagaggttggaaccttatattgctgacactgtgcatgttgtgaacgaagctattacacaaaagaagaagatcttggttgaaggaggacaagcaaccatgttggacgttgattttggcacttacccctttgttacttcatctagcccatcagctggcgggatatgcaccggtcttggtatcgctccaagagtagttggtgatttagtcggagtggtgaaagcatacactacaagagttggttctggcccttttccaactgaattgttgggtccaggaggtgatctcctaagatttgctgggcaggagtttggcactactactggccgtcctcgacggtgtggttggctcgatatagttgcattacgatacgcatgtcagatcaatggtttttcatcattgaatctc

SEQ ID NO: 1561 - DNA, 216 bp, Cicer arietinum
acatggaagcaagaccgttggaagatgggcttgcagaggccattgatgaaggcacaattggaccaagggatgaccccaaaatccgttctaaaatcttgtcagagcagcatggttgtgataaggatcttgttaagaagatttggtgttttggacctgagaccactggacccaacatggtggttgatatgtgtaagggagtccagtatttgaatgaaa

SEQ ID NO: 1562 - DNA, 402 bp, Cicer arietinum
  misc_feature (316)..(316): n is a, c, g, or t
accaggcctctgcatttcttcgaacacatgtccacgtttctgattaagaacactgtagataccaccaagagcttgctcaggagcttggatttccacaaggtaaacaggctcaagaagcctaggtttggctgtcagctgtgaggcatagaccactctcctggcagtaggaatgatctgaccacctcctctatggatagcatcagtgtggaggacaacatcacacacttcaaaacaaatggctctcatgttttcttctgctaaagcaccttctttagatgcccactggaatccagcaacaacagaatccttgatttcnattcaatactggactcccttacacatatcaaccaccatgttgggtccagtggtctcaggtccaaaacaccaaatcttcttagcaag

SEQ ID NO: 1563 - DNA, 124 bp, Cicer arietinum
gcaaattttgccctgagtgattttatctttgtcttttgagaatatgtctggctgcaactgtggaagtagctgcaactgtggtgatagctgcaaatgcaacaagaggtctagtggattgaactat

SEQ ID NO: 1564 - DNA, 456 bp, Cicer arietinum
actccaaatatcttagcaacaacccactaggcagagtcctcacaattactatcacccttacccttggctggcccctttacttggctctcaatgtttcaggcaggccttatgataggcttgcttaccactttaacccatatggtcccatttactcagatcgtgagcgtctacaaatatatgtatcagatgcaggaatccttgcagtatgctatgggctttatcttctcgccatggctaaaggacttgcctgggttgtgtgtgtttatggagttccactgctagtagtcaatggattcttggtgctgattacatttttgcagcatactcaccctgcgttgccacattacgattcctctgagtgggactggttgagaggagctttagcaacagtggacagggattatggtatcctgaacaaggtcttccataatattactgacactcatgtggctcatc

SEQ ID NO: 1565 - DNA, 311 bp, Cicer arietinum
actgttggcattggaagctcggcatgggaccgattgaccaaactccctcggcctaacgagctacatcctttcaaagagttcaaggggtcaaagcatactgctgtgtcaacgccaggtgatatcttctttcatattcgatcggagaggcgagatatggcattcgaatttgagagacaactcatggatagactgggtgatgctgtcaagctcgaagatgagacagttggttttaggtatttcgatacgcgcgacgtccttggatttgtcgacggaactgccaatccagtcggccccgatgtcaaggactcggt

SEQ ID NO: 1566 - DNA, 362 bp, Cicer arietinum
acagcagcacactagccaatgtcaaggcacctccttgactgaatccacagataaatatattgttagggtttacgccagcggctatttccttgtctatagtagcatgaacattttgaacagcattaagcaaactactttcgtcatttggagactcagctgtaacaggaatctccttaatgtcaaaccatgaaggcattacagaaccatggttgctagtgacagaggcgtaaggggcggaagggaaggaccatttggtgtctctgaattggggagaagtgaataatgtcttgattggctcatttgcaggaccagagtcaccaagaccgtgaagccacagaataaagcttcgagccattggttct

SEQ ID NO: 1567 - DNA, 437 bp, Cicer arietinum
gattgttgacgatgagatcaactctacaattgttaggcctctacctcaaggtgccaaactccgtgctgtcattgatacatgctttagtgggacagttcttgatttaccatttatgtgcaggattaaccgaaaaggttattatggatgggaagatcatagaagttctagagctggctacaagggcactagaggtgggctagcagtttgtttttcagcttgtgatgatgatggaaatgcagcagacacatcggcctttagtggtagtgaaagtgctggtgccttgacttacagtttcatccaagccatgcaagttcaacctaaactgacttatggtcaattgcttagtgccatgcgttctacaatccgtggggcaagagaaggaacttttggcacggattatcaacagcatgccatggacaatcggcagcagtatgctc

SEQ ID NO: 1568 - DNA, 437 bp, Cicer arietinum
accgccattgcagtggatggtctgtccactaacacatgagctgtcactcgacgccaggaagaccacgcacgtagcaatctctgatggctgagcaggtcgtcccatggggcttgtgaactgcttctgcgcttcgtcgtccattgtggcgggaatgagaggtgtccaaacgggtccaggagcgacagcattaacacgaatacccttgccgacatattgattgctgagaccgcgtgtgaatgaaacaatcgcaccctttgtggatgtgtaatcgaggagatcagggcgaccgatgtaggcgttgatggaagcattgttaataatagtagctcctgtcttcatgtgagggagggcgtatttagagatatagaagaaggagtggatgttgatgttgaaggtgtgaatccattgctcctcggggaggtctttgatatcctgga

SEQ ID NO: 1569 - DNA, 341 bp, Cicer arietinum
caacaaaccaccaacctcaacataaccaactcaattatctttttctttttaaacaagaaaactatataaaccagcaatggataccatcaagaacaccgttaaccaagctaccgagaaggtccaggagggtatctctggcaccagcaaggaggctaacaaggaggttgccaaggactccaacgccggcattggcactcgtgcttccgctgccaaagatgcagttggcgacaagatcgatgagagcacccatggagctaagggagaggcctacaagcagaacccatagatgcttcttacctgagaaatgaggaggatatgacactgcgggggactcgggccat

SEQ ID NO: 1570 - DNA, 364 bp, Cicer arietinum
caacaaaccaccaacctcaacataaccaactcaattatctttttctttttaaacaagaaaactatataaaccagcaatggataccatcaagaacaccgttaaccaagctaccgagaaggtccaggagggtatctctggcaccagcaaggaggctaacaaggaggttgccaaggactccaacgccggcattggcactcgtgcttccgctgccaaagatgcagttggcgacaagatcgatgagagcacccatggagctaagggagaggcctacaagcagaacccatagatgcttcttacctgagaaatgaggaggatatgacactgcgggggactcgggccatatctcgttcacgagacttcccgt

SEQ ID NO: 1571 - DNA, 183 bp, Cicer arietinum
ggtatggtatggtatgtatatttttcgtccggggggccaaaggccccaaaaagtctcctaatggagcacaggacgtgctgagctaaactatctacaatcgctgtcgcgctggactcctcctagaatacccgccatgtccactcgcatcaacggagagcctctcgagctccttcccccgagggc

SEQ ID NO: 1572 - DNA, 418 bp, Cicer arietinum
accttctccagatctcgatggtccgaacaataagaaccctcgttgtggcaaagcataaaagtcttcctctgtagcagttctaattcactgctaagcaggtaggctctcgaggcgctgaggcggtcgaagcgaacatccacgctttgtcgcgcttattcgagatactggcctaccaggacaaaccgctttaccaaaaaatgttagaaaatatattggctgggagcagggaacgggctcgtggggtgtttagaactgcatcgtgccagcgtggacataaagttcttgtttcaatgtccagcctgttggctcgcagagagaagaggcattctggaacaggctggcatatttcagcgatagagctgccgcccaaatgcgtgagagacagacaggccggtccgggcaggtgtcaggagcatgt

SEQ ID NO: 1573 - DNA, 436 bp, Cicer arietinum
gggtggacgtggtggtttacaattgggttcagtgtatcaaccttcacagcatattggattggcagtttctgattcaaatttgggtatgttggctgctcttaatgcttacacaagagctgcagctggtgctactgatttcaatgttaatgttaattctgataatcatcatcaccatcaccatcaacatcaacatcaacatcattctatttcattggattcacaatctcattctcattctcattctcattctcatcctcaacctactgaaagtgaagaagatgctcctgatacctctcaatgattcattactacttcataatattgggttctgtgttgaatttcttataacttattgctttttggaaattcattccatggattcatatgctagctgtgcatgctcaaaggacttgagtttttcatagatgttgcatta

SEQ ID NO: 1574 - DNA, 403 bp, Cicer arietinum
accaacatcttctgagtagtcaccatgaacctccatcagttttccaagatcaaacttgggagatttcaagatcttaactttgcgaataaaaacgttctgcagagggtaaatgctagatgtagccttctcaatctcctttccaatcatctcagggataaacttgcgaacaagctctttcaaatcacacgatgttgcttggttaaccatgatctccctcatcttcctgcggatctgtctgatctggctggattgagcataacaggttctcttcacttggttactgcgtctcttggtaaagccaatgcagaacattctcaaggtataattatcagtggtcttaacatccacatgagcttcaatgagagtttgccatttacggaccaaagacctgagcttgtcagtg

SEQ ID NO: 1575 - DNA, 443 bp, Cicer arietinum
aaaaattctttcttggcacccactgttagtgcggtgctaggagcgggattttctacgggctatgcgactacacaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccacgacagtcgactacgagctacaacttggttactggagattgtggactgcgtcagcagatgtagcgatgcgtgagagaattctggtcggtggaaaaattcgacaaat

SEQ ID NO: 1576 - DNA, 323 bp, Cicer arietinum
accttgtccctgctgacctaactgttggacagtttgtctatgttatccgcaaaaggattaaattaagtgcagaaaaggctatctttatatttgtggacaatgtccttcctcctacaggagcaatcatgtctgccatttatgacgacaagaaggatgaagatgggtttatgtatgttacatacagcggcgagaacaccttcgggaatctgacttcccatactcagtaggcatcacaaatgtatactgtatgatctgctctcattggtttgtctgttaaattctctgtagaactcataacaagaacataactcttaatgttatgt

SEQ ID NO: 1577 - DNA, 340 bp, Cicer arietinum
acaggaactattgaaggcaatggagatcagtggtgggatctcccctgcaaacctcacaggggtccagatggaaaaactttgtcaggaccatgtggtagtccagctatgatacggttcttcatgagctcgaatttgatggtgagtggactgcaaattcaaaacagtcctcaattccacatgaaattcgatggctgccaaggagtgttgattgataggctaaccatctctgcacctaaactcagccctaacacagatggaatccatgttgaaaactcacaggctgttggaatatataactctatgataagcaatggggatgattgtatttcaattggacccg

SEQ ID NO: 1578 - DNA, 440 bp, Cicer arietinum
acaggaactattgaaggcaatggagatcagtggtgggatctcccctgcaaacctcacaggggtccagatggaaaaactttgtcaggaccatgtggtagtccagctatgatacggttcttcatgagctcgaatttgatggtgagtggactgcaaattcaaaacagtcctcaattccacatgaaattcgatggctgccaaggagtgttgattgataggctaaccatctctgcacctaaactcagccctaacacagatggaatccatgttgaaaactcacaggctgttggaatatataactctatgataagcaatggggatgattgtatttcaattggacccggaacctcagatgtggacatagctggtgtcacttgtggtcctagccacgggattagcataggaagccttggtgtgcacaactcccaagcatgtgtttcaaa

SEQ ID NO: 1579 - DNA, 143 bp, Cicer arietinum
acatgttcctgacacctgcccggaccggcctgtctgtctctcacgcatttgggcggcagctctatcgctgagatatgccagcctgttccagaatgcctcttctctctgcgagccaacaggctggacattgaaacaagaacttt

SEQ ID NO: 1580 - DNA, 438 bp, Cicer arietinum
acacgtattattggggagagacagtttaataaagcagtggagctatttaatggagcatccgaacagattaaaggaaaggtagattttcgacatgcctacatcgatttctcccagctcgaggtaaatgtttctagcacaggagcttctaagctagtaaagacatgtccagctgcaatgggatttggatttgccgctggaacaactgatggacctggagcatttgattttaagcaaggcgatgatcaggggaatccattctggaaactggtccgcaacttactgaaaacgccagaccaggaacagatagattgtcaacacccaaagcctattttgcttgataccggtgaaatgaagcttccatatgattgggcaccttcaatacttccaatccagatcctccgaattgggcagtttgttattcttagtgtaccaggagaa

SEQ ID NO: 1581 - DNA, 312 bp, Cicer arietinum
cacgaaagcgtctggaactcccgcccccgaaactacggcaagggctctcgcagctgccgcgtctgcaagcacaaggctggtctcatccgaaagtacgacctcaacctgtgccgtcagtgcttccgtgagtaggccaaggatatcggcttcaacaagtaccgataaacgatcatgacacccggttttctcggttaagggatgggggggactgctagagagcatagtattgtgcggatggggagaactctcagcagaacgtcaaaggcctcgcggtaaaaaaagagcactcggagggcggccgcttggaacagg

SEQ ID NO: 1582 - DNA, 438 bp, Cicer arietinum
cacgaaagcgtctggaactcccgcccccgaaactacggcaagggctctcgcagctgccgcgtctgcaagcacaaggctggtctcatccgaaagtacgacctcaacctgtgccgtcagtgcttccgtgagtaggccaaggatatcggcttcaacaagtaccgataaacgatcatgacacccggttttctcggttaagggatgggggggactgctagagagcatagtattgtgtggatggggagaactctcagcagaacgtcaaaggcctcgcggtaaaaaaagagcactcggagggcggccgcttggaacaggagttttatggcttgcttgggtccctcaggaagatcgtgcgtctgacgaaaatcctccgaggatagacgaataccattgcattggacctcgatcatgtctatgtgtcctgtcttatcctcccacctt

SEQ ID NO: 1583 - DNA, 360 bp, Cicer arietinum
accatacacatgtttgattcatgtggtggaaatgctagatgctcaataagaagtttggagcaggtccaggttgagttgtttggcaaccaaatatgtggtggttcaagtgtgagcatatatcagtatgcgatggtgctagtctgttgtaacaatggcaatgaagaatcatggctctcaagatcactgtttgtgatcggtggttatgtgcttttatgcattgaagatatcaagcaactgtattcattttcatcagatgcgactgtgtctccatattacagaatcgattcatgctgctccattgttgacattaatgagatggtgattggggctggtgacagctgctgtgttactttaggtctg

SEQ ID NO: 1584 - DNA, 313 bp, Cicer arietinum
cgcattttggacagaaaccaaactcaccacaagccgctgacggtcaagtgggtattcaaggtcaagaagaacgaggaaggcggcctggacaaattcaaggcgcgtctagtggtcagaggctttgaacagcagcctgggtttgactatgatcagacctttgcctctgtcgctaaagtggcgacgtggcggatcctcctcaccgtggcagcctgcctcgactgggagattgagcagatggacgtttccacggcattcctggaaggggatctagatgaagatgtctttattgaaatgccggaaggactcgtcgagt

SEQ ID NO: 1585 - DNA, 321 bp, Cicer arietinum
gttcttaagattttcggggagtatagtcttactgacttcatttggcctttgaaaaagcttaaggttgggaaatatgagaagaagattgaggaaatttttaacaggtttgaccctgtcattgaaaaggtcatcaagaaaagacaagatgttaggagaagaagaaaggagagaaatggtgaacttgaagagggtgagcagagtgttgtttttcttgatactttgcttgattttgctgaggatgagaccatggagatcaaaattaccaaggaacaaatcaagggccttgctgtggatttcttctctggaggaacagattcaacc

SEQ ID NO: 1586 - DNA, 197 bp, Cicer arietinum
actggtggacgatcatctgtcagtggtattgttgctacagtatttggggcgactggattccttggtcgatatgttgtccaacaacttgccaaaatgggatctcaaatcctagttcctttccgaggctctgaagattgtcctcgtcatctcaagctgatgggagatttaggacaggttgttcccatgaaatacaatcc

SEQ ID NO: 1587 - DNA, 133 bp, Cicer arietinum
actcattacctccaagaggcacctctctactcgtagccagctctacagtagttgtcggtgaagcacgtcccattggacatcaatacagctgatctcagcagagcttccctccagcaacgcttctatctagttc

SEQ ID NO: 1588 - DNA, 439 bp, Cicer arietinum
aagacgaccagcgccttaggcaactaaattaaggcctgatcaaattccccatttaccttgtcattagcaggaatcctgcaatatacacctgatattccttcttggaacttttccagatcctcaaccaccatataatgaaagtggatgagacatagactacaatatcacacagaacgtctgtctatattcgccttacgtcgagcaaaacgttgccgcctcatcgatgcaaaagtatcgcgttagaaaaaacactaccgacgataagatagttgagaaatgcaacacagtgaccaaacagtcttgctccccaccaatgtggcattcctataacaacgcggacattccaaatgataattacctcgccctcgtcgtggacatggaccgttcgagtggctcggtgtggtttgtggaacgaacgactagagaatatctggatatg

SEQ ID NO: 1589 - DNA, 402 bp, Cicer arietinum
actgaatgtttaaaaaatattggatagtttcttttttccccgagaacccaactaattaatttctttacaacaagaagcgctcttgctcagagtcacagatgccagagtaacttcgaagaagcatctcacattgtatgaacactatctggatttctaaaaaccgtctaatgtatgcctttgatgaataaaactcatttcttcaaattgattggtataggatgtgcttctgtgttaaaaacaaatttatccaatggaatatgggagctatctccaaaaagcaagtataaatacttaagtgtttctcctagaaagaaagtctccattttatctcgtttaggaggaggaatactagttacatcgtccaaagaacaatatccaccagtatcaacctttgtgtacctg

SEQ ID NO: 1590 - DNA, 437 bp, Cicer arietinum
acgccgaggaggataaggctacccgcgagcgcattgaggcccgaaacggccttgagaactacgccttctccctcaagaaccaggtcaacgacgaggagggtcttggtggcaagattgaggaggaggacaaggagactatcctcgaggccgtcaaggagaccaacgagtggctcgatgagcacggtgctgacgctaccgctgaggacttcgaggagcagaaggagaagctttccaacgtcgcttaccctattacctccaagatgtacctgcccgggcggccgctcgagcgtggtcgcggccgaggtacgaccacgacaaaaacggcctcatctcgactgaggaacttcacttggcgcttaaccgcctcggaatgaaatgttctgttgaggaatgccgtgatatgatcaattccgttgattctgacggtgacggcagcg

SEQ ID NO: 1591 - DNA, 425 bp, Cicer arietinum
accatttcgacccagcggttttgtctagtggtctcagccagtgagacaaattgtcgaagcccggtcgtgttctgggcggcagccgaggctgcaaagaagaagaggttctctgggcagttctttttgcaaattgtgttgtgagtgattttatctttgtcttttgagaatatgtctggctgcaactgtggaagtagctgcaactgtggtgatagctgcaaatgcaacaagaggtctagtggattgaactatgccgaaggcggcgaaaccacagagacggtggttttgggcgttggtccgacgaagattcagttcgagggagctgaaatgagtgttgcagctgaagatggtggctgcaagtgtggatcaagctgcacatgtgacccttgcaactgcaagtgaggtgcatatagcaaatgaaagcttga

SEQ ID NO: 1592 - DNA, 418 bp, Cicer arietinum
acctggtggaaaccttggaaatatttatgctttttataaagggtttcagatgtgtaaagagttaggtcttgtggataggattccaaggcttgtttgtgctcaggctgcaaatgcaaatcctttgtatttgtattttaagtcagggtggaaggagtttaagccggttagggcacaaactacttttgcatctgctattcagattggtgatcccgtttctattgatagagctgttcatgctttgaggagctgtaatggaattgttgaggaagctactgaggaagaattgatggatgctatggctcaggctgattcgactggaatgtttacttgtcctcacactggtgttgctttgactgctttgtttaagctgaggaatagtggggttattaagcctactgataggactgttgtggtgagt

SEQ ID NO: 1593 - DNA, 313 bp, Cicer arietinum; identical to SEQ ID NO: 1584

SEQ ID NO: 1594 - DNA, 458 bp, Cicer arietinum
gattcccagagttcgacattgtttccaacgctagttgtaccaccaactgccttgccccacttgctaaggttatcaatgacaggtttggcattgttgagggtttgatgaccaccgtccattccatcactgccactcagaagactgttgatgggccatcagccaaagactggagaggtggaagagctgcctcatttaacatcattcctagcagtaccggagctgctaaggctgttggcaaagtgcttcctgttttgaatggaaaattgaccggaatggcattccgtgtcccaactgttgatgtctcagttgttgaccttacagtgaagcttgagaaggccgctacctacgacgaaatcaaggctgctatcaaggaggagtctgagggcaagttgaaaggcattctcggatacactgaagatgatgtggtctccaccgacttcattggtgatactaggtca

SEQ ID NO: 1595 - DNA, 251 bp, Cicer arietinum
ctcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtgggatcggtagcgacatccttccgatcaacgacgccgattgcgatgggattttctcctttgaaggtaagtcgcaccgacgggctctgattcct

SEQ ID NO: 1596 - DNA, 392 bp, Cicer arietinum
cagcactaaacaaacaactctacttcatcatccactaccttgcctcttatccagatccatcactcgatctccatcagtcatccaagatgcccgccgccatggaacccactcagcaagcccccatgacctctgacaacggagacatcgtcacacagcagcctagcgctgaacctcagcctgatatgaccatgcgtggtggtgaggaggctggctgtgagatctgctgtggtctctgcgcctgcgatgagggatgctgctaagcagacagcctcacgtagagtgttctgagtagaatagactgctcgggatggagtttgggtagcattgttatcgtgaattagcaactcctgtctggatggttgatccagtggagcaataaactacattcatgc

SEQ ID NO: 1597 - DNA, 258 bp, Cicer arietinum
acgtatgagagacgaatccttgagattaatgggaaaagggtcaaggtggtaaagcctgccaccaagacttcttttccagctacagaaattcgtggtagttatgcccctccgtttcatgtggagctttacaggaatgatcaacaccgtctaaaagtagtagtggacagtgagaatgtagctgacttgatggtgcagtcccgacacattcgggatgttattgttcttgtgattagaggacttgctcaacgattcaacagt

SEQ ID NO: 1598 - DNA, 440 bp, Cicer arietinum
acaactggaactcgagatcctataacttctgcattgcatattgtcctcggtaaaaaggtgcaccttgacatagctcaagttgtgcgatggaaaacaactcctagatccgaggttgaaccttttgtgcgctatgcagcttccttttcagggtatggattttatggtgatgttatcacagagagtgagaagtatcgctggatgggtccgaaacgttatgattatgctggaactatggtatttttaaagcacaggtcatatgaggcagaaatatcatacctagatgttggattagaggaaaccaatttgacttccaaaaggaatcgtgaaagtagcctgttacagtcattgaaagctcaacgtagagcagaaagatgtatctgccgtattaattgcaaagtttgtaatgaaaagccaaacaatgcagccactgaaatttgctg

SEQ ID NO: 1599 - DNA, 436 bp, Cicer arietinum
acaactggaactcgagatcctataacttctgcattgcatattgtcctcggtaaaaaggtgcaccttgacatagctcaagttgtgcgatggaaaacaactcctagatccgaggttgaaccttttgtgcgctatgcagcttccttttcagggtatggattttatggtgatgttatcacagagagtgagaagtatcgctggatgggtccgaaacgttatgattatgctggaactatggtatttttaaagcacaggtcatatgaggcagaaatatcatacctagatgttggattagaggaaaccaatttgacttccaaaaggaatcgtgaaagtagcctgttacagtcattgaaagctcaacgtagagcagaaagatgtatctgccgtattaattgcaaagtttgtaatgaaaagccaaacaatgcagccactgaaattt

SEQ ID NO: 1600 - DNA, 334 bp, Cicer arietinum
gaaaatattgtttctgagcatggagaaaaggctccgaatgttgtctataaagggaaacttgaaaatcaaatgcgaattgctatcaaacggttcaacaaatcagcatggccagatacccatcagtttttggaagaggccagagctgttggtctgataaggagccaaagattggcaaatctgcttggatgttgctgtgaaggtgatgagaggttgctcgtatcagaatatatgtccaatgatactttggcaaagcacttgttccattgggaaactcaaccgatgaaatgggcaatgcgacttagagttgctttacaccttgcccaagctctagagt

SEQ ID NO: 1601 - DNA, 287 bp, Cicer arietinum
gctgaaaatcgtaaggattgggtatcctaatgctgacagatgaaaatgaaagaaatcacaaaagaaatctcaaacggccgtagcaaactcctccgcaaactaacaaagctctccccccttcccctatcctttctcaaattggtatcacaaaagaagttcgcccgtgtagttcatcgtctaaactctcgtcgtcctcatgtgagagtgtcctcggcgcttcgctcggcctcccttcgaaccgcaatagccgcaggtaaggaagcggaccagaatcgagcagaaagcta

SEQ ID NO: 1602 - DNA, 214 bp, Cicer arietinum
ggaagtggcgtctcaacactgcaggaagttgtcgttgaaactggcgaagaaaatgaggaagtagttttcaatgcatattcagtattgtttgaatttgcagacggtggttggaaggaacgtggaaagggagaggtgaaagtcaatgtaactagtggaacagaaaagaaagcaagagttcttatgaggtctagaggaaattacagactgattttaa

SEQ ID NO: 1603 - DNA, 427 bp, Cicer arietinum
caaaatcttagccttgtctaagagctcaacaatcacaaccaaccgaacgggtacacaaagcacctacatcacctactacatcacctttcaaatattcacaatgggcggtgttatgtcttgtatccggtcatgcctccagaccattggggacgtgatcatggcaatcataggaggaatcggccggattatcacagcaatcgtcaatggcattgtagctttctgctcgattctggtccgcttccttacctgcggctattgcggttcgaagggaggccgagcgaagcgccgaggacactctcacatgaggacgacgagagtttatacgatgaactacacgggcgaacttcttttgtgataccaatttgagaaaggataggggaaggggggagagctttgttagtttgcggaggagtttgctacggccgtt

SEQ ID NO: 1604 - DNA, 162 bp, Cicer arietinum
actttcttagacggcacgtttgtttcgacgccacactccttatatcagccctatccggttactgtcagaaagttattttgcaacgactcctgagaattgatcaccagtatcttttgtctgtggtaattgtcaacttgtccctgcttactcattcatgcgcca

SEQ ID NO: 1605 - DNA, 368 bp, Cicer arietinum
  misc_feature (312)..(312): n is a, c, g, or t
gatttcgagcgggccgcccgggcaggtacaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgaccgnagtggggaagttgaagctgcgagagaactcgccgaaggtgcgctcggtgagccagt

SEQ ID NO: 1606 - DNA, 430 bp, Cicer arietinum
acagaatcaaaaaggggaatccctctatacccaattgataaaaaatgaatgatctaatgacaaaatcattcaccagctacgtagatctaaaaaaagcagctatgaaagatgaagttgatttagaagctggtattccaaaagaaggtgttaatgttgaattaacatcttcaataacccatttggaaaccgatatgaatttgttcttagaagaggcagagaaagtaagaacagaaatgggtcaaattcgcgatatcctaacaaagcttgaacaatcaaatgaagagagcaagtcacttcacaaaacggaagctttgaaatcattgagggaaagaattaacactgatattgtaactgttttgaagaaagcaaggtgtatgaggactcaattggaagaaatggatcgtgctaatgatgctaatagaagactctc

SEQ ID NO: 1607 - DNA, 440 bp, Cicer arietinum
gactctcttaaggtagccaaatgcctcgtcatctaattagtgacgcgcatgaatggattaacgagattcccactgtccctgcctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacattgtcaggtggggagtttggctggggcggcacatctgttaaaagataacgcaggtgtcctaagatgagctcaacgagaacagaaatctcgtgtggaacaaa

SEQ ID NO: 1608 - DNA, 315 bp, Cicer arietinum
gatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaagcgcctttgtgccgatgatatgctggatgaactagatagaagcgttgctggagggaagctctgctgagatcagctgtattgatgtccaatgggacgtgcttcaccgacaactactgtagagctggctacgagtagagaggtgcctcttggaggtaatgagt

SEQ ID NO: 1609 - DNA, 433 bp, Cicer arietinum
taataatatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttc

SEQ ID NO: 1610 - DNA, 341 bp, Cicer arietinum
actggctcaccgagcgcaccttcggcgagttctctcgcagcttcaacttccccactcgtgtcgaccaggacaacgtctctgccaagtttaaggacagtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgtaggcctggcttggtcattcgctccttgt

SEQ ID NO: 1611 - DNA, 393 bp, Cicer arietinum
acgctagacactaccatgctcactgacctacagaatttgtgtccccaaaatggagatggaaatgcaactgctgttcttgataggaactcaactgatttatttgacaatcactactttaagaacttgctcaatggaaagggccttcttagttctgaccagattttgttttcttctgatgaagccaattcaactactaagcctttagttcaaagctatatcaacaatggttcacttttctttggagactttgtcaagtctatgatcaggatggggaatataaatccaaaagtggggtctgatggagagattaggaagagttgcagagttataaattcatagtgatgtgcattaggctttgcaaaatactagtatatgaaataagtggaagattaa

SEQ ID NO: 1612 - DNA, 333 bp, Cicer arietinum
  misc_feature (136)..(136): n is a, c, g, or t
cctgggccgactctgattggaaaggcgacaatttcacgggaagatcgacgtttggatggctcgttcagcttgaagaatctacggtctcatggagagcgaaacgacatgaaacagtagcactctcaactaccgaggncgagtatactgctctatcacaatgcgccagagaattaacatggattcggaatctgttctcagaactacaactatcactagacattccgatccttttgaatggcgataatcagggttctctgaaactctgcagaaatcccgagctacatcaacgaacaaagtatatccctttagtcgaacaccacatacgagaggaaa

SEQ ID NO: 1613 - DNA, 431 bp, Cicer arietinum
ggaagtgtcgtctcaacactgcaggaagttgtcgttgaaactggcgaagaaaatgaggaagtagttttcaatgcagattcagtattgtttgaatttgcagacggtggttggaaggaacgtggaaagggagaggtgaaagtcaatgtaactagtggaacagaaaagaaagcaagagttcttatgaggtctagaggaaattacagactgattttaaacgcccggctttaccctgaaatgaaactcacaaatatggagaagaaaggggttacctttgcttgtgcaactgaagggaaagactgtctttcgacatttgcattgaagttcaaagatgggtccatagtggatgattttaagactgctatcacagcacataagggtgaggcggcgtatccagttatcaagaccccagaaaattctcccaaggcttgtga

SEQ ID NO: 1614 - DNA, 441 bp, Cicer arietinum
actcctccagtagaattttatgtgcagattgatactggaagtgatgttctttgggttagttgcagctcctgcagtggatgtccacagacaagtggactacagattgaactcgatttttttgaccccgagcgttcatcaacgtcgtctttaatctcttgttccgaccggaggtgcaacagtggaatacaatcatcagatgcaagttgttccactcagaacaaccaatgctcttacactttccagtatggagatggtagtggaacatcaggctattatgtgtcagatatgatgcatttgaatactattttcgagggatctgtgactgcaaattctacagctcctgtagttttcggttgtagtaaccggcagagtggggacttgacaaagtctgacagagcagttgatggtatattcggattcgggcagcaggaaatgtctgtc

SEQ ID NO: 1615 - DNA, 443 bp, Cicer arietinum
actaccttgatccagaattccaagatcttggtaaggaagccaattaaaggacaagaaaacgttgtggtggaagatgactcatttcaaaaggacaccgcacactcgaataattctccaaaattgttccatcatgtcaatcattgagctatatccttatcgatttacagtgaagacttacttggcaaggcaatagatggctttttgagaggtggattcattaataattattttgattattttattcaacgagatggatatatgatatggaaaattaatgaaacaaacactgaaaactcttacttcgctcagttttacaacattggatatggtgtcaatgctacaacaagaattaaatggacaaacgatgtcattactaaagatgaagctattagattcactgctcaatcgtggcttaatgccagcacttggttgcctttttttat

SEQ ID NO: 1616 - DNA, 440 bp, Cicer arietinum
acttacaatggggaggatgttgccatcaaaatcttggagaggcctgaaaatgatacagcgaaggctcagttgatggaacaacaatttcagcaggaggtcatgatgcttgctacactgaagcatcccaacatagttcgtttcataggtgcatgccgtaagcctatggtgtggtgcattgttactgagtatgctaaaggtggatcagttcggcagttcttaaccaagcgccaaaaccggtccgttcctctcaaactagctgtcaaacaagccttggatgttgcaagaggcatggcatatgttcatggtctgggattgatccatagggacttgaaatctgacaaccttttgatttttggtgacaagtcaatcaaaattgctgactttggagtcgcccggattgaggtgcaaactgaaggaatgacccctgagactggaacata

SEQ ID NO: 1617 - DNA, 329 bp, Cicer arietinum
acctggggggctgataattcaaataataattctaattcgatagtattttcttcaaataataagcgttctagaaatgacaacaacaataacaacgacgacgaagatcccgaccttcttctacattgcctcaatgccctcgaaactcagtatagtctgccacaaacatctcttgaaatggcaagcgttgacaagctattgcatattccacaagattccgtcccttgtaaaattcgtgccaagcgtggctgtgccactcatccccgtagtattgctgaacgggagagaagaactagaataagtggcaagttgaagaaattacaggaccttgt

SEQ ID NO: 1618 - DNA, 341 bp, Cicer arietinum
  misc_feature (327)..(327): n is a, c, g, or t
accgaggtagccctgatcaccgacaccgccacagttgatgatgataccgaggatgatgaatcccaagcaagcgcagatcttgatggcggacaggacgaattcgacctctccgtaaccacgaacaccaaagatctgaacaatggtgagagcgacgaggaagacagtaacccaaacagccatgtggatgtcagtgcgccagaactcaatggtctttgacgcagcgatcaactcgaaggggagaaccgtgagccaggacagagcatattcccaaccgcaggcgaagccccaggagggatcgacgaagcggacaatgtaggtgtagaaggnaccgttgacggggt

SEQ ID NO: 1619 - DNA, 190 bp, Cicer arietinum
ccgggctggtccctccagcctcctataccttggcgcagtttatttgccgcagttcttgcaagagcagctctggccacaggagcaagagctaggaccgccgcagttacaagtagatccacaatcgcaagccatgatgacagacgtaaagttatagagttgtatgtgacgagatagtgacttgagaaatttg

SEQ ID NO: 1620 - DNA, 378 bp, Cicer arietinum
acccccgtggacacgtgtttatagagttcagcgggatattccgatgccattggttacctctggagttgagaaagggaatctaagggagctagcattagcacgaatggaagacctgggattaaaatgtcgtgatgttcggaccagagaagctggaatccaggatattcatcaccaaattaagccagaagaggttgaacttgttcgtcgtgattatatggcaaatgaaggttgggaaacatttctgtcatatgaagatacacgacaagatatcctcgttggtttgttgcgactgagaaaatgtggccggaacactacttgtccagagcttatggggaaatgttctattgttcgtgagcttcacgtttatggaactgctgt

SEQ ID NO: 1621 - DNA, 350 bp, Cicer arietinum
ggccgaggtactggttcaccgagcgcaccttcggcgagttctctcgcagcttcggcttccgcgctcgtgtcgaccaggacaacgtctctgccaagtttaaggacggtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgtaggcctggcttggtcattcgctccttgt

SEQ ID NO: 1622 - DNA, 429 bp, Cicer arietinum
cgaaagacatcgtcaatcaagatgagagccaaatggaggaagaagcgggttcgccgcctcaagcgcaagagaagaaagatgagggctcgatccaaataaacacctcgcacctcaacctgacttgactcatctttcatgatgttacgacttcacacgcacaacgatactctggccgaagctgcgaacgctactctggcgcctatgggatgtcccgcaacgtactgagctgggatttgacttcgggaactacgtcacggtggtggaaccccgcacttgagcggctgttgggcactcaatgaacattatgggaatggggattatgacaattggacggtcgggaaccaggcggtgttaggatcaaagaccatcagtcatgctcgcaaaagacgatgcagcgagaacttgattggcagttctaagacaaagaaa

SEQ ID NO: 1623 - DNA, 453 bp, Cicer arietinum
actagtgattggtttcgaatcagtcgatggttctagaaagcaggtttctggaacaaacaaactacgttctggaaattattgggaaggagcgccaattatttgagacttcacaacaacaatgccagtataacttacaagaaaaaataaatcaacagtccatagaatacaacaaattgacaactcaaatcgaaggacaaaataaagacatacaagaaatcaaacaatttttaaaattattggtccctagaatagttggaatcgaagcatcctataaagtactttcaactgaaaatccgataatggaaagccaacaaaaaccaagaccaataaaacggaaaaaacaaagctagagctccttgccttttcgggaatgtgaaagcgattttaagtttctgcctttgctcacatgacggaatctaaaatttgtgtgttgcagatttaatttcttttttt

SEQ ID NO: 1624 - DNA, 308 bp, Cicer arietinum
aaaattaccaaggaacaaatcaagggtcttgttgtggatttcttctctgcaggaacagattcaaccgctgtggcaacagattggtgtttatcagagctgatcaacaacccaagagtgatgaagaaagctcgagaggaggttgactctgttgttggaaaagatagactagtcgacgaatcagatattcaaaatcttccatacattagagccgtcgtgaaagagacattccaactgcccaaacattgaaaagtacagaagagtgtgagattaatgggtatgtaatcccagaaggagcatgtaccctgggc

SEQ ID NO: 1625 - DNA, 174 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaag

SEQ ID NO: 1626 - DNA, 423 bp, Cicer arietinum
gctgctgaaagagaagtcggagaagaaccctagcttcacttggtcatcattcgtgaatggcgccttcttggatagggccttagctctctttccagagtttggttttgacgtgaagaatcacttagcgaacattattgactcgggaaatgagcctttcaccgcaatgtcaattggtaacattgggcaaccggtagctaggttgcttcagaatccggaagacaccaaaaacaggcatgtccacatctctgcgccggtaacttcgcaaaatgaaatcctcgcgacactcgaaaagtttacgcagaagacatggagtacaaggaagttgagctcaagtgatgtgaaaagagacgcagaaagcaagttgcgcgatggggatttcaagggagcctatgttggcctactggtagttcagctttttgaaga

SEQ ID NO: 1627 - DNA, 352 bp, Cicer arietinum
accaagggcatctcatctatgtcaggcctatcctcatggttttctatccaagttacagcagcctcaagactagcgttaccagaaaaatgaagcgctcttgttgccctcgctgttgaaaagcccatcgattcaagttcctcaagcagatttttgtcaacttcaggaacaaccatttcttcattttggtcagtggttccaccctcttgagattctgaatcacccttaggaacctctaaacttattggttttgctgcttcggaagtcttatcaacaaactcagtgtgcccagttctcttggtgtgtaaatcactctcggttttggatcggcatggtttggagcaagtggtgcaga

SEQ ID NO: 1628 - DNA, 346 bp, Cicer arietinum
actggctcaccgagcgcaccttcggcgagttctctcgcagcttcaacttccccactcgtgtcgaccaggacaacgtctctgccaagtttaaggacagtatcctgagcattgttgttcccaaggccaagaagcacgagtctcgccgcatcaacgtcgagtaaacgcgacaacacaccacaacccggaatcttgacgaccttattatccagctctcagatttcacgacaaatcaagatcagtaatgactcatctttacgactttagcattgcatggatcggtgttgggaagtttcttagcatgaaatagcattgtaggcctggcttggtcattcgctccttgtacctg

SEQ ID NO: 1629 - DNA, 319 bp, Cicer arietinum
acgttgcagatgagcaaaatcaactaaagttgcagattaatgctcaaaattgtttacattgcaaggcttgtgatatcaaagatccaaagcaaaatattgagtggacagtgccggaaggaggtggaggtccgggatactcagtcatgtagatccaggaatcagtcatactgtggtccctgaagttacgacttccggaatgtaaaataagttgctaaggttcctcatcttaaacaacaacaagcatcttacactgttctgttagaaattatgtctgttcagtgtttttcgcattttaaatattctgtgtcatgtaccttgg

SEQ ID NO: 1630 - DNA, 301 bp, Cicer arietinum
aaaattaccaaggaacaaatcaagggtcttgttgtggatttcttctctgcaggaacagattcaaccgctgtggcaacagattggtgtttatcagagctgatcaacaacccaagagtgatgaagaaagctcgagaggaggttgactctgttgttggaaaagatagactagtcgacgaatcagatattcaaaatcttccatacattaaagccgtcgtgaaagagacattccaactgcccaaacattgaaaaggacagaagagtgtgagattaatgggtatgtaatcccagaaggagcacttgt

SEQ ID NO: 1631 - DNA, 436 bp, Cicer arietinum
actcgacctcagggaaggactcgtgactacacatgggtgcaggcactcgctgtcatgttcgacgtgcacactcttgttattgcagccaatagagtaaatcaatggaatgaaagtgttgactctcttacagtgaaatgggatggtgaatcagtaaccattcctattgatggtgaggctgaatggaagactaataccgacgaaagagaagttgttgttgaaagaacagatgataccaacagtgttagagtcacaatttctggtttacttgaaatggatataagggtgaggcctattggagaaaaggaaaacaaagctcacaattatcagttaccatcagatggtgcttttgctcatttggaaacacagttcaagtttaagaaacctacagattttattgaaggagttttgggtcaaacttataggccaagctatgtta

SEQ ID NO: 1632 - DNA, 403 bp, Cicer arietinum
actgtagcccaactcgttgtcataccatgagacaagcttaacaaaccggtcatttaaggcaattccagccttggcatcaaagatacttgacctagtatcaccaatgaagtcggtggagaccacatcatcttcagtgtatccgagaatgcctttcaacttgccctcagactcctccttgatagcagccttgatttcgtcgtaggtagcggccttctcaagcttcactgtaaggtcaacaactgagacatcaacagttgggacacggaatgccattccggtcaattttccattcaaaacgggaagcactttgccaacagccttagcagctccggtactgctaggaatgatgttaaatgaggcagctcttccacctctccagtctttggctgatggcccatcaaca

SEQ ID NO: 1633 - DNA, 403 bp, Cicer arietinum
tgttgatgggccatcagccaaagactggagaggtggaagagctgcctcatttaacatcattcctagcagtaccggagctgctaaggctgttggcaaagtgcttcccgttttgaatggaaaattgaccggaatggcattccgtgtcccaactgttgatgtctcagttgttgaccttacagtgaagcttgagaaggccgctacctacgacgaaatcaaggctgctatcaaggaggagtctgagggcaagttgaaaggcattctcggatacactgaagatgatgtggtctccaccgacttcattggtgatactaggtcaagtatctttgatgccaaggctggaattgccttaaatgaccggtttgttaagcttgtctcatggtatgacaacgagttgggctacagt

SEQ ID NO: 1634 - DNA, 414 bp, Cicer arietinum
acagagcttacctggagaccgtggaacgaggcgactgcctcggccggggaggggcgttctagccgccttgggtttttccctgcgaggggtttccccaaggatgtatggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatacgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatga

SEQ ID NO: 1635 - DNA, 180 bp, Cicer arietinum
gatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaagcgcctttgtgccgatgatatgctgg

SEQ ID NO: 1636 - DNA, 318 bp, Cicer arietinum
actgttggcattggaagctcggcatgggaccgattgaccaaactccctcggcctaacgagctacatcctttcaaagagttcaaggggtcaaagcatactgctgtgtcaacgccaggtgatatcttctttcatattcgatcggagaggcgagatatggcattcgaatttgagagacaactcatggatagactgggtgatgctgtcaagctcgaagatgagacagttggttttaggtatttcgatacgcgcgacgtccttggatttgtcgacggaactgccaatccagtcggccccgatgtcaaggactcgtaccttggc

SEQ ID NO: 1637 - DNA, 324 bp, Cicer arietinum
actatgatgaagcccttgtgtcacaggagaggcaagaactcggccgcgagctaagaagtgagctcttgacagttgaaaagtttgtgctggtgattagtggacatgagaaacttcagcagaataataggagcttgaggaggttggttgagaatagacttccatttctcaatcctatgaacctgttgcaggtggagatactgaagaggttaaggcgtgatgatgacaaccttaaactcagggatgctttgcttattactgtgaatggtattgctgctgggatgaggaataccggttgaagttgcttctcaacaactacaataatgt

SEQ ID NO: 1638 - DNA, 439 bp, Cicer arietinum
acaaacgtcttgcaaagatatggagcaaaatgaaaggactaaaaattccaaagaagggagacatgagtgccttatcccgaaatatgaatgcccagcacatgagcaaaatcctccctccacagatgctaaagcaaattggaggtatgggtgggttacaaagcttgatgaaacaaatgggatctactaaggacatgatgggaatgttcggtggtggcggggataactaaattcttagtggcatttgagctgaggtttttgtttatgataacttactcttatgcctttataagagttagattcatcatttcttctagctgcagaaatctcaatgggtggaatagttcattaccttggcttttttctttttgtgtaaaactatacttttgtccctatttctgttgtatatttattagtcttaagatacagtcaaagaatttgt

SEQ ID NO: 1639 - DNA, 324 bp, Cicer arietinum; identical to SEQ ID NO: 1637

SEQ ID NO: 1640 - DNA, 436 bp, Cicer arietinum
gggtggacgtggtggtttacaattgggttcagtgtatcaaccttcacagcatattggattggcagtttctgattcaaatttgggtatgttggctgctcttaatgcttacacaagagctgcagctggtgctactgatttcaatgttaatgttaattctgataatcatcatcaccatcaccatcgacatcaacatcaacatcattctatttcattggattcacaatctcattctcattctcattctcattctcatcctcaacctactgaaagtgaagaagatgctcctgatacctctcaatgattcattactacttcataatattgggttctgtgttgaatttcttataacttattgctttttggaaattcattccatggattcatatgctagctgtgcatgctcaaaggacttgagtttttcatagatgttgcatta

SEQ ID NO: 1641 - DNA, 325 bp, Cicer arietinum
actcgcttttccttcagtggcatgtttcataacacattgtggttggaattcatcattggaagcacttactttaggagttccaatgttgacttttccagcatggggtgatcaagttacaaatgcaaagttcttggcagatgtttttggagtaggtattcgattgggttatggtatggctgcaaataagttggtaacaagagatgaggtgaaaaagtgcttattggaagcaacgtcaggggaaaaatcataggagttgaagcaaaatgcgatcaagtggaagaaggtggcggaggaggaaatggtggacggtggatcctctgaccgg

SEQ ID NO: 1642 - DNA, 427 bp, Cicer arietinum
acaacaaccttttgctattggaggatctgggtccagttacttatatggattttttgaccaagcttggaaagatggaatgaccaaggacgaagctgaggaactagtcaaaaaggcagtttcacttgccattgctcgtgacggtgctagtggaggagttgtccgaacagtcataataaactcagagggagtgaccaggaatttctaccctggagatcaactgccgatatggcacgacgaactggagtctcataactcattgctagacattcttggtgccccagagccaatgaacatatgaagttgggactaaagagtcatcggctagattatatcccgcgctgtcagccctttctgtgaactattttatcgaatttgtgtaatcgttatattgttcggttagatattggttgttattatatatcctcat

SEQ ID NO: 1643 - DNA, 432 bp, Cicer arietinum
acatgatcggtcaacatcccggttccgatgacaattctcgtccaccttttctccgtcgaacccgccgcaacggaggtgaccggtcacctttcaatccggtgatcgtcctacgcggaagtggatcaacggaggtaacagaaggtggtagcacaggagagagtcgtgggtttgagcttttctatgatgatggtgctggttctggtcttagacctttaccaccaagtatgtcagagtttcttttgggatctggatttgatagactgttagaacaactttctcagattgaaatcaacggtattggaagatatgaacatccaccagcttcaaaaacagccgttgattcattaccaactattgaaatcaatgggtgtcatttggatatggaatcacactgtgcagtttgcaaagaggcttttcagttaggtacctgcc

SEQ ID NO: 1644 - DNA, 118 bp, Cicer arietinum
acctaactgaaaagcctctttgcaaactgcacagtgtgattccatatccaaatgacacccattgatttcaatagttggtaatgaatcaacggctgtttttgaagctggtggatgttca

SEQ ID NO: 1645 - DNA, 315 bp, Cicer arietinum; identical to SEQ ID NO: 1608

SEQ ID NO: 1646 - DNA, 324 bp, Cicer arietinum; identical to SEQ ID NO: 1637

SEQ ID NO: 1647 - DNA, 454 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaattgaaaatcaccattaaagaatgttactcaaaaaactattgttaatatgccttcatcaccatatcaatcaacattagatgcac

SEQ ID NO: 1648 - DNA, 439 bp, Cicer arietinum
gagtaaactaagttttcaactcaacaagaacaaatcatggcattgatggcagcaacagcaagctcagcaactgttgttaaacaatctcctttccttggacaaaggaaaggtgccagtgccaatcctcttagagatgttgtctccatgggaacttctaaattcaccatgggaaatgaattgtggtatggaccagacagagtgaaatatttaggacccttttcagctcagacaccttcatacttaactggagaattcccaggagattatggatgggacactgctggtttatctgctgatcctgaagcatttgccaagaacagggctcttgaggtgatccatggaagatgggcaatgctaggagcactaggttgcataacaccagaagtgttagaaaaatgggtgagagttgacttcaaagaaccagtttggttcaaagcag

SEQ ID NO: 1649 - DNA, 440 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatc

SEQ ID NO: 1650 - DNA, 238 bp, Cicer arietinum
cacgttagctgtccccttacacaataatgtcatcatctctggccacttcgccacagtgaaatcaaaacttacaactaactctgaaatttccatggctcgttgaaatcgaattgattaataaaggaatcaagtcgaagcgttaagcattaattaaacggcatgatgacactagcttatggggaatgaatgggaaatggatttagtgagagagaagagaaagtggcaggcatgtacacgt

SEQ ID NO: 1651 - DNA, 410 bp, Cicer arietinum
acaaaggagtcgaccaagtcgtggaggttgaagtagctggacagaagctctgagagacatggttggaacgattgcggatcggaaagagggagtatgcagtaactaccccttggtcgagattttgaatatataacaggcgttttacatgacccgacagcctcctctcagactattaggacaaactgggcttggacactgtccgtcacgcataccattccgaagaaatagcaggccttgtgggcatacaagcaatggcggatggaagaagtgacagaattcaacataaaccagataatctttcccgcagacgtggcatgcagccgaatgctgcgtgcacatttatcgtgaactcgagcttgttcttaaagttcgattgggtgatgatcgaagtcgactattgggaaggggga

SEQ ID NO: 1652 - DNA, 434 bp, Cicer arietinum
acctcgggccgcagtcgatttgggccgagcgatcaggcctggtggcatagtcgaaagtgataagttgccttctgatgtcaggaaacgaactatggatgctgtggatgcttgtggtggtagggtgaccattggtgacgtggctagtaaggctggtcttaagttgaatcaagctcaaaaggcactccaagctcttgctgctgataccaatggtttcttagaggtttctgaggaaggagacgttttatatgtgtttcccaaagattatcgatcaaagctcggtgccaagtcatttaggattaaagctgaaccttttattgaaaaagctaagggcgccggagaatacttgataagagtttcttttgggacagcacttattgcatccattgttattgtttacactgcaataattgctcttgtaactagcagcagaagtg

SEQ ID NO: 1653 - DNA, 342 bp, Cicer arietinum
cagaaacttgagtcttctatacacaagtctttcttttttagaccaatctctacttttcaaacacattaaaaaatgggttttcgtttacctagtatcatcagaagggctgcaaaccaagcatcttctaaaggcgtggatgtgccaaagggatatcttgcagtgtatgtaggagagaaaatgaagcggtttgtaatcccaatatcatatttgaatcaaacttcattccaggaattgttgaaccaagctgaggaacaattcggatatgagcatccaacgggtggtctcacaattccttgcagagaagacgttttcttagatattacttctcgtttgaatttttgc

SEQ ID NO: 1654 - DNA, 436 bp, Cicer arietinum
gactctcttaaggtagccaaatgcctcgtcatctaattagtgacgcgcatgaatggattaacgagattcccactgtccctgcctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacattgtcaggtggggagtttggctggggcggcacatctgttaaaagataacgcaggtgtcctaagatgagctcaacgagaacagaaatctcgtgtggaa

SEQ ID NO: 1655 - DNA, 418 bp, Cicer arietinum
actggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtaggcagggacagtgggaatctcgttaatc

SEQ ID NO: 1656 - DNA, 434 bp, Cicer arietinum
cgggaccccaagccgtggaactttgaagatataaagaaccatgttgagaaatctgaccagggcgatgtagtcctcatcgacgtccgagaaccagtcgagcttttcgagacgggcaagatccccggtgcgatcaatattcctatcacatcggcagctcagagcctccacatctccgacgaggattttgaggacatgtatggcttccagagaccggcaaagaacaaagagcttgtgttttattgcaaagcaggagtgcgtgcaagggcggctgcgcaactggctcatcatgctggctggaacaagatcggcgactatgcaggcagctggctggactgggaagctcagaaaggaccagttgagaaggttaagaaaccatattgaacagacagagcttgatgaagacatccattggcagaatggttggtcaaataaaa

SEQ ID NO: 1657 - DNA, 423 bp, Cicer arietinum
gaatgagggtgttgctgccttctataagggtctatcagctgggttactcaggcaggctacatacaccactgcccgacttggaacatttcgaatcttgacaaataaagcaattgaggctaatgatggcaagcccctgccactttaccaaaaagctctgtgtgggctgactgccggtgctattggagcaactgttggtagtccagcagatttggcactcattcgtatgcaggccgatgcaacattacctcttgctcagcgccggaattatacaaacgccttccaggcactttaccgtattgctgcagatgaaggggttctgtcactttggaaaggtgctgggcctactgtagtgagagccatggcattgaacatggggatgcttgcatcttatgatcaaagtgtcgagttcttcaaggataccgt

SEQ ID NO: 1658 - DNA, 317 bp, Cicer arietinum
accgttgtttcgttggtggtctagcctggaccaccgacagcgacgccccagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggctggatatggtggtggacgtcgtgaagg

SEQ ID NO: 1659 - DNA, 294 bp, Cicer arietinum
accgttgtttcgttggtggtctagcctggaccaccgacagcgacgccccagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtaccggtggtggaggcggccgtggtggcggtggatatggtggaggcggtggat

SEQ ID NO: 1660 - DNA, 145 bp, Cicer arietinum
accgacgaaatggtgtatgggctgtcccttgatagagaatcttgactggttatcattgatcatgacacccctatctgtgttgatcctaagaagatcacacatgttgctttcctcagacttacaatgtggacattccccacactcc

SEQ ID NO: 1661 - DNA, 313 bp, Cicer arietinum; identical to SEQ ID NO: 1584

SEQ ID NO: 1662 - DNA, 261 bp, Cicer arietinum
actccatcaaggccaagatgttgtgcctattcctggaacaacgaaaattaagaatctggatcaaaaccttggtgctttagcagtgaaactatctgaagaggatctgagagaaatttctgcagctgtagatgatgtagcaggtagtagacactacaatggactagatcacttgtcgtggtcctcgtggaaatctgctaatacacctcctaaagactcaagggtctcaacctaaaatataaatcccatttagttggagaatgt

SEQ ID NO: 1663 - DNA, 436 bp, Cicer arietinum; identical to SEQ ID NO: 1388

SEQ ID NO: 1664 - DNA, 395 bp, Cicer arietinum
acaaaatctcagccttgtctaagagctcaacaatcacaaccaaccgaacacatacacaaagcacctacatcacctactacatcacctttcaaatattcacaatgggcggtgttatgtcttgtatccggtcatgcctccagaccattggggacgtgatcatggcaatcatagcaggaatcggccggattatcacagcaatcgtcaatggcattgtagctttctgctcgattctggtccgcttccttacctgcggctattgcggttcgaagggaggccgagcgaagcgccgaggacactctcacatgaggacgacgagagtttagacgatgaactacacgggcgaacttcttttgtgataccaatttgagaaaggataggggaaggggggagagctt

SEQ ID NO: 1665 - DNA, 301 bp, Cicer arietinum
aaaattaccaaggaacaaatcaagggtcttgttgtggatttcttctctgcaggaacagattcaaccgctgtggcaacagattggtgtttatcagagctgatcaacaacccaagagtgatgaagaaagctcgagaggaggttgactctgttgttggaaaagatagactagtcgacgaatcagatattcaaaatcttccatacattatagccgccgtgaaagagacattccaactgcccaaacattgaaaagtacagaagagtgtgagattaatgggcatgtaatcccagaaggagcacttgc

SEQ ID NO: 1666 - DNA, 216 bp, Cicer arietinum
gatttcgagcgggccgcccgggcaggtacctcaatcaatctgttttagagggtcgctatatcactgtagagcggtcacggagaaagcgaccaagaactcccacacctgggcactatcttgggctgaaaaataccagagacgatggttatcgtggtgaccggggaaggcataggggtggacctggtcgtgatgattatcaatatcggaggtctccaa

SEQ ID NO: 1667 - DNA, 443 bp, Cicer arietinum
acacgaagaagaaaaggcacgcttggtcggtgatgtctttacgagtgttgctgcaaattatgacacaatgaatgatctaatgagtgctgggttgcatagactgtggaaggaaaggctagtttctatgctgaatccttttcttggaatgaagcatcttgatgtggctggtggcacaggggatgttgcctttagaatcttggacaacataaacaaagttaagcagagtgggattcgaaataggtttcaagatggtttagaggaagaaactcagatatatgtatgtgacattaacccaaacatgttaaatgttggcaaacaacgggccaccgagaagggttatggagaagatggttccctcgtatgggtggagggaaatgctgaaagcttgagtttccaaaatgattcaatggatggttacactattgcatttggaataaggaatg

SEQ ID NO: 1668 - DNA, 439 bp, Cicer arietinum
acacgaagaagaaaaggcacgcttggtcggtgatgtctttacgagtgttgctgcaaattatgacacaatgaatgatctaatgagtgctgggttgcatagactgtggaaggaaaggctagtttctatgctgaatccttttcttggaatgaagcatcttgatgtggctggtggcacaggggatgttgcctttagaatcttggacaacataaacaaagttaagcagagtgggattcgaaataggtttcaagatggtttagaggaagaaactcagatatatgtatgtgacattaacccaaacatgttaaatgttggcaaacaacgggccaccgagaagggttatggagaagatggttccctcgtatgggtggagggaaatgctgaaagcttgagtttccaaaatgattcaatggatggttacactattgcatttggaataagg

SEQ ID NO: 1669 - DNA, 143 bp, Cicer arietinum
gctgaaaatcgtaaggattgggtatcctaatgctgacagatgaaaatgaaagaaatcacaaaagaaatctcaaacgggcgtagcaaactcctccgcaaactaacaaagctctccccccttcccctatcctttctcaaattggt

SEQ ID NO: 1670 - DNA, 235 bp, Cicer arietinum
acgtggtcacgcaagagcctaaatatggtagctgtgaatttcccactgggtattaaaaactgaagagaaggtggctgattttgcattgtgtaaagttaatgcgaaggtagagtttcttgatgggtgaagctataaaggttgatgatcagtttgaatattttttcgggagtgtggattgcattagttattagtagttaaataatagtggactagcttaattttcttagagactaaa

SEQ ID NO: 1671 - DNA, 435 bp, Cicer arietinum
acaaaggaccatggaaacgaaagaaaatcaagaatcctaactacaaaggaaaatggaaaactccatggatagataatccagagtttgaagatgaccccgatctttatgtgcttaagcctatcaaatatgttggcatcgaagtttggcaggttaaaggcggttcagtatttgacaacattttgatttgtgatgatcctgattatgcaaaacaagttgttgatgaagtgtttgccaatagggagattgaaaaagaggcttttgaggaagcagagaaaataaaaaaagcccaagaggaggaggaggctcaaagagcaagagaggaaggtgagaggcgaagaaaagagaggggtcatgaccgacgacaccgggacagatatagagaccgatatagaaagcatcgccgtgattacatggatgattacgatcatgatgaac

SEQ ID NO: 1672 - DNA, 420 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaagggtgttgtcagagaaggtgaactctccaaaattcctt

SEQ ID NO: 1673 - DNA, 301 bp, Cicer arietinum
aaaattaccaaggaacaaatcaagggtcttgttgtggatttcttctctgcaggaacagattcaaccgctgtggcaacagattggtgtttatcagagctgatcaacaacccaagagtgatgaagaaagctcgagaggaggttgactctgttgttggaaaagatagactagtcgacgaatcagatattcaaaatcttccatacattatagccgtcgtgaaagagacattccaactgcccaaacattgaaaagtacagaagagtgtgagattaatgggtatgtaatcccagaaggagcacttgt

SEQ ID NO: 1674 - DNA, 430 bp, Cicer arietinum
gatttcgagcgggccgcccgggcaggtacctcaatcaatctgttttagagggtcgctatatcactgtagagcggtcacggagaaagcgaccaagaactcccacacctgggcactatcttgggctgaaaaataccagagacgatggttatcgtggtgaccggggaaggcataggggtggacctggccgtgatgattatcaatatcggaggtctccaaggcgctcaccaccatatcgaggtgggagggatatttcaccaaggcactctccctacggtggaagatataggagggacatgtctaggtcaccacctccttatccccaatatggtagcccagataggaggtatgcccgcgggccctaggtgatattttacattagtttgttttgacatttgaagagtgaaagcaaaaactgtgtaattggtatggt

SEQ ID NO: 1675 - DNA, 303 bp, Cicer arietinum
aataagattgattatgtcttagctcttgagggtgagaatttccctgagcgtcgtcttcagacacttgtttttaaatctggtatggctaagtctattcatcatgctagggttctcatcagacagaggcatatcagggttggtaggcaggtggtgaacatcccctctttcatggttagggtcgactcacagaagttcattgacttttcactcacaagtccccttggtggtggacgtcctggaagagtgaagagaaggaatctcaaggctgccgccaagaaagcatctggtggtgacggagatgag

SEQ ID NO: 1676 - DNA, 437 bp, Cicer arietinum
acacgaagaagaaaaggcacgcttggtcggtgatgtctttacgagtgttgctgcaaattatgacacaatgaatgatctaatgagtgctgggttgcatagactgtggaaggaaaggctagtttctatgctgaatccttttcttggaatgaagcatcttgatgtggctggtggcacaggggatgttgcctttagaatcttggacaacataaacaaagttaagcagagtgggattcgaaataggtttcaagatggtttagaggaagaaactcagatatatgtatgtgacattaacccaaacatgttaaatgttggcaaacaacgggccaccgagaagggttatggagaagatggttccctcgtatgggtggagggaaatgctgaaagcttgagtttccaaaatgattcaatggatggttacactattgcatttggaataa

SEQ ID NO: 1677 - DNA, 330 bp, Cicer arietinum
  misc_feature (100)..(100): n is a, c, g, or t
  misc_feature (125)..(125): n is a, c, g, or t
acgcaaatctggctaggagggctgtggaaactgatatgccgattatggttcagatgcaggaattgcttcgaggagctaagaatgctgtgtctttggctcnaggggtggtttattgggcacctccnaagcagccttggataggtgaaagaactcgtgttcgagccttctattagtcgttatggtaacgatgaaggtattcctgaactcagagcagcattagtgaaaaagttgcgcgttgaaaacaatttgcacaaatcctcagtaatggttacagcaggtgccaatcaggcattcgtgaatctagttcttactctgtgtgatgcgggggat

SEQ ID NO: 1678 - DNA, 258 bp, Cicer arietinum
accgttgtttcgttggtggtctagcctggaccaccgacagcgacgccccagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtaccggtggtggaggcg

SEQ ID NO: 1679 - DNA, 265 bp, Cicer arietinum
actccatcaaggccaagatgttgtgcctattcctggaacaacgaaaattaagaatctggatcaaaaccttggtgctttagcagtgaaactatctgaagaggatctgagagaaatttctgcagctgtagatgatgtagcaggtagtagacactacaatggactagatcacttgtcgtggtcctcgtggaaatctgctaatacacctcctaaagactcaagggtctcaacctaaaatataaatcccatttagttggagaatgtacct

SEQ ID NO: 1680 - DNA, 126 bp, Cicer arietinum
ggagtttcaggaaactatcaacacgctttactcagacgacggaactctggagccgaacaatgctctcgcggggttgatggataacctcaaaaaagtccacgacaagattggccgcacgctagatcc

SEQ ID NO: 1681 - DNA, 427 bp, Cicer arietinum; identical to SEQ ID NO: 1376

SEQ ID NO: 1682 - DNA, 436 bp, Cicer arietinum
ctctcctatctaccatttttgtttcccgaaataccctcccaaatacgtcaaattcccttcgctgccactttctgcacttccgcgttcttcacctgctccgatggaagctcctcccgaaggttaccgcaggaacgttggaatctgtctcatcaataatcacaaaaagattttcgcagcttcaaggctagacattcccaatgcttggcaaatgcctcagggtggtattgatgaaggtgaggatccgagaaatgctgctattagggaactaagagaagaaacaggcgttagttcagcagaagtgattgcagaggcaccttactggttaacttacgacttcccaccaaaagtcagggagaaattaaacattcagtggggatctgattggaaggggcaggcacaaaaatggtttctttttaagtttactggagaagatcaa

SEQ ID NO: 1683 - DNA, 380 bp, Cicer arietinum
gggaaatatcccgccacagctctgtggagcatattgatatttgtgagatagataagatggttattgatgtttctaagaagttttttccagatttagctgttgggtttgaagatccccgtgtacatttgcatgttggtgatgctattgaatttcttagatgtgctcctgaagggaagtatgatgctgtaattgttgattcctcagatcctgtgggtcctgcccaggaacttgtagagaaaccattttttgagacaatagctaaagcattaaggcctggtggagttctttgtaatatggcagaaagtatgtggcttcatacacaccttattcaagacatgatctccatttgtcgagaaacatttaaaggttcgtaccctggc

SEQ ID NO: 1684 - DNA, 262 bp, Cicer arietinum
acaaagcttacctagaggccgtggaaagaggcgaccacctcgtccacagagcagcgttctagccgctttgggtttttctcctgcgagggttttccccaaggatgcacggttctaggttgcagctactggcaatcttaggggtcatggatttcttgccttagggtatggaaagctacttgatctatctgtgcaagagaattctaggctggagagggacgagttcccgctgacgggatgccctcttgaaagtaatgcgcctttg

SEQ ID NO: 1685 - DNA, 361 bp, Cicer arietinum
agtcaagttgcgaagaggacgctaacgactggcgtgaatggtgaactacatccatccagattttgtgagaaagatttgctcaaagttgttgatagggagtatgtttttgcgtatgttgatgatccttgtctctctacataccctttgatgcaaaagttgagacaagtgcttgtagatcatgcattggtgaatgttgatggtgagaagaatttgaacacatcaatatttcaaaagattgcaacttttgaggatgagttgaagacccttttgcctaaagaagttgaaagtgcaagaattgcttatgagaatggacaatgtggaattccaaacaagattaaggagtgtaggtcttatccattgt

SEQ ID NO: 1686 - DNA, 444 bp, Cicer arietinum
gcactgttagtgccgtgttaggagcgggattttctgcaggccacgcgaccacacaaaactgcggggatgctatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgacaatagattgcccccgaacccgct

SEQ ID NO: 1687 - DNA, 271 bp, Cicer arietinum
acgcggccgtcggcggtgagaccggcgatggcaactccgatatgatcatcaaccttaaagatcttcttctgatgagaagagagttcggaattagctttgttaacgcacgcgagaaccacgtgagttttggatcggagacctattgcggctgaaccttgtttcactgcttccatagcgtattcgacttggaataatcttcctgctggactccatgttgttacgtctgtgtcgtattgatttctaaacattttggattttgattttgattttg

SEQ ID NO: 1688 - DNA, 366 bp, Cicer arietinum
gggcgacaaaaccaagtcgaagcgacgaggttttggacagcgaggaacaagtgaggatcacaaatcagatcaaagctcaattcgatgctttaaaacctaaacgacccattaaacccaacagaagcgaacctgaaactcaaaaccccgttgactcaacactctcttcacacaacataccagagcttcaaaaacttcaatctcttcaatctattaattctctcgctatactttcctcagagaatttggtggatccgcaagatgagtttgtggagactcactattacaaggagttgttgtccattgataaacagcatcatgcgacgggaagtgggtttataaaagcggtgagagaaggtggtgaagatg

SEQ ID NO: 1689 - DNA, 432 bp, Cicer arietinum
gttcagtcttggccttataatggcggtgctcctggacctctggtgaccctcaagcctggacagaagttctctgagaaccttctctccactggatcgaccgtcaagattgctactaccaagactctcaccaaccctctcttcttcggttactcctcttcctccaagcccaactacgtttactacgagttcagcactcaatggggtaaccctttcgccaacaagcacaacatcctcaccactggtaagggatgcaatatgtttgactgcaaggccggtgatgcttcttgctacagcactcccagcatgaagaaggtctatggttgccctagccctgccactatctctgccaccatctgcgccaaatagaggagacgtccagtgtatgactagtggaccctttgaacgaaggaatgaagcatttgagagaaggag

SEQ ID NO: 1690 - DNA, 301 bp, Cicer arietinum
aaaattaccaaggaacaaatcaagggtcttgttgtggatttcttctctgcgggaacagattcaaccgctgtggcaacagattggtgtttatcagagctgatcaacaacccaagagtgatgaataaagctcgagaggaggttgactctgttgttggaaaagatagactagtcgacgaatcagatattcaaaatcttccatacattatagccgtcgtgaaagagacattccaactgcccaaacattgaaaagtacagaagagtgtgagattaatgggtatgtaatcccagaaggagcacttgt

SEQ ID NO: 1691 - DNA, 350 bp, Cicer arietinum; identical to SEQ ID NO: 803

SEQ ID NO: 1692 - DNA, 353 bp, Cicer arietinum
actcttgacgaagcgatcgctcagatgagtatcgataacaacttaccacccgacaggcatcccgagaggcgactcaaggcttccttcaaggcatttgaagaagttgaactccctaagttgaagcaagataaaccgggtcttacctacactcaatacaaagatatgatttggaagctttggaagaaatctcctgacaatcctcttaatcaaattgctgctgagtgaatgcgttcaatcatctacctcactgcttccgttgcccattttccattaactcataatagctttttctttacctttcatatttgttatccctctgtaagcaatatatgagtttcactttctgtaccttg

SEQ ID NO: 1693 - DNA, 464 bp, Cicer arietinum
accagacggaaggttgattggctgactgacaagatgcgaagccgtgatcacacagtctcagcaactcatggagacatggaccagaacactagggacattattatgcgagaattccgttctgggtcttcccgtgttttaataactactgatcttctagctcgtggtattgacgtgcagcaagtgtcattagttataaattatgatctcccaacacagcccgagaactatcttcatcgtattggtcgtagtggaaggtttggtaggaaaggtgttgccatcaactttgtcacaaaggacgatgaaagaatgctgggtgacatccagaagttctacaatgtgataattgaggagctgccttcaaatgttgcggaacttctgtgatgagattttttcttccatcatactagaggaaagttggtttctgagataagtgttatgtaatgttccccctttttgccccattt

SEQ ID NO: 1694 - DNA, 440 bp, Cicer arietinum
  misc_feature (242)..(242): n is a, c, g, or t
accgctaccatgttggtgatattctccgagtaactgggtttcataactctgctcctcagtttcactttgtgcgtcgaaagaacgtgttgcttagtattgactctgataaaacagacgagtcagagctacagagagctatggaaaatgcttcaaagttgcttgtggagttcaacacgagtgtggtcgaatacacgagctatgcagacacaaagacaataccaggtcactatgtgatatattgnggagttgttgaccaaggacatttcaaactcaccgagtaacgaggtgcttaatcaatgttgtctggaaatggaggaatcattgaactcggtttataggcagtgtagggtcgctgaccattcgattggaccactagaaataagggttgtgaagaaaggaacttttgaggagcttatggattatgcaatctcaagaggtgc

SEQ ID NO: 1695 - DNA, 365 bp, Cicer arietinum
cgggaccccaagccgtggaactttgaagatataaagaaccatgttgagaaatctgaccagggcgatgtagtcctcatcgacgtccgagaaccagtcgagcttttcgagacgggcaagatccccggtgcgatcaatattcctatcacatcggcagctcagagcctccacatctccgacgaggattttgaggacatgtatggcttccagagaccggcaaagaacaaagagcttgtgttttattgcaaagcaggagtgcgtgcaagggcggctgctcaactggctcatcatgctggctggaacaagatcggcgactatgcaggcagctggctggactgggaagctcagaaaggaccagttgagaaggt

SEQ ID NO: 1696 - DNA, 421 bp, Cicer arietinum
acaaaatctcagccttgtctaagagctcaacaatcacaaccaaccgaacacatacacaaagcacctacatcacctactacatcacctttcaaatattcacaatgggcggtgttatgtcttgtatccggtcatgcctccagaccattggggacgtgatcatggcaatcataggaggaatcggccggattatcacagcaatcgtcaatggcattgtagctttctgctcgattctggtccgcttccttacctgcggctattgcggttcgaagggaggccgagcgaagcgccgaggacactctcacatgaggacgacgagagtttagacgatgaactacacgggcgaacttcttttgtgataccaatttgagaaaggataggggaaggggggagagctttgttagtttgcggaggagtttgctac

SEQ ID NO: 1697 - DNA, 429 bp, Cicer arietinum
acttaaactttagctttcaattcatcattgaaaacaaatcacagtaggagccttttttttcccctcttatcagttggttctcattttaagttaaatctattctgggatggtttttatttccatttttatttttatatatgttgggttatacatgcctgtctgatttctaggacttggttgaatttgctgtgcctgtttactgggaatgtataaaagtagtgaggagtttgtatggaaagattctctagcccttcctcccacacaataaaaggagtgaaatgatgttgagaacatgttttctggatgaatgcgttgaataatatgttggttgttatacaatgtttgaatttttaaatatataggccctcaaagattttctagcaaagtttgaagacagggagataaaactattggtttaatagtgtcgtc

SEQ ID NO: 1698 - DNA, 318 bp, Cicer arietinum
acaactctctcatccacccaaaacacatgccatttagcccattcaatagaatcaacataaggaggctccaaaagtttctgaagatagttgatcaaagagccaccagacaaacaaacggtgaaagcacctctttgatgagtgaatttattggagagatcggcaacgtatttggcgagagaaacagcaagttcttctttttcgaagatttctaattcaacccccattgaagatttcacttggcaaacaaatgtgttactgggtttagcgctaaaccctttgaatctgagggattgaaaagagaatcgggttgaaggtaga

SEQ ID NO: 1699 - DNA, 376 bp, Cicer arietinum
acaaaatctcagccttgtctaagagctcaacaatcacaaccaaccgaacacatacacaaagcacctacatcacctactacatcacctttcaaatattcacaatgggcggtgttatgtcttgtatccggtcatgcctccagaccattggggacgtgatcatggcaatcataggaggaatcggccggattatcacagcaatcgtcaatggcattgtagctttctgctcgattctggtccgcttccttacctgcggctattgcggttcgaagggaggccgagcgaagcgccgaggacactctcacatgaggacgacgagagtttagacgatgaactacacgggcgaacttcttttgtgataccaatttgagaaaggata

SEQ ID NO: 1700 - DNA, 433 bp, Cicer arietinum
ctcatttctctcctaaaaccctaactaatttctcaatccgattacaatggaattctggggtgctgaagttaaggtgggtgaaactgttaaggttgacccaagtgaatttgaggcatgcattcacctttctcaggctgcactcggagagacaaagaaagacaaacctagtgatcctgtcgttcttttcttgaaagttggtgataaaaagcttgttttgggaaccctaatcaaggataaaattccccagacatcccttgaattggtcttggacaaagattttgagctttctcacaattcaaaatcggctagtgtccatttctgcggatacaaagcatattatcccggtgaagatagtgatgaagatgactttactgatagtgaagatgatattcccttggctaatgaagagaatggtaaactcgaaacaaaagtt

SEQ ID NO: 1701 - DNA, 453 bp, Cicer arietinum
gggcgacaaaaccaagtcgaagcgacgaggttttggacagcgaggaacaagtgaggatcacaaatcagatcaaagctcaattcgatgctttaaaacctaaacgacccattaaacccaacagaagcgaacctgaaactcaaaaccccgttgactcaacactctcttcacacaacataccagagcttcaaaaacttcaatctcttcaatctattaattctctcgctatactttcctcagagaatttggtggatccgcaagatgagtttgtggagactcactattacaaggagttgttgtccattgataaacagcatcatgcgacgggaagtgggtttataaaagcggtgagagaaggtggtgaagatggatatgagattaagttacctgcaagctatgttgatgttggtgaaattcaattcagaggatataaaagtaatcctgctacaaatgact

SEQ ID NO: 1702 - DNA, 440 bp, Cicer arietinum
acaacggcgtcaattatcaacaacttctcaattccatgctcactactggatttcaagcttcaaaccttgctgatgccattaacgtcgttaatcaaatgctagattggaggctggttgatgaacctgtgactgaggattgtgctgacgaagagagagatttggattacagaaaatctgttaagtgtaaagtgtttttgggtttcacttctaatctcatttcatctggtgttagagatgttgttcgttacctttgtcagcatcacatggttgatgtgattgttacaactacaggtggtatcgaagaagatctcataaagtgccttgcacctacatataaaggagatttctctttgcctggagctcatcttcgctcaaaaggattgaatcgaattggtaatttattggtccctaatgacaattattgcaaatttgaggactgg

SEQ ID NO: 1703 - DNA, 436 bp, Cicer arietinum
gttcagtcttggccttataatggcggtgctcctggacctctggtgaccctcaagcctggacagaagttctctgagaaccttcgctccactggatcgaccgtcaagattgctactaccaagactctcaccaaccctctcttcttcggttactcctctacctccaagcccaactacgtttactacgagttcagcactcaatggggtaaccccttcgccaacaagcacaacatcctcaccactggtaagggatgcaagcagtttgactgcaaggccggtgatgcttcttgctacagcactcccagcatgaagaaggtctatggttgccctagccctgccactatctctgccaccatctgcgccaaatagaggagacgtccagtgtatgactagtggaccctttgaacgaaggaatgaagcatttgagagaaggagaata

SEQ ID NO: 1704 - DNA, 435 bp, Cicer arietinum; identical to SEQ ID NO: 1399

SEQ ID NO: 1705 - DNA, 431 bp, Cicer arietinum
gttcagtcttggccttataatggcggtgctcctggacctctggtgaccctcaagcctggacagaagttctctgagaaccttcgctccactggatcgaccgtcaagattgctactaccaagactctcaccaaccctctcttcttcggttactcctctacctccaagcccaactacgtttactacgagttcagcactcaatggggtaaccccttcgccaacaagcacaacatcctcaccactggtaagggatgcaagcagtttgactgcaaggccggtgatgcttcttgctacagcactcccagcatgaagaaggtctatggttgccctagccctgccactatctctgccaccatctgcgccaaatagaggagacgtccagtgtatgactagtggaccctttggacgaaggaatgaagcatttgagagaagga

SEQ ID NO: 1706 - DNA, 391 bp, Cicer arietinum
tgaagcgctttcccctgggtctcatcaagaagctccgaaaggctaagcaggaggctcagcccaacgagaatcccgacctcgtcaagacccacctccgagacatgattgtcgtccccgagatgattggcagtgtcattggtatctactccggcaaggagttcaaccaggtcgagatcaagcctgagatggttggtcactacctggctgagttctctatctcatgacaagcctgtcaagcacggtaggcccggtattggtgccacgcgctcttctcgattcattcccctcaagtaagaaggttgcggtctcgggtggtttctgcattcatggacattttgggcgaaaaggactggttctggtatatgggctaaacatctatcaaaaacactga

SEQ ID NO: 1707 - DNA, 424 bp, Cicer arietinum
ctcatcctcgccagacatcgtcaatcaagatgagagccaaatggaggaagaagcgggttcgccgcctcaagcgcaagagaagaaagatgagggctcgatccaaataaacacctcgcacctcaacctgacttgactcatctttcatgatgttacgacttcacacgcacaacgatactctggccgaagctgcgaacgctactctggcgcctatgggatgtcccgcaacgtacctcggccgacctcggccgcgaccacgcgtggtcgcggccgaggtacaggacatcttctcaacaaatccactgcagtcacctattgagaagatgtcctggaaaaccaacgcttccggctctagcccaagtagcagagaggcaaggtaaatacttagcaggcttattaaacaaaataggtaaaaccaatggaggcc

SEQ ID NO: 1708 - DNA, 416 bp, Cicer arietinum
ctcgcactcgcacttgcactcgcactcaactctttccggaaaacgttgccggagttcgtagtcgtcggaaggaaggtagcgagaagcttttagaacatctgtccagagaagacaaaagggtttatggcaggcaaagctgttggttcagcggcaaaggcaatagcagaataccaatatccatggcgtgagaagttaacaaaatacaaggatgaattggccaagggagtgtggggttactgggagctaggagcatggaagccactcagcatcagtgctcggcatagggctagactccggaaagaagtccttcttgctggggaagattggacttatgatcctgaaaggaaggagatgaagaccaggcgaaaaggacataaggttgataggatagcagctgagaagagggaaaacactgc

SEQ ID NO: 1709 - DNA, 441 bp, Cicer arietinum
actgaagagacctttaacagtagcatttaaaggagataaacagaatgatactactttggttgcaactcaagagaaaattcttatgcaagttgatacagccaagacacacaagaaaaggatagcgaaaaccaaaaaactacctaagaaagcaagagtggtcttcacagaggaaacttttccgtcttcattggatgtagactataatgaagctgctgcgatacttgaaaatatatacaaacttagcccgacatctgatgtatgtaatgcagactatatagattgtaagatcaaaagagtctctcgaaggggtaagaagattggtgatgtaagtaaagaggagttagacaatgatagggtagtcagaaaccagaatgtgaaagccaaacgattggatcttgatgagaggattgcattaaaaaagaacaatagtgaagatgcaat

SEQ ID NO: 1710 - DNA, 438 bp, Cicer arietinum
actttttgctggcattgctgctgaagctcttatatatggcgaggcagagggtggagaaaatgatgaaaatctatttagaagcatctgtcttcttcttgagcctccactgtctgtagctgagatgtctaatcaagcaagatggtcagttatgcaatcttataatttgctcaagtggcataaagctgcacaccgagctgctgttaaagcattggaaagtggtggcagtcttagtattgtaatcaggaggatcgaagagactttatattctgaaaaataaaccttcaaagtttacataaaagaacaaattttgtcttttaagttgcataaagggttattgagatagatttaaactggagctggtttgactggtctttatataccattgcatatttgcagatgctacatgtattggaccttgtctaccatgacagaatcaat

SEQ ID NO: 1711 - DNA, 367 bp, Cicer arietinum
acaactctctcatccacccaaaacacatgccatttagcccattcaatagaatcaacataaggaggctccaaaagtttctgaagatagttgatcaaagagccaccagacaaacaaacggtgaaagcacctctttgatgagtgaatttattggagagatcggcaacgtatttggcgagagaaacagcaagttcttctttttcgaagatttctaattcaacccccattgaagatttcacttggcaaacaaatgtgttactgggtttagcgctaaaccctttgaatctgagggattgaaaagagaatcgggttgaaggtagacggaaatttgagattgggtttgaaagggaaaacaatggaaatcgcgact

SEQ ID NO: 1712 - DNA, 418 bp, Cicer arietinum
acaaaatcattgaaaattttcctaactagtcacaatctctctgtccataatcatctcactcagttgtttttctctctcactaactagattataatgaaaaaataagtgagtgccggcctatacaaatttgcctcaaataatctatgtcagctccttcttctgaagagatcagcaaaaattcaaacgagaagtaatatctaagaaaacgtcttctctgcaaggaattgtgagaccacccgttggatgctcatatccgaattgttcctcagcttggttcaacaattcctggaatgaagtttgattcaaatatgatattgggattacaaaccgcttcattttctctcctacatacactgcaagatatccctttggcacatccacgcctttagaagatgcttggtttgcagcccttctgatg

SEQ ID NO: 1713 - DNA, 290 bp, Cicer arietinum
acaactctctcatccacccaaaacacatgccatttagcccattcaatagaatcaacataaggaggctccaaaagtttctgaagatagttgatcaaagagccaccagacaaacaaacggtgaaagcacctctttgatgagtgaatttattggagagatcggcaacgtatttggcgagagaaacagcaagttcttctttttcgaagatttctaattcaacccccattgaagatttcacttggcaaacaaatgtgttactgggtttagcgctaaaccctttgaatctgaggga

SEQ ID NO: 1714 - DNA, 424 bp, Cicer arietinum
cttagctactctcccaaccaatcacacaaaatggataatcaaaataacttgtcaggaaatatcaacaagaagaccaacatcaacatggataggaagaagaaatatatggtgagcagagttgaatttttggagaatgaagaagacattaacatgaaagctgacacgtttattagtaacttcagaaaacagctaaagattgagagacaagaatcactccagcgttttcaggaaaccacacgatcaagtgcttgaatcattttgataaaattaaactactgatgtggttaaaattgtaaaattgaaaagatgtgaggctctgtctcttactcttctggtgaaatagcaaagtcagcttattaatgtagcttttcagttttttatataaattgttttttatttaatgttttaaacattaaaattcata

SEQ ID NO: 1715 - DNA, 354 bp, Cicer arietinum
ttggctttcttcaccatcttattacaaacccataattgaatgttgtgggggcactgagctgggatctagttacatcatagggagtctactacagcctcaagcttttggagcatttagcactgcatcaatgacaactggtttggtcatccttgatgaaaatggagttccttatccagatgatgttccttgtgttggtgaagtgggcttatttcctgtatatatgggagcaactgatagattgcttaacgccgataatgaggaggtctattttaaagggatgcccctttacaaaggaaaggttcttaggagacatggagatataatcaaaagaactgtaggaggctattttgttgt

SEQ ID NO: 1716 - DNA, 356 bp, Cicer arietinum; identical to SEQ ID NO: 1437

SEQ ID NO: 1717 - DNA, 434 bp, Cicer arietinum
acttggaggatgttcctgcacacaaacaggccattccattcaggcgtttctgtcgtggtgttgggaggacagctcaggccaagaatagacactctaatggacaaggaaggtggcctgccaaatctgccaagttcattctagatttgctcaagaacgcagagagtaatgctgaagtgaaaggtttggatattgatgctctttacgtttctcatatccaagttaatcaagcacagaagcaaagacgtcgaacatacagagcccatggaagaattaacccttacatgtcatctccatgccacatagagttggtattatctgaaaaggaagaggcggtcaagaaagagcctgagactcagttggcaccaagcaagaagaaggcttaagctcttcatgcctgcgcatgttaattttaaatccattatttgtatcagata

SEQ ID NO: 1718 - DNA, 423 bp, Cicer arietinum
accgacgaaatcctgtatgggctgtcccttgatagagaatcttgactggttatcattgatcatgacacccctatctgtgttgatcctaagaagatcacacaagttgctttcctcagacttacaatgtggacattccccacactccccagtgaatacaggcagagcatgatcccctggttccagatgagtcacaccctcccctacgctctccacaatccctccagcttcatgaccaaatatacgaggaaacagtggagtctgacccttagcttcccagaagtaaacatcagtgtgacaaagggaggtgaagagtatcttaagacggacttcaccggcttgtggtggcgccacctccacttcttctatcaccagcggcttccccgcctcccatgcaatcgcagctttgcatttgatgacctgacc

SEQ ID NO: 1719 - DNA, 364 bp, Cicer arietinum
cgggaattcgatttctagcggccgcccgggcaggtaccgaccaaatggtgtatgggctgtcccttgatagagaatcttgactggttatcattgatcatgacacccctatctgtgttgatcctaagaagatcacacaagttgctttcctcagacttacaatgtggacattccccacactccccagtgaatacaggcagagcatgatcccctggttccagatgagtcacaccctcccctactctctccacaatccctccagcttcatgaccaaatatacgaggaaacagtggagtctgacccttagcttcccagaagtaaacatcagtgtgacaaagggaggtgaagagtatcttaagacggactt

SEQ ID NO: 1720 - DNA, 404 bp, Cicer arietinum
cgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctggcgggtgacgggctcgagaaaatacagcgccttttgtgccttggtatgctggatggtgaaggaagcggggtatcctgtacctagctagctcagcacgtcttttgctccagtaggagatttggcttcgttacagccacccagacgaaaaatacacataacatatcgtatagaagtt

SEQ ID NO: 1721 - DNA, 213 bp, Cicer arietinum
actaaatcctgagagcaagagttggatctatttcatacatatcctggttttaaattatccttaggcgtctcaccttcgagcctagctaggaacatgacttttattaattattattaacctagttaagcacttgactccgcagatgcatcttcaacaagcttgaactcctgcacctccttgaagttcatccaagacttttcccaaaccttgact

SEQ ID NO: 1722 - DNA, 106 bp, Cicer arietinum
acttgaggtgggttcaaatgttacgaggttcagtgttggagaaattgtgggagttggactcctcgttggttgctgcaaaagctgcagagcatgtgaatctgatatt

SEQ ID NO: 1723 - DNA, 245 bp, Cicer arietinum
acaacggtttcaattatcaacaacttctcaattccatgctcactactggatttcaagcttcaaaccttgctgatgccattaacgtcgttaatcaaatgctagattggaggctggttgatgaacctgtgactgaggattgtgctgacgaagagagagatttggattacagaaaatctgttaagtgtaaagtgtttttgggtttcacttctaatctcatttcatctggtgttagagatgttgttcat

SEQ ID NO: 1724 - DNA, 124 bp, Cicer arietinum
acacaaccgaagcgtctcatagatgacattttaagataagtaagttttggaaggactgattcatctaccaaacgatcttgtcctacatgaatatccaattcatcctttaccttcttcaatatct

SEQ ID NO: 1725 - DNA, 439 bp, Cicer arietinum
ggagtttcaggaaactatcaacacgctttactcagacgacggaactctggagccgaacaatgctctcgcggggttgatggataacctcaaaaaagtccacgacaagattggccgcacgctagatcccgctcctgagttcaagaactgggtatgggaggctggcttccacaacattacggagcaaaggttcaagtttcctgtaggcccgtggcctaaggacaggaggttgaaagagatcggggcttgcttgagcatgaacttcaccagcggcgttgatgccttcacagcgaagcctttcagagatcatttaggttggtcacagaaggaggtggaggttctgaaagcggaggttcggaaggcagctaaacgcagggaggttcatgccatgttccatcttgttgttgtgacagcgcagaagccaggatcatagcgagtgaag

SEQ ID NO: 1726 - DNA, 254 bp, Cicer arietinum
accaaactcgttctcaagagcggcctttgaagcagcatctagacttccctgagctccttggttgtgtgtcaggaagatcttgaaggaagaaatgaagtgagcaagaggaatgctcttgtcgctcttccacttctggtaggtctcaacatcatcaatgaagatgatgaagtcgtcgctgcccttgtagtggaccttagtctgctgagtctcgccacgagccattgtgattgtttattgagtaagggaagtggtag

SEQ ID NO: 1727 - DNA, 403 bp, Cicer arietinum
acctaccatgttgccatggctatggataaacaacacttgagtaacaagcatacataattaccaactacataaataacatgattgtggtagttttctgatcctatatggagatagttttgccagaaccagaagctaaattcacaacttcatgattatatatttacacaaattgaattagagtcgtgtcacataggatgagaccaccagaaccagcatctccgtattattaattgttggatgcatgaactgcagctacagttgagaccattgaatccactccacatatatttcgacctctgcagatcttgtaatatccttcctcaccccaattctgtccccatgaattctttatgatccagtaaggcttttccttcaatcggatgggagcaaaaccatttccaaa

SEQ ID NO: 1728 - DNA, 439 bp, Cicer arietinum
taaaaaacgtctccgtctaccggctcacgctcagaaggctccgatcttacctactaacaaccttcctgaggacttcgattggcgtgagaaaggagccgtcactcccgtcaaggaccagggttcgtgtggttcgtgttgggcgtttagcacaacgggagcgttggaaggagcaaattatttggctactgggaaattagtgagccttagtgagcaacagcttgtggattgtgatcatgtgtgtgatccagatgaatataattcgtgtgactcgggctgtaatggtggattgatgaacaatgcatttgaatacctactccagtctgggggagtagtgcgagaacaggactattcttacacaggaagagatggctcctgcaaatttgacaaaagcaagattgctgcttccgtatctaatttcagtgttgtttccgttgacgaa

SEQ ID NO: 1729 - DNA, 399 bp, Cicer arietinum
acatgtccacctcaaacctccaataatggaacttcgtctgcttcaagattgggaaaagttgacggcatacctttatctaacaagttgcatgcatttgttgaatatgaatctgttgagctggctgagaatgcggtcgctgagctaaatgatgagggaaactggcggagcggcctccgtgttcgtctaatgcttaataaacatacgggacggggaaggaagggacttgatgttgaagttagctgtgaagaggattatacttctgcgcgtgagccacagacaaatgagaaacaattagaggatgcttcctttccagatactcagctgcatgattatgtgggagaagagcatggttatgacaaagagagtggacagaggaaggggcggaggcgagctaaggga

SEQ ID NO: 1730 - DNA, 434 bp, Cicer arietinum
acatgtccacctcaaacctccaataatggaacttcgtctgcttcaagattgggaaaagttgacggcatacctttatctaacaagttgcatgcatttgttgaatatgaatctgttgagctggctgagaatgcggtcgctgagctaaatgatgagggaaactggcggagcggcctccgtgttcgtctaatgcttaataaacatacgggacggggaaggaagggacttgatgttgaagttagctgtgaagaggattatacttctgcgcgtgagccacagacaaatgagaaacaattagaggatgcttcctttccagatactcagctgcatgattatgtgggagaagagcatggttatgacaaagagagtggacagaggaaggggcggaggcgagctaagggacgtggccgagttcattgtcatcaaaacaatcgtgt

SEQ ID NO: 1731 - DNA, 419 bp, Cicer arietinum
acaaaaacgagaaccacagtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacgtgagtagcgagaaccaccatcaccaccaccatatccacgatctctgctaccaccataaccaccaccacctcctccgccatatccacctccaccaccatatcctccaccgccacctctgttatatccaccttcacgacgtccaccaccatatccaccgcctccaccatatccaccgccaccacggccgcctccaccaccgctaccacgagactgagcttcgttcacggtaatgttacgtccgtcaa

SEQ ID NO: 1732 - DNA, 182 bp, Cicer arietinum
gcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggt

SEQ ID NO: 1733 - DNA, 252 bp, Cicer arietinum
ttcggagatagtcttgaggaggatagaagaagcaagtggcttgactttggggacaggctgaacaagcttcttaccttggaaaaaccttggactttaattcttgatgatccagaaggaaattcttttatagcacctgcaactgatgatcttaaagacgacaaacaattaatatacgaggaatatgagaggacatgggagcaagatgaagaattaggtctacatcaaatggacacctcttctgcagatgctgct

SEQ ID NO: 1734 - DNA, 253 bp, Cicer arietinum
ttcggagatagtcttgaggaggatagaagaagcaagtggcttgactttggggacaggctgaacaagcttcttaccttggaaaaaccttggactttaattcttgatgatccacaaggaaattcttttatagcacctgcaactgatgatcttaaagacgacaaacaattaatatacgaggaatatgagaggacatgggagcaagatgaagaattaggtctacatcaaatggacacctcttctgcagatgctgctt

SEQ ID NO: 1735 - DNA, 137 bp, Cicer arietinum
acgtgcaacaacactatcattatctccaccactaccatcagcattacccgaagtatgaaatatcgtaacaagagagttcttctgtagatttgtcttgattccaggatataacaaggcattaagaagaatttttccta

SEQ ID NO: 1736 - DNA, 253 bp, Cicer arietinum
acttaggcaaatcttctcttcgaattccaagtttctgattgatcttatcaaactctgccaagaggaggtccattcctttctcatcatttctcagtagaggtttctttatattcttttcaactttctccaatgcatcaaacatcatagcctctgcaccaagatcatctgtaagacctctcttggttcttatttccttcacggtcaaaagataagtccgagcatctggaatatcttgtgtctccaaattgatggt

SEQ ID NO: 1737 - DNA, 426 bp, Cicer arietinum
acaaaggagttgaccaagtcgtggaggttgaagtagctggacagaagctctgagagacatggttggaacgattgcggatcggaaagagggagtatgcagtaactaccccttggtcgagattttgaatatataaccggcgttttacatgacccgacagcctcctctcagactattaggacaaactgggcttggacactgtccgtcacgcataccattccgaagaaatagcaggccttgtgggcatacaagcaatggcggatggaagaagtgacagaattcaacataaaccagataatctttcccgcagacgtggcatgcagccgaatgctgcgtgcacatttatcgtgaactcgagcttgttcttaaagttcgattgggtgatgatcgaagtcgacaattgggaagggggaggctcgcacgaacgac

SEQ ID NO: 1738 - DNA, 434 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgtcgcggcggcagggaaaaacctcgacctcggccgcgaccacgctcgagcggccgcccgggcaggtcgcgatacagacaaagttcatcagccatggcacttgcttctcgtctcgcatccaaatccaaattgctctatggtagtcaaatgcttgtgcaaaaggagttttctgttccagttcgtcactttgctaaaggctctgcccctactgcccttaagggagatgcgatgttgaagaa

SEQ ID NO: 1739 - DNA, 391 bp, Cicer arietinum
cgagaagaaatggaagaagaagccgtagtggtcgcagaagcactcgaatcactgtccaccgccgaatcatcgaatccaaatccaacagaaacaactcagcagcagttgttgggtgtggaacagagatatcagatcgtcaggagtatcggagaagagtgcattcaagaagatgaacttcttaatctcctcgctaaaaagcctgagcctgtttgttatgatggtttcgaaccttctggaagaatgcacattgctcagggtgtcatgaaaacactcaatgtgaacaagctaacctctgctggttgccgagtcaaaatatggattgctgattggtttgctaagcttaataataaaatgggaggagatttgaagaaaattgagacagttggcaagt

SEQ ID NO: 1740 - DNA, 410 bp, Cicer arietinum
ggaaaaaccatcacccttgaggttgaatcgtctgatacaattgataatgtcaaggccaagatccaggacaaagagggtatccctcctgatcagcagaggcttatctttgcagggaaacaacttgaggatggtagaaccctagctgattacaacatccagaaagagtctacccttcatttggtgcttcgattgagaggtggcatgcaaatttttgttaagactttgacagggaagaccattaccctcgaggttgaatcttctgatacgattgataatgtcaaagccaagatccaggacaaagagggtatccctcctgatcagcagaggcttatcttcgccggtaagcaattggaagatggtcgcaccctagctgattacaatatccaaaaggaatccacccttcatttggt

SEQ ID NO: 1741 - DNA, 413 bp, Cicer arietinum
ggaaaaaccatcacccttgaggttgaatcgtctgatacaattgataatgtcaaggccaagatccaggacaaagagggtatccctcctgatcagcagaggcttatctttgcagggaaacaacttgaggatggtagaaccctagctgattacaacatccagaaagagtctacccttcatttggtgcttcgattgagaggtggcatgcaaatttttgttaagactttgacagggaagaccattaccctcgaggttgaatcttctgatacgattgataatgtcaaagccaagatccaggacaaagagggtatccctcctgatcagcagaggcttatcttcgccggtaagcaattggaagatggtcgcaccctagctgattacaatatccaaaaggaatccacccttcatttggtacc

SEQ ID NO: 1742 - DNA, 148 bp, Cicer arietinum
gatttcgagcgggccgcccgggcaggtacaccaaaaaggtttaaactacatggtgggtggtgataacaactctctgacacacaatggaaatcatttatcagcaacaagggcttcaattttgtttacaatgtgagcttcatgatcctca

SEQ ID NO: 1743 - DNA, 171 bp, Cicer arietinum
acaatttttccctagaggccgtggaaagaggcgaccacctcgtccacagagcagcgttctagccgctttgggtttttctcctgcgagggttttccccaaggatgcacggttctaggttgcagctactggcaatcttaggggtcatggatttcttgccttagggtatggaaa

SEQ ID NO: 1744 - DNA, 319 bp, Cicer arietinum
actcattcccccaaaaggcacctctctacccgtagctagccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggatctattcctctccagcctagaattctcttgcacggatagatcaagtagctttccataccctgaggcaggaagtccatgatcccctaagatcgccagtagctgcaacctaggaccgtgcatccttg

SEQ ID NO: 1745 - DNA, 434 bp, Cicer arietinum
actaccactcagggaaagtctcctgttaaaaccattgtgaatctgaagaatgatcctgatcatcttcttgtccttgtccgtggtatctggtctagcccaagtgactggagttatacggaggctgagttaaaaacgcaccttggaaaaagctttttaatatatgcaagttcatcaaacgcctacactaagacatttactgggattgatgaagctggaaagcgattagctgatgaagtcatgcaagttgtaaagaagacaaagagcctgaagcgaatttcctttgttgcccattctcttggaggcctctttgctagatatgcaatttctgttctttattcacctgatacctataatagcggccaacttggtgattcaatgaactgcatgatggaaaattcacagagaacagacttttcaagagggacgattgctgg

SEQ ID NO: 1746 - DNA, 420 bp, Cicer arietinum
gaataatataatgacaacacttggtggagttcgcgatgtgccaggaaaccagaacagccttgagatcgatagtctcgcccgctatgctgttgaggaacacaacaaaaaacagaattctcttctggaatttgaaagggtgataagtgcaaaacagcaagtggtttctggaaccttgcatcacatcactcttgaggcaaaagatggggtgaataaaaaggtttatgaagtcaaggtttgggaaaagtcttggatgaacttcaaggaggtgcaggagttcaagcttgttgaagatgcatctgcggagtcaagtgcttaactaggctaataataattaataaaagtcatgttcctagcttggctcgaaggtgagacgcctaaggataatttaaaaccaggatatgcatgaaatagatccaactc

SEQ ID NO: 1747 - DNA, 200 bp, Cicer arietinum
acaaaggaccatggaaacgaaagaaaatcaagaatcctaactacaaaggaaaatggaaaactccatggatagataatccagagtttgaagatgaccccgatctttatgtgcttaagcctatcaaatatgttggcatcgaagtttggcaggctaaaggcggttcagtatttgacaacattttgatttgtgatgatcctgat

SEQ ID NO: 1748 - DNA, 120 bp, Cicer arietinum
aaagaattcaacggcaatttgcgaccttaggagcccgaattacagctcgtcactgactcaaccccatcaacaaactatttgaggaggccattttacattggctggctgcggccatgaatg

SEQ ID NO: 1749 - DNA, 302 bp, Cicer arietinum
tacactcttcacccgcgtaacagcggaatcaactagtctcaggaggagggaaagggctcacaggaagttcgagcacccaaggcacggatcattgggatttctcccaaggaagcgtgctgctcgtcacagaggaaaagtgaaggcattccctaaggatgacccaacaaaggcacccaagcttactgccttcttgggttacaaggctggtatgattcatattgtcagagaagtcgagaaaccaggatccaagcttcacaagaaggagacctgtgaaccagttacaatcattgagacccctccaa

SEQ ID NO: 1750 - DNA, 228 bp, Cicer arietinum
cgagaagaaatggaagaagaagccgtagtggtcgcagaagcactcgaatcactgtccaccgccgaatcatcgaatccaaatccaacagaaacaactcagcagcagttgttgggtgtggaacagagatatcagatcgtcaggagtatcggagaagagtgcattcaagaagatgaacttcttaatctcctcgctaaaaagcctgagcctgtttgttatgatggtttcgaa

SEQ ID NO: 1751 - DNA, 424 bp, Cicer arietinum
acagagtttacctggagaccgtggaatgaggcgactacctcgtccacggagcagcgttctggccgctttggggttttctcctgcaagggttttccccaaggatgcacgggtctagggttgcagctactggcgatctttggggatcatggacttcctgcctcagggtatggaaagctacttgatctatctgtgcaagagaattctaggctggataggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctgcgagtagagaggtgcctcttgggggtaatgagtacctcgg

SEQ ID NO: 1752 - DNA, 428 bp, Cicer arietinum
gaataatataatgacaacacttggtggagttcgcgatgtgccaggaaaccagaacagccttgagatcgatagtctcgcccgctatgctgttgaggaacacaacaaaaaacagaattctcttctggaatttgaaagggtgataagtgcaaaacagcaagtggtttctggaaccttgcatcacatcactcttgaggcaaaagatggggtgaataaaaaggtttatgaagtcaaggtttgggaaaagtcttggatgaacttcaaggaggtgcaggagttcaagcttgttgaagatgcatctgcggagtcaagtgcttaactaggttaataataattaataaaagtcatgttcctagcttggctcgaaggtgagacgcctaaggataatttaaaaccaggatatgtatgaaatagatccaactcttgctttc

SEQ ID NO: 1753 - DNA, 435 bp, Cicer arietinum
actaacatgttctgaagctcttttgctcaagggcctgctgctacaatatatgacataaagaacacgaaccaagatcaaggtgacaacaaaagcagcacttgaaagggtagcaattgacaatacactagagaagcagcaatcattggctttttccatcagagacatgttcaagatttcagttggagctacacttccatcttgctgtgtcaataatttttcactgcttgaggattgtggaggccgatctcaaaggtggcgtagctggatgagggtcttagaggtagagcttaacgtgcagcaagcgcgcgagagaggagaagagaaaagagaaggggcgggcgagagaggagaagaagaaagaagaggaccgagggcagcgagactgggagatagaagaggagaagacggcgtggtggccggtggtggcgctggtag

SEQ ID NO: 1754 - DNA, 417 bp, Cicer arietinum
acaaagcttacctagaggccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 1755 - DNA, 206 bp, Cicer arietinum
actaggaattaaagtgaaggatcattctgaagaactttcaaaagggtatgcagcacttgtggttgtaatggtgtgcatttttgtgtctgcatttgcgtggtcttggggtccgctcggttggctaattccgagtgagatatttccattggagactcgttctgcaggacaaagtgttacagtttgtgtcaactttctcttcacttttg

SEQ ID NO: 1756 - DNA, 302 bp, Cicer arietinum
tacactcttcactcgcgtagcagcggcatcaactagtctcaggaggagaaaaatgtctcacaggaagttcgagcacccaaggcacggatcattgggatttctcccaaggaagcgtgctgctcgtcacagaggaaaagtgaaggcattccctaaggatgacccaacaaaggcacccaagcttactgccttcttgggttacaaggctggtatgacacacattgtcagagaagtcgagaaaccaggatccaagcttcacaagaaggagacctgtgagccagttacaatcattgagacccctccaa

SEQ ID NO: 1757 - DNA, 336 bp, Cicer arietinum
accaccattaacctgaatctccataatgtgggctttcttctgcttcaatcccttcatcttcttgatctgagtgtgagccagaacacggataacagttgcatacttcttcagtttctcaagctgggtctgaatgttcttctttccttcatcggtttcatactgctttgaatacttagtgaaagccttcttcttggacttgcaccaattcttgtagaacctacgcttgatttcttcactcaaatgctgagtccaaacagtattcaaagtccgaagaccgcggggagttttcacataaccaacaacgccaacaacaatcgttggaggggtctcaatgat

SEQ ID NO: 1758 - DNA, 336 bp, Cicer arietinum
accaccattaacctgaatctccataatgtgggctttcttctgcttcaatcccttcatcttcttgatctgagtgtgagccagaacacggataacagttgcatacttcttcagtttctcaagctgggtctgaatgttcttctttccttcatcggtttcatactgctttgaatacttagtgaaagccttcttcttggacttgcaccaattcttgtagaacctacgcttgatttcttcactcaaatgctgagtccaaacagtattcaaagtccgaagaccgcggggagttttcacataaccaacaacaccaactacaatcattggaggggtctcaatgat

SEQ ID NO: 1759 - DNA, 401 bp, Cicer arietinum
acaatggtcacagcaccagtgactatcatcagacgttctgctggtcatggtggttcggaaagctccctttcctctcccagttctccccttgctgctccctgcagcattttttgagcttgttgctttgctgatggcagctccattaccatccacatcagatagaccattctctagtgccctcactaagttctcgaagtaattttttgtcacactagtcaatccagctaactttgtacggaagtcattgaattctttagatgggccatcagcactgagaaactgttgtagttctttttcagcacattgatgaagtctctctagaccagattctgcttcaccttgcaaatactcaaagaactgtttttttgcacgctcatgctcaggtaaatagtacctgcccg

SEQ ID NO: 1760 - DNA, 161 bp, Cicer arietinum
ctgcacctaaagtccctgaagtagttctctcctcctcctcaggacagaggaaaatgccggtgattggcctcggcaccgcaccggaagcaatcaggaaggttaccacaaaagatgctgtccttgaagccatcaaacaaggttatagacattttgatgctgct

SEQ ID NO: 1761 - DNA, 255 bp, Cicer arietinum
cccttggtttcgaatcagtcgatggttctagaaagcaggtttctggaacaaacaaactacgttctggaaattattgggaaggagcgccaattatttgagacttcacaacagcaatgccagtataacttacaagaaaaaataaatcaacagtccatagaatacaacaaattgacaactcaaatcgaaggacaaaataaagacatacaagaaatcaaacaatttttaaaattattggtccctagaatagttggaatc

SEQ ID NO: 1762 - DNA, 301 bp, Cicer arietinum
ggccgaggtactgcttgaatatggctctgtgaaagtggacctccagcactgggataagaatttcctagcattgaaattacctgaggagaaccttgtggaagcacaccactcatcaatcgattctgtccttgcacgcctagaccaccatatccactatttccattcaaatttaggcgagacgcaaggtcaggaatggacaatcctccggagcttatcctcccgatgttccccgcagcaaccatgtttcccatagaacttgttatccgaggacctgcatttcccaaaattggggatactccca

SEQ ID NO: 1763 - DNA, 195 bp, Cicer arietinum
gattcattacctggtgccactccgccaatggtggctactaaatccaatacgagagtaataaatgttgatgttggagattctgaattggaagagtataaaaaggccaccaaattaaacacaagaattattggtgtacctgtagaaagcaatattgataacgtcaacgataacgatgatgataacaataaggaaaac

SEQ ID NO: 1764 - DNA, 435 bp, Cicer arietinum
ctcatttctctcctaaaaccctaactaatttctcaatccgattacaatggaattctggggtgctgaagttaaggtgggtgaaactgttaaggttgacccaagtgaatttgaggcatgcattcacctttctcaggctgcactcggagagacaaagaaagacaaacctagtgatcctgtcgttcttttcttgaaagttggtgataaaaagcttgttttgggaaccctaatcaaggataaaattccccagacatcccttgaattggtcttggacaaagattttgagctttctcacaattcaaaatcggctagtgtccatttctgcggatacaaagcatattatcccggtgaagatagtgatgaagatgactttactgatagtgaagatgatattcccttggctaatgaagagaatggtaaactcgaaacaaaagttga

SEQ ID NO: 1765 - DNA, 454 bp, Cicer arietinum
gattcattacctggtgccactccgccaatggtggctactaaatccaatacgagagtaataaatgttgatgtgggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcac

SEQ ID NO: 1766 - DNA, 334 bp, Cicer arietinum
accagcttaaatatccagcacctggagctccaaatttagctaaaagggtgaaggagctactcaacaaatccggtttcaaccgtgtcgccgaagacgaaaaacgaggactcgatcacggtgcttgggttccactcatgttaatgtatccagaagctgacattccagtttgtcaattgtctgttcaatctaacaaagatggaacttaccattataacttgggaaaagcattggctcctcttaaagatgaaggtgttttgatcataggttctggaagtgctgttcataatttgagagctattagccgtcatggaagtgttgctccttgggccttaga

SEQ ID NO: 1767 - DNA, 447 bp, Cicer arietinum
acaagtttagttggaattcgatgtaaactggtaagaagcataagagagagtgccatgctcaatactactatggataagtttggcctttgaatcatcaccagcagcaccaatagcaacatgcagtggataaaagtgatccggcgacggatgagcctttctcgcatgtggcgccttttgttcataatgatttacatcttcatatcttccttcaagaagagcatctttcaaccaattatcaaactctaaggcccaaggagcaacacttccatgacggctaatagctctcaaattatgaacagcacttccagaacctatgatcaaaacaccttcatctttaagaggagccaatgcttttcccaagttataatggtaagttccatctttgttagattgaacagacaattgacaaactggaatgtcagcttctggatacattaacatgagtgg

SEQ ID NO: 1768 - DNA, 212 bp, Cicer arietinum
gattcattacctggtgccactccgccaatggtggctcactaaatccaatacgagagtaataaatgttgatgttggagattctgaagtggaagagtataaaaaggccaccaaattaaacacaagaattattggcgtacctgtagaaagcaatattgataacgtcaacgataacgatgatgataacaataaggaaaacttacctcctaaaatca

SEQ ID NO: 1769 - DNA, 416 bp, Cicer arietinum
acattacaatagccaacaaattaacaccagaaggaacatactaccaacatcaacgcaatcatagttcataacaatacataaactcttgtcaaccagataacaaatgagaaacaagagcgctttataccattagagttcatcatgatcgtaatcatccatgtaatcacggcgatgctttctatatcggtctctatatctgtcccggtgtcgtcggtcatgacccctctcttttcttcgcctctcaccttcctctcttgctctttgagcctcctcctcctcttgggctttttttattttctctgcttcctcaaaagcctctttttcaatctccctattggcaaacacttcatcaacaacttgttttgcataatcaggatcatcacaaatcaaaatgttgtcaaatactgaaccgcctt

SEQ ID NO: 1770 - DNA, 365 bp, Cicer arietinum
actcgccgtcccccttaccgtcatatccgtcattccacaagttccgggaaccggcgcctatggtgttgcgtgggcggttccattcttgtgggccgctgtttggggtatcatcaccatcaagtggtgtaagagagacatgaagcgggagagagaagagtgggaacttggagttgaccctgaaaaggagattaagagaaagggatcatctatcgagacggcatcatagtgggggtgtgagagtttggtgagtggtgatttaatagcgagcatggtggcatacacaatatccgcaaggcttgggcgtttaggaatgagagcagtgctaacgataacgatctgactcgttaataataattaataaaagt

SEQ ID NO: 1771 - DNA, 415 bp, Cicer arietinum
acaaagcttacctagaggccgtggaaagaggcgaccacctcgtccacagagcagcgttctagccgctttgggtttttctcctgcgagggttttccccaaggatgcacggttctaggttgcagctactggcaatcttaggggtcatggatttcttgccttagggtatggaaagctacttgatctatctgtgcaagagaattctatgttggagagggacgagttcccgctgacgggatgccctcttgaaagtaatgcgcctttgtgccgatgatatgctggatgaactagatgggagacgctgctggagggaagctctgcgaggatcaactgtattgatgtccatgggacgtgcttcaccgtacaactactgtagagctggctacgagtagagaggtgcctcttggaggtaatgagt

SEQ ID NO: 1772 - DNA, 187 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctcctgtatccaagttgtagctcg

SEQ ID NO: 1773 - DNA, 423 bp, Cicer arietinum
  misc_feature (420)..(420): n is a, c, g, or t
cccgattcaagtggtgctgcttatagtttggccttacaaacgagcttaccggatgttgctctatggtgtgatgtgcaattgacaaaagatgcagctgggatttgccttccaaatgtcaaccttttaaattctacttacgtttcaattgctatcccaaataaaactacgagttactcggttaatggtgtatccacccgtggctatttttccgtggattacaccttggaggacttatccaatgtcttcttatctcagggagtattttctcggtcagctctgcttgatgccaatggttatttaattcttactgttgatgatgtagtcaaatcagtggcgccacaaaaaccaaatctgtggttgaatattcagcatgatgcgttctatacacagcacaagttgagcatgagaagctatgtaccntgc

SEQ ID NO: 1774 - DNA, 416 bp, Cicer arietinum
acaatatttggtgttctatatattcttcttggaaagcgggtctgggtttggcctaacattcttgccgaggaagcaacactgcgagagctgttcagattttggccaaagaaagatgaagaggaaagacctaagtggacgacaaggattttctattctgtggtggctgtgctgttcatattactgctgaggcatcatgcacctgattatgctgcaagagcaaggtatcagaagagagtatcgaacatcattgatgatgttctcgaatggtcacctagtttagccttgtctgggatgatggagaagcaaccgaatgtggctaatgccacagggtccggtgatgctgcctcacaaggcagcacaacaggaccggagcatgaagctccaactgatggtaatgatgaaaaaactttctctga

SEQ ID NO: 1775 - DNA, 433 bp, Cicer arietinum
acaatatttggtgttctatatattcttcttggaaagcgggtctggtttttccctaacattcttgccgaggaagcaacactgcgagagctgttcagattttggccaaagaaagatgaagaggaaagacctaagtggacgacaaggattttctattctgtggtggctgtgctgttcatattactgctgaggcatcatgcacctgatgaagctgcaagagcaaggtatcagaagagagtatcgaacatcattgatgatgttctcgaatggtcacctagtttagccttgtctgggatgatggagaagcaaccgaatgtggctaatgccacagggtccggtgatgctgcctcacaaggcagcacaacaggaccggagcatgaagctccaactgatggtaatgatgaaaaaactttctctgaacaatataatactgaag

SEQ ID NO: 1776 - DNA, 335 bp, Cicer arietinum
acacaagaatggccgcaaagaggcacaatgaaaaacaccttcgattaataattacagaatcccactctaaaagaggcaggcagctctgaaagatgaaccgttcccatatcgcataataggtgtttcaccgggtaatctgtctacttcttcataaaatacaagaacttaacggtcccttatggcctcaggtctgtgcttcaaccaatgaaccatctccttgtccagtggagagttatttattacagcatctaacattgggctaccaaagaatttcggaaaacttctaaacaaccatatctggtctttgggccaagatctctgcggctgcttctcca

SEQ ID NO: 1777 - DNA, 180 bp, Cicer arietinum
accacaagagaggtctctgggccatcaaggccaaacacggcggcgctttccctaaacatgatcccaaacctaagcctgaagctcccgctgagaaggctcctaaattctaccccgccgatgatgtcaagaagccacttcgcaacaagcacaaacctaagcctactaagctcagggctaaca

SEQ ID NO: 1778 - DNA, 459 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccatct

SEQ ID NO: 1779 - DNA, 422 bp, Cicer arietinum
acacttacatcaagaaactcaacaataaatagcatgccaactggaggggttcagcaacctacatcaagcctttctagtggaagatttacatcaaacaatttacctgctgctctgtcacagctatctcatggaagctctcatggacattcaggagtcaacagtagaggaggtataagtgttgtaggaaatcctggatttagtagtagcacaaatggagttgccggttctattcctgggattcttcctacttctgctgcaattggtaaccgtgctactgttccaggattgggagtatccccaattttgggaaatgcaggtcctcggataacaagttctatgggaaacatggttgctgcggggaacatcgggaggataagctccggaggattgtccattcctggccttgcgtctcgcctaaattt

SEQ ID NO: 1780 - DNA, 328 bp, Cicer arietinum
  misc_feature (169)..(169): n is a, c, g, or t
  misc_feature (179)..(179): n is a, c, g, or t
  misc_feature (253)..(253): n is a, c, g, or t
  misc_feature (280)..(280): n is a, c, g, or t
  misc_feature (296)..(296): n is a, c, g, or t
  misc_feature (320)..(320): n is a, c, g, or t
ctaataaaccttttgaagatggatcttgaagagtgggaatcaatttctgatgatggctattttgatttcaatgaagatggtgagaaaaaaaaattcttagcaaaagggccagaaaatattttagacatggaggattatttgtatccatcatcacccccaagaaaacacnaccaacttgnccctttacaaattccattggaaataaaaattggtaacacttcaaatgatgttgttttgttgaaagacatgacanagaatcaatcttttgaggttgatcaanaagaaagtgtgtcacnagttttttttaagattaaggaaantgaatttg

SEQ ID NO: 1781 - DNA, 453 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgca

SEQ ID NO: 1782 - DNA, 414 bp, Cicer arietinum
acaggatccccgcttccttcaccatccagcatacaaggcacaaagcgctgtattttctcgagcccgtcacccgtcagcgggttcgggggcatactgtcgactttttccaccgaccagaattctctcacgcatcgctacatctgctgacgcatccacaatctccagtaccaagttgtagctcgtatcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaagggtgttgtcagagaaggtgaactctccaaaattccttc

SEQ ID NO: 1783 - DNA, 428 bp, Cicer arietinum
accgcttccatcctggtgatattctccgagtaactgggtttcataactctgctcctcagtttcactttgtgcgtcgaaagaacgtgttgcttagtattgactctgataaaacagacgagtcagagctacagagagctatggaaaatgcttcaaagttgcttgtggagttcaacacgagtgtggtcgaatacacgagctatgcagacacttagacaataccaggtcactatgtgatatattgggagttgttgaccaaggacatttcaaactcaccgagtaacgaggtgcttaatcaatgttgtctggaaatggaggaatcattgaactcggtttataggcagtgtagggtcgctgaccattcgattggaccactagaaataagggttgtgaagaaaggaacttttgaggagcttatggattatgcaatc

SEQ ID NO: 1784 - DNA, 329 bp, Cicer arietinum
ccaaaacgttactttatagcgtcgccgttgatcaacaagtgacaccttcagctgcatcacactcactactcgattgattaatgctaattgtttttgattttatttttttttaacttaatttcgattttggaacaacctacgactcttcgagtaattcgaggccactccttttatatggccattgctgataatggcttcttcctttttgacaaagattcttttaggtcctcgctcgattatcactcaccacccaccaattctctcttctttcttctctaaacggctgttctctatacaaactgttccaacctctacagcccaaaacacca

SEQ ID NO: 1785 - DNA, 403 bp, Cicer arietinum
  misc_feature (350)..(350): n is a, c, g, or t
tgttgatgggccatcagccaaagactggagaggtggaagagctgcctcatttaacatcattcctagcagtaccggagctgctaaggctgttggcaaagtgcttcctgttttgaatggaaaattgaccggaatggcattccgtgtcccaactgttgatgtctcagttgttgaccttacagtgaagcttgagaaggccgctacctacgacgaaatcaaggctgctatcaaggaggagtctgagggcaagttgaaaggcattctcggatacactgaagatgatgtggtctccaccgacttcattggtgatactaggtcaagtatctttgatgccaaggctggaattgccttanatgaccggtttgttaagcttgtctcatggtatgacaacgagttgggctacagt

SEQ ID NO: 1786 - DNA, 432 bp, Cicer arietinum
actacgaagctggtgcacgttttgctaaatggcgtgccgtcctcaaaatcggccccaacgaaccatctgagcattctatccatgagaatgcatatggtttggcccgatacgccgtcatatgccaagagaacggacttgttcctattgtcgagcctgagatccttgttgacggatctcacgacattcacaagtgtgccgccatcaccgagcgtgtccttgcagcaacctacaaggccttgagtgaccaccatgtcctcctcgaaggaactctcttgaagcctaacatggtgacaccaggatccgattcaccaaaggttgcacccgaggttgttgctgagcacaccgttagagccttgcagcgaaccgtacctagctagctcagcacgtcttttgctccagtaggagatttggcttcgttacagccacccagac

SEQ ID NO: 1787 - DNA, 422 bp, Cicer arietinum
actacccagagaccttcttcttctttgcggcctcggctgctgcccggaacaccaccaggctttgacaatctgtctcactggctgagacctctagaccaaaccgttgggtcgaaacggtacagagcttacctggagaccggggaacgaggcgactgccttgtccacagagcagcgttctagccgccttgggtttttccctgcgaggggtttccccaaggatgtacggtcctaggttgcagctactggcgatcttaggggatcatggacttcctgcctcagggtatggaaagctacatgatctatctgtgcaagagaattctaggctggagaggaatagatcccgctgacgggatgacctcttgaaagtaaatgcgcctttgtgccgatgatatgctggatgaactagatgggagacgctgctg

SEQ ID NO: 1788 - DNA, 161 bp, Cicer arietinum
actcgacctcagggaaggactcgtgactacacatgggtgcaggcactcgctgtcatgttcgacgtgcacactcttgttattgcagccaatagagtaaatcaatggaatgaaagtgttgactctcttacagcgaaatgggatggtgaatcagtaaccattcc

SEQ ID NO: 1789 - DNA, 370 bp, Cicer arietinum
cccgatcaacagcgactcatcttcgctggcaagcaacttgaagatggccgaactctttccgactacaacattcagaaggaatctactctccacttggttctccgtcttcgtggtggtatgcagatttttgtgaagactctcaccggaaagaccatcacccttgaggtcgagtccagtgacactatcgacaacgtgaagagtatgattcaggacaaggagggtattccccctgatcaacagcgtcttatcttcgctggtaagcagttggaagatggtcgcaccttgagcgactacaacatccatgaaggagtcaactcttcacctcgttctccgacttcgcggtggccagtaagcgattcctacgaacggt

SEQ ID NO: 1790 - DNA, 341 bp, Cicer arietinum; identical to SEQ ID NO: 202

SEQ ID NO: 1791 - DNA, 428 bp, Cicer arietinum
actttttgctggtattgctgctgaagctcttatatatggcgaggcagagggtggagaaaatgatgaaaatctatttagaagcatctgtcttcttcttgagcctccactgtctgtagctgagatgtctaatcaagcaagatggtcagttatgcaatcttataatttgctcaagtggcataaagctgcacaccgagctgctgttaaagcattggaaagtggtggcagtcttagtattgtaatcaggaggatcgaagagactttatattctgaaaaataaaccttcagagtttacataaaagaacaaattttgtcttttaagttgcataaagggttattgagatagatttaaactggagctggtttgactggtctttatataccattgcatatttgcagatgctacatgtattggaccttgtctaccatga

SEQ ID NO: 1792 - DNA, 313 bp, Cicer arietinum
ggataaagaagtggtgcgtgtaggagagattttgctgggtttgttgagtgaagggttgggattagatgcaggaaggctgccggaaatgggtttgtcccaaggaagggtgatggttggccactattacccattttgccctcaacctaatcttactgttgggctcaattcccatgcagatccaggggcattgacggtattgttgcaggatcatattggtggattacaggttaggacccaacagggttggattcatgtcaagcctcttgatggagctttggttatcaacattggtgatttacttcagataatttct

SEQ ID NO: 1793 - DNA, 319 bp, Cicer arietinum
caacactacggtgttgaaattggaaggaaaaagaaaactgcttccaaaaaagatacaccagaggaggccgaagctgttacagaagaagccaaaaagagtaaccatgtccaaagaaaattagagacccgccagaaagaacgccagcttgattcccacattgaagagcagtttggcggtgggcgtttgcttgcatgcatttcatctcgacctggtcaatgcggcagggctgatggttacattcttgaaggaaaagagcttgaattttacatgaagaaactccagaggaagaagggcaagggtgccgcttgatcgtacctgc

SEQ ID NO: 1794 - DNA, 313 bp, Cicer arietinum
caacactacggcgttgaaattggaaggaaaaagaaaactgcttccaaaaaagatacaccagaggaggccgaagctgttacagaagaagccaaaaagagtaaccatgtccaaagaaaattagagacccgccagaaagaacgccagcttgattcccacattgaagagcagtttggcggtgggcgtttgcttgcatgcatttcatctcgacctggtcaatgcggcagggctgatggttacattcttgaaggaaaagagcttgaattttacatgaagaaactccagaggaagaagggcaagggtgccgcttgatcgt

SEQ ID NO: 1795 - DNA, 313 bp, Cicer arietinum
caacactacggtgttgaaattggaaggaaaaagaaaactgcttccaggaaagagacaccagaggaggccgaagctgttacagaagaagccaaaaagagtaaccatgtccaaagaaaattagagacccgccagaaagaacgccagcttgattcccacattgaagagcagtttggcggtgggcgtttgcttgcatgcatttcatctcgacctggtcaatgcggcagggctgatggttacattcttgaaggaaaagagcttgaattttacatgaagaaactccagaggaagaagggcaagggtgccgcttgatcgt

SEQ ID NO: 1796 - DNA, 300 bp, Cicer arietinum
ggcatgcaagcttcaattgtctctaaaactgcgctaccatcgaaagttggcggttccagttcatcaccagcatgcctctttctttctttccattctttccattgtacttccgacttgctcattgatctcgcattgatgatctcgcatcgagatgtcctcctgtatcgtgtcatggaagcatggtccttgaaggcctgcgagtgtggttgtcattgccgagggtcgttggtgatggaagaaggaatttagtgcttgcagcaagagcaggtttggccgcaggcagaggcctcgtggttacag

SEQ ID NO: 1797 - DNA, 341 bp, Cicer arietinum; identical to SEQ ID NO: 202

SEQ ID NO: 1798 - DNA, 428 bp, Cicer arietinum
accgtggtgtaagaaagagggactccggcaagtgggtgtgtgaagtgagggaacctagcaagaagacaagaatttggctcgggacatttcctaatcccgagatggcggcgcgtgcgcatgacgtcgctgcgattgcgctcaggggaaagtctgcttgtcttaattttgctgattctgcttggaggttgccggttccggctacgacggatgcaagagatattcaaaaggcggcagctgaggcggcggaggcttttcgggcggagagtgagtttgagaggaaggagagtgagacgaagatggcggaagtggcgatggagcaactagtggaagaagaagaagagacggtgccggagtatctgagaaacatggtgctgatgtcaccgacacattgctgggggaacgactatggtgttgctgacgtggaattt

SEQ ID NO: 1799 - DNA, 426 bp, Cicer arietinum
ggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgaca

SEQ ID NO: 1800 - DNA, 425 bp, Cicer arietinum
ggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgac

SEQ ID NO: 1801 - DNA, 435 bp, Cicer arietinum
accagacggaaggttgattggctgactgacaagatgcgaagccgtgatcacacagtctcagcaactcatggagacatggaccagaacactagggacattattatgcgagaattccgttctgggtcttcccgtgttttaataactactgatcttctagctcgtggtattgacgtgcagcaagtgtcattagttataaattatgatctcccaacacagcccgagaactatcttcatcgtattggtcgtagtggaaggtttggtaggaaaggtgttgccatcaactttgtcacaaaggacgatgaaagaatgctgggtgacatccagaagttctacaatgtgataattgaggagctgccttcaaatgttgcggaacttctgtgatgagattttttcttccatcatactagaggaaagttggtttctgagataagtgtt

SEQ ID NO: 1802 - DNA, 174 bp, Cicer arietinum
  misc_feature (154)..(154): n is a, c, g, or t
gttcagtcgccgtaacgcgagcgaagacgctgagatccaaatcaacttttcagaatgaagttcaacgttgcaaatccaaccactggatgccagaagaagctggaaatcgatgatgatctgaaactccgtgcattttgggacaagaggatctcgncagaggttaatggcgatgct

SEQ ID NO: 1803 - DNA, 402 bp, Cicer arietinum
actctgctgcctctgattttgctttggcaattcttttcttcttatctgcaattcttgccctctttctctgaagagtaagaggagtgaccagtcgctgtatctttggagctttgctcacctttttcccagctttggttgtgaatgtcctacggtaggtgttgacatacttcctgacatcgtcctccttggacagattgaagagcttgcggattttggaagctctcttaggacccctcattcttggcttttcaacatctgtcaagcctggcaaatcattttcacccttcttcacaataaccaagttcaagacagagaggtctggactaacaatgcaaccacgaacagacttcctccttcgctctccattacgccttccatatcctcggaaacaaggagttcctc

SEQ ID NO: 1804 - DNA, 404 bp, Cicer arietinum
  misc_feature (389)..(389): n is a, c, g, or t
ttagaatcggcagtgtcacgtttggaggcgatatccaccggaacccactccgcatcttctccgtccgacgcttctgatgcggcattcgatccatcagttgttgcctttggcgatctgattgatcaatatgtcggtagggtttctagtgctgccgagattattggtggacaggttttggaggttaccaatagggtgaaggaagccttcgctgctcagaaagaacttttgattaagctcaaacacactcagaaacctgatcctgctgggctggctgaatttctgaaaccattgaatgaagtgatcgtgaaagctacctcattgacagaaggaaggagatctgatgtttttaatcacttgaaagctgctgttgacagtctctcaactctagnatggattgcatttac

SEQ ID NO: 1805 - DNA, 427 bp, Cicer arietinum
acattgccttagaaggcctagacattgtgaacacagaaacaatgcaacctgttcctgctgatggtaaaactgttggcgagatcgtgatgcggggtaatgctgtgatgaaaggctacttaaagaaccctaaagctaatgaagagtcctttgctaatggatggtttcattctggtgatcttgctgtaaagcatccagatggatacatagaaattaaagacagatcaaaggacatcatcatctcaggtgctgaaaatatcagcagtgtagagatagagaatactctatactcgcatcctgcaatactcgaagcatcggtggttgcgaggccagatgagaaatggggtgagtctccgtgtgcatttgtgacattgaagccgggagtggatagcagtaacgagcagcttctagttgaggatatactgaagtt

SEQ ID NO: 1806 - DNA, 341 bp, Cicer arietinum; identical to SEQ ID NO: 202

SEQ ID NO: 1807 - DNA, 189 bp, Cicer arietinum
acaaaagatttgccagtaactctgctatccgtaagagatttcgttggcagttgataagcgaggaattggtgagggacgtaacctgcaacagttgactggaatacggggtcacagacggtcacccgatgtgtcgcataaggtacctcgtcgtatcaccacatctacctgtattttcatattccaaagacg

SEQ ID NO: 1808 - DNA, 439 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccggagtctgtc

SEQ ID NO: 1809 - DNA, 430 bp, Cicer arietinum
acccgataattggacttctttttccggttttacattatcggatcaacctgattatgctaaaaagtcacacgagttagggttttctggtcaaagtgctgctaatcagttttcagagttcgacaatggtaagagtaaacaggtgggaattggagggagtaggtggtcctcaaatcaaacaaattttgctggttctgttgctgaagaaaggattaacttagggtgtcaagatataactgacagtcatggtaaagttccacatatgattggttgggagaaacatagcttgcctacaagtgcggatcacttagatgataaatcttgctggtggagaactaccaaacccatgccagttgatttttctcatacatcaggtttacaatccccttcgttgtctgtagaaactcatcatgaggctcctttgaagttagct

SEQ ID NO: 1810 - DNA, 432 bp, Cicer arietinum
acccttgctgattacaacatccaaaaagaatccacccttcatttagtgcttcggttgggaggtggcatgcagatattcgttaagaccttgaccggaaaaaccatcacccttgaggttgaatcgtctgatacgattgataatgtcaaggccaagatccaggacaaagagggtatccctcctgatcagcagaggcttatctttgcagggaaacaacttgaggatggtagaaccctagctgattacaacatccagaaagagtctacccttcatttggtgcttcgattgagaggtggcatgcaaatttttgttaagactttgacagggaagaccattaccctcgaggttgaatcttctgatacgattgataatgtcaaagccaagatccaggacaaagagggtatccctcctgatcagcagaggcttatcttcgcc

SEQ ID NO: 1811 - DNA, 461 bp, Cicer arietinum
ctttcttggcacccactgttagtgcggtgctaggagcgggattttctacgggctatgcgactacccaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtga

SEQ ID NO: 1812 - DNA, 409 bp, Cicer arietinum
actttctcaggaggtccactaatttgtagtgctgctcttgcagttatgaacaaaatatccaaacccgagttcctatctgatgtatcaaagaaaggtctatacttcaaagaactactgaaacagaaattgggaggaaattcgcacgtgaaagagattcgtggtgtggggctaattgtaggaatcgatttagatgtgtccgcgtcaccatacgtagacgcttgccgaaattctggacttctagtattgacagctggaaaaggtaatgttgttaggcttgttccgccgttgattataacagaaaaggagctcgagcatgcagctgatattctatcccaaactttgcctgttttggatgccaattaacaaaagtaggagaaagaagctttcccttcttgctggaagtcatcat

SEQ ID NO: 1813 - DNA, 356 bp, Cicer arietinum; identical to SEQ ID NO: 1437

SEQ ID NO: 1814 - DNA, 350 bp, Cicer arietinum
accgatcctttctccggtcatctgcaaggacttttgcgtcggagccgtggggatggtcgagctttttctctactcatccccccaaaaggcacctctctacccgtagcttgtcctacagtagttgtcggtgaagcacgtcccattggacatcaatacaattgatcttagcagagcttccctccagcagcgtctcccatctagttcatccagcatattatcggcacgaaggcgcatttactttcaagaggtcatcccgtcagcgggagctattcctctccagcctagaattctcttgcacagatagatcaagtagctttccataccctgaggcaggaagtccatgatcccct

SEQ ID NO: 1815 - DNA, 433 bp, Cicer arietinum
tggtttcgaatcagtcgatgggtctagaaagcaggtttctggaacaaacaaactacgttctggaaattattgggaaggagcgccaattatttgagacttcacaacaacaatgccagtataacttacaagaaaaaataaatcaacagtccatagaatacaacaaattgacaactcaaatcgaaggacaaaataaagacttactagaaatcaaacaatttttaaaattattggtccctagaatagttggaatcgaagcatcctataaagtactttcaactgaaaatccgataatggaaagccaacaaaaaccaagaccaataaaacggaaaaaacaaagctagagctccttgccttttcgggaatgtgaaagcgattttaagtttctgcctttgctcacatgacggaatctaaaatttgtgtgttgcagatttaa

SEQ ID NO: 1816 - DNA, 307 bp, Cicer arietinum
acaactcaagacctagccgatcaacatttcaacatgttgcgaccaagccttttaggtatatggtttctaatctaatgttcttaattgataactagcaaagttgagttttgaagggcacttagcaaagagggaacatatgtctccattcgtttcggccgtgaattatgtgtatcagtatttgaatttgacttatttaagttccatgtatgttatagtgtgtatgatggagacatttattagtagttttatgtaatgttgatgatcactcgtttaaactatttataagttcactgtcgacaatttttgt

SEQ ID NO: 1817 - DNA, 427 bp, Cicer arietinum
ctttcttggcacccactgttagtgcggtgctaggagcgggattttctacgggctatgcgactacccaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaat

SEQ ID NO: 1818 - DNA, 302 bp, Cicer arietinum
  misc_feature (165)..(165): n is a, c, g, or t
  misc_feature (168)..(168): n is a, c, g, or t
  misc_feature (172)..(173): n is a, c, g, or t
acaatcaagcggcacccttgcccttcttcctctggagtttcttcatgtaaaattcaagctcttttccttcaagaatgtaaccatcagccctgccgcattgaccaggtcgagatgaaatgcatgcaagcaaacgcccaccaccaaactgctcttcaatgtgggaantcnaagnnctggcgttctttctggcgggtctctaattttctttggacatggttactctttttggcttcttctgtaacagcttcggcctcctctggtgtatcttttttggaagcagttttctttttccttccaaattt

SEQ ID NO: 1819 - DNA, 220 bp, Cicer arietinum
acaattaagcggcacccttgcccttcttcctctggagtttcttcatgtaaaattcaagctcttttccttcaagaatgtaaccatcagccctgccgcattgaccaggtcgagatgaaatgcatgcaagcaaacgcccaccaccaaactgctcttcaatgtgggaatcaagctggcgttctttctggcgggtctctaattttctttggacatggttactctt

SEQ ID NO: 1820 - DNA, 435 bp, Cicer arietinum
acaatatttggtgttctatatattcttcttggaaagcgggtctggtttttccctaacattcttgccgaggaagcaacactgcgagagctgttcagattttggccaaagaaagatgaagaggaaagacctaagtggacgacaaggattttctattctgtggtggctgtgctgttcatattactgctgaggcatcatgcacctgatgaagctgcaagagcaaggtatcagaagagagtatcgaacatcattgatgatgttctcgaatggtcacctagtttagccttgtctgggatgatggagaagcaaccgaatgtggctaatgccacagggtccggtgatgctgcctcacaaggcagcacaacaggaccggagcatgaagctccaactgatggtaatgatgaaaaaactttctctgaacaatataatactgaagaa

SEQ ID NO: 1821 - DNA, 389 bp, Cicer arietinum
ctttccttaattttcacaattttcacaatatggatcaagaaaaagaacaaagtttcaaaaacccaagaaacataatcttcaacaaatacgaaatgggtaaagtattgggtcaaggaaactttgcaaaggtttatcattgtagaaacctttcaacaaatgagagtgtagcaatcaaggtgataaaaaaagagaagcttaaaaaagagaggctagtgaagcaaatcaagcgtgaagtttcggttatgcgtctagttcatcaccctcatgttgttgaactcaaagaagttatggcaacaaagagaaaaatctttcttgtaatggaatatgtaaaaggaggtgaactcttcaccaaagtagaaaaaggaaaattgaaagaagatgttgcaaga

SEQ ID NO: 1822 - DNA, 357 bp, Cicer arietinum
acacgaacaagaaccagaaagccataacaaaacagataccataacagagactactagatcccaccatctaaaatctcaactaaacataattaaccataaaaacttcatcacgagacttagcttacaaaactactctctccagtttccaccaccaccgccaccgccgctgccacgtgagtaacgggaaccaccatcaccacctccgccaccgtatccacggtccctaccaccaccataaccacctccaccaccatagcctccaccaccaccactgcttcggttgtatccaccttcacgacgacctccaccgtaaccacctcctccaccgccacttgaacggttttgagcttcgttaac

SEQ ID NO: 1823 - DNA, 419 bp, Cicer arietinum
acaggaaaccccgcttccttcaccatccagcataccaatggcacaaaaggtgctgtatttctcaagcccgtcacccgtcagcgggttcgggggcaatctattgtcgaactttttccaccgaccagaattctctcgcgcatcactacatctgctgacgcagtccacaatctccagtaaccaagttgtagctcgtagtcgactgtcgcggcggcagggaaaaacctcgggaaggaatcagaggccgacggtgcggcttgccttcaaaggagaaaaacccatcgcaatcggcgtcgttgatcggaaggatgtcgctacgaatgcccggggcatcgtcctccgatatctaagacgttctggttctgaggtgccgccattagatccgacaaaggtgttgtcagagaaggcgaactctccaaaat

SEQ ID NO: 1824 - DNA, 426 bp, Cicer arietinum
ttctttcttggcacgcactgttagtgccgtgttaggagcgggattttctgcaggccacgcgaccacacaaaactgcggggatgctatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaa

SEQ ID NO: 1825 - DNA, 414 bp, Cicer arietinum
ccgagaacgaggccggcgttgagttcgacgaccaaatcacccttactgctagcttcgaccacaaggtcgttgacggtgctgtcggtgctgagtggctcaaggagctcaagcaggttcttgagaaccctcttgagcttcttctgtagatcaggggtaggacgtcaagtggcccctgaaaaccgaattatgctgggaaagacgaaatggctggtcgagcgaggaatgacttttttatagaacaggaggagatgacctctgagggacggagatgcggtaaggagtttacttgggatatcgtggggacacccatgagagcattcctgggtaaggatcggtgaatcacgacgatgatgagcatctatgaggacacccacagagcttcttcgcctgatcacgccgcagcattcgtggaag

SEQ ID NO: 1826 - DNA, 192 bp, Cicer arietinum
acttcaaaactatccgaatcttcaagatatcattgccattttgggaatggatgaggtcagtgaagatgataagttgaccgttgcccgtgcccgtaaaattcagcgattcctaagccagcctttccatgtggcagaagtcttcactggtgccccaggaaaatatgttgaattgaaggagaacatcactagttt

SEQ ID NO: 1827 - DNA, 432 bp, Cicer arietinum
actcccattctcaaacacaaaaaagaccatcaaatcactcttaacaaaaccagcaagcgtcaacacgaggaagaattaaaactgctggaagaagagactgcgagaagactggaagaagctatcaggaagaatgttgaggagaagcttaattcagaggaagtcaaattagaaatagaaaggcgtgtagcagagggcgtaaagaatttatttgatgatgttgaagttcaacttgaaaaagaaaagcaagatgctcttaatgaagctagggggaaagaagaacaagctcgaaaagagagagaagagttggataagatgcttgaagagaataggaggagagtggaagagtctcagagaagagaagctctagagctgcaacggaaggaggaggaacggcaaagggaattagagatgattcggcgacagaaagaagag

SEQ ID NO: 1828 - DNA, 297 bp, Cicer arietinum
aaacttttccttggcacccgctgttagcgctctgctagggtagagaatttttgcaggctaaaatggcagcaaaagcagctgtggggctaacgggaccctaacagctgcctgaagaaagggattcagagagttgacctttcttcgcgacgagtgtctgcaacgacattgagcttcgcgagctcttgacaccgccttcgggcgctacttctcacgtgttatttgcggcttcttcttaccccgacattccggcttcgcgagccttcgacaatccgggctctgcgcccctcgacttcccgt

SEQ ID NO: 1829 - DNA, 440 bp, Cicer arietinum
gattagcgggtcgcggccgaggtacagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 1830 - DNA, 415 bp, Cicer arietinum
actgagctgaacaagaaaatttacaagcttggcaagtctggagaagagacccatgatgcccaaactgattatgataggactgagaaagacatcaccccaatgggtggattcccccactatggtgttgtgaaggaggattatctgatgatcaagggaggtgttgttggtcccaagaaaagggttattactttgcgtcagtctctactcaagcagacttctcgcaatgccttggaggatatcaaacttaagtttatcgatacctcttcaaagtttgggcatggtcgcttccagacaacacaagagaaacagaagttctatggacgcctcaaagcttagttatggctgctgctttgaaatgttggaaatcgttatttatgttatttttgttgccatccttttaaactctgttgtggtg

SEQ ID NO: 1831 - DNA, 268 bp, Cicer arietinum
  misc_feature (83)..(83): n is a, c, g, or t
  misc_feature (245)..(245): n is a, c, g, or t
ttagaatcggctgtgtcacgtttggaggcgatatccaccggaacccactccgcatcttctccgtccgacgcttctgatgcggncatcgatccaacagttgttgcctttggcgatctgattgatcaatatgtcggtagggtttctagtgcagccgagattattggtggccacgttttggaggctaccaataggccgtaaggaatccttctcttggtcagaaagcactttttgatttaagttcaaanacaatctgaaacctgatcctgct

SEQ ID NO: 1832 - DNA, 316 bp, Cicer arietinum
actttacagcttctccagaagtcatcatcatccttctacgcacagtatcaatgggataagaagccaaaccagcaccaattgtgattgcccatcccaaaaggaaactagcaaagaaactatcctgcatcccaccaaccaaaacaactggtttcagagaatcatacattccaaagtaaagaccacgatacactataattccaacgcacgagatgttgaatccacgataaaggccagcaatgccatcagatttgagggttttcctgtaaacatcaatcaaaccatcaaactgcctcccaccacccttctttgcagcctt

SEQ ID NO: 1833 - DNA, 430 bp, Cicer arietinum
cgaccactgtggactgtggttacctggcaacatcttccatttatttttccagaataacacggcgtatcatgacattcatcatcaactacaaggactgaaatacaattattcgcagccgttctttcccatatgggataaacttctcgggacatacatgcctttcaatcttgtaaagcggcccgaaggagggtttgaggcaaggccttcaaaggactagttacaatggtaattgttatggcagcgtttttcgatcgaaccagaggctttactgcagacatttcttgagttgagtggcgcttacagattttttttggtggcttgacaatgttttcagatcatgttattgcagtaggttttgccaacccaccttgtgtagcataacaatgatgtcgtggttaatgagataacttttcattattatgatgtacct

SEQ ID NO: 1834 - DNA, 423 bp, Cicer arietinum
actggccatttgcatcgcgggcgagctggaaggactggctgaagttcatggggcgctgctcctcatcgacaaggagagcaccggtaatgaggataatgacaccgccctggtcgttggagggctgggcatcgagggtagagacttggtgcttgaccttctcaaaggggaggccagcaagcttctcggtaatagcctgggtgccgaggacggaagcagactcgaaagtcagcatagagttgtctcggtagagagcagcaagacccttgcgatcactgtcgaaggtgttgtagtagaactcaacaaactgtttggcaacttcctcaaagtttccggccattttgaagtctggggacctgtcctggtcgtttggatcgctaatgcgtctagaaagggggaactgaaaggttttaactaaggtagaga

SEQ ID NO: 1835 - DNA, 458 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccatc

SEQ ID NO: 1836 - DNA, 430 bp, Cicer arietinum
gagaagcttactcgtcaacaggccaggcaacacatagaatctctagaggaatccacgataagggccattcagttttgaggaagcttgactcagatgggaaggttgatacaacacagacactgcacaatcttaatgaagatgagcttgcacggtttgaggaagcatggaaaggaaataatctagggaagttacctgattatgatgtgcataggaaaaatgattctagagttggtgagctaaacaaaaaccaggttcggtcacttccatctttggatcaggatagaaaaggaagtggatttgcatcaaagtatgaaacagggaacaattctgagggaagaacaaagaaagttgttagaatcaatattgagtgaatggtattatgtccattatgatattgtatgtaaaaatgtagaatgaagttgtgctatgg

SEQ ID NO: 1837 - DNA, 327 bp, Cicer arietinum
acttgccactggccgatcaacctggcatgtaaagaatatagctcaagccctaatttacaaggctaagcagaagcagaaaggagttgagcgaatgatgctacctagtgtggaagggtcagagggtggaaagtggattgtcattgactctgggaaagtgatagttcatgcacttgatgaaaaagcaagagcttactacaatttggagaatctttggacccatgggtcaattcaacatgagtctactgaggatttacaaaaagttttggtgaaggtccggcggaaaaacaattccaagaaacctgcccaaaagaatgcttaattggtgtt

SEQ ID NO: 1838 - DNA, 437 bp, Cicer arietinum
actataaatcggctacaaaaattctaatcatcaagtaagttttcaaaactgggtctctttccccgttcggctttagaagattcacaaatgatactgattcctgtggtttatcttatgacatgataggggcttaaaacatcccaccaggggtattggaaacaatgaaaatgatagaatggtaaagttaaaacgtcattgaataagatttaattggcaaaccgatttaaggctttagagaaagagcaagaccaaatttggcgggtgaaccaaatatctttgtggagtcatactcagcagatagggttatgagtgaatttggtctccacgctcgttggcattggaaggcagctttaccatcatcactgaatcgagtcttcaaaattgttttggggtctattgactgtgagctcccaatggtaaacctattctcaaaggtg

SEQ ID NO: 1839 - DNA, 426 bp, Cicer arietinum
ctaataaaccttttgaagatggatcttgaagagtgggaatcaatttctgatgatggctattttgatttcaatgaagatggtgagaaaaaaaaattcttagcaaaagggtcagaaaatattttagacatggaggattatttgtatccatcatcaccaccaagaaaacacaaccaacttgtccctttacaaattccattggaaataaaaattggtaacacttcaaatgatgttgttttgttgaaagacatgacaaagaatcaatcttttgaggttgatcaagaagaaagtgtgtcacaagttttttttaagattaaggaaaatgaatttgttgacatgaaaattgaatcaccaaagtcaaatagtggaaaaggggttactagttcaccaagaatgattattgagaaagatgtgtttggtgaaaaagaa

SEQ ID NO: 1840 - DNA, 430 bp, Cicer arietinum
aaaaattctttcttggcacccactgttagtgcggtgctaggagcgggattttctacgggctatgcgactacacaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaa

SEQ ID NO: 1841 - DNA, 436 bp, Cicer arietinum
accaagatgaagttaccaagatatgataaatctgcatttggtgggagaggtgatcgggctgatccatcgacatggcctgaaattgaagggcccctaacagttgtgttgtttgaaggctggatgcttggtttcaaaccccttccagttgatgctgtaacgtccgttgatccccagctagaaacagtaaataaaagccttgaagcttattatgatgcatgggacaaatatatagattcatggatagtcattaagattaaggacccaaattgcgtctttcagtggcgcttgcaggctgagattgcaatgagggaagcaggcaatcctggaatgtctgatgatgaggtgagagattttgtttctcgctacctgccagcatacaatgcataccttcctacactttattcgcagggtccgaatggatcagatcctcaacatc

SEQ ID NO: 1842 - DNA, 435 bp, Cicer arietinum
atattcatattcatattatttttacattaagggatggcaggaattgattttgaggatttgttaccagtaattgctaataagctaggtggtgaaggtttaatgaaggaactttgtaaagggttcaatttacttatggacaaagacaaaggtgtgattacattggagagtttaaggaaaaactctgctttaatgggtttgaaagatttgaaggaagatgagttagtgagcatgatgagagaaggagatgttgatggtgatggtgcactcacagagatggagttttgtgttttgatgtttagattaagtccacagttgatggaggaatcatggtttttgcttgaagaagcattgcatcatgaactcaacaataaccattgatattgaatatgactcgttattaagtcattgttaacctttattatcatgttcttgact

SEQ ID NO: 1843 - DNA, 414 bp, Cicer arietinum
acttaacaaaggcaaacatttaatctttgttgctctatgcagtttctttcttctcttaatattgacttgatcaaatatgctctaattttgttcacactctgtagcactacaagtgagacccaactctcattgctaatttttgtagctctttacacctaccatcattactttcacactaaaaagcaatggtctcatataaaccaaataaaacatcattattcagattgaagcttttatcataatggaatctaaaaaaataaggtatcagtcaattttcaattaccaaaataacatgatttcatcactaaagtgtaatataaattactgcaacagcccatattttcttcatcaaacaaggtgaagtgaaggaactgtataactgaataaggaagtaagctactaatccttagttaa

SEQ ID NO: 1844 - DNA, 431 bp, Cicer arietinum
  misc_feature (423)..(423): n is a, c, g, or t
accttcacacctagataatcaccaagtgcccgcataaccttctcaatctgctgggcaagctcacgagttggtgccgagaccaaggcttggcattctgttacattatagtcaagttgctacagaattccagagcagaaagttgctgtcttccctgttccagactgagcctgttgtataacatcaagtcccttgcagaatggaactattcccctttgttgaatagctgatggcttctcaaaaccatatgcgtaaatgcctctgagaagattctcttgcaagtgcatggcatcaaaactatcataaacctcatcataagatgtgaagaagtcctgtgcatcagttgtgagtaactcattcattttggaatcaaactgcttagcatcaaactgggaaccctctggtgcaactcctgccatgacttanggagatga

SEQ ID NO: 1845 - DNA, 334 bp, Cicer arietinum
accaaggctgttcgctgcactcaatgcaatcatggcgaagctgtatttttccaggcaacggctagaggggaggaaggaatgacgcttttcttcgtttgctgcaaccctaattgtggacaccgttggagagactgagattcttacatgctcaaatcaaggttcaactgtttgggtgatctaacatattttgcggtccactattgattagaagagagaattttgtacttacatgtaaacttgggtggtgtgtggaggactatgatgcagattacagaattatgtgtgcttcttgttttaagtgtagttgctaatcaaatgattaatggaaaaatcc

SEQ ID NO: 1846 - DNA, 367 bp, Cicer arietinum
accaaggctgttcgctgcactcaatgcaatcatggcgaagctgtatttttccaggcaacggctagaggggaggaaggaatgacgcttttcttcgtttgctgcaaccctaattgtggacaccgttggagagactgagattcttacatgctcaaatcaaggttcaactgtttgggtgatctaacatattttgcggtccactattgattagaagagagaattttgtagttacatgtaaacttgggtggtgtgtggaggactatgatgtagattacagaattatgtgtgcttcttgttttaagtgtagttgctaatcaaatgattaatggaaaaatccttgtgggtcagtgtgatgataaattttatggac

SEQ ID NO: 1847 - DNA, 429 bp, Cicer arietinum
acagagcttacctggagaccgtggaagggggcaattgcctcgtctacagagcagcgttctggccaccttgggtttttcccctgcgaggggtttccctaaggatgcatagttctagggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctatgagtagagaggtgcctcttgggggtaatgagtacctcggccgcg

SEQ ID NO: 1848 - DNA, 220 bp, Cicer arietinum
cgaaagacatcgtcaatcaagatgagagccaaatggaggaagaagcgggttcgccgcctcaagcgcaagagaagaaagatgagggctcgatccaaataaacacctcgcacctcaacctgacttgactcatctttcatgatgttacgacttcacacgcacaacgatactctggccgaagctgcgaacgctactctggcgcctatgggatgtcccgcaacgt

SEQ ID NO: 1849 - DNA, 297 bp, Cicer arietinum
acaaaactacgtaagcacataagaatctcatgactcggaatgatttaattggccattttcagtgatagcatccaagttccagcctctttctgcagcttctcttctcagttcatgtaggcaaatttcaacagaagcacacgcagcactgatgcctatatttttctgacagagctccttcttttgcattgacaaagcattaagctcatatgcagtattttgctgatgatatttcctttcacgattaactttttcaatcttttcattttgttcctgagctaatttctgcattctgaaaat

SEQ ID NO: 1850 - DNA, 359 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcgagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccag

SEQ ID NO: 1851 - DNA, 298 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggaga

SEQ ID NO: 1852 - DNA, 341 bp, Cicer arietinum
accgaggtagccctgatcaccgacaccgccacagttgatgatgataccgaggatgatgaatcccaagcaagcgcagatcttgatggcggacaggacgaattcgacctctccgtaaccacgaacaccaaagatctgaacaatggtgagagcgacgaggaagacagtaacccaaacagccatgtggatgtcagtgcgccagaactcaatggtctttgacgcagcgatcaactcgaaggggagaaccgtgagccaggacagagcatattcccaaccgcaggcgaagccccaggagggatcgacgaagcggacaatgtaggtgtagaaggcaccgttgacggggt

SEQ ID NO: 1853 - DNA, 426 bp, Cicer arietinum
acgggaagtctcgtcaacgagatatggcccgagtcccccgcagtgtcatgtcctcgtcatttctcaggtaagaagcatctatgggttctgcttgtaggcctctcccttagctccatgggtgctctcatcgatcttgtcgccaactgcatctttggcagcggaagcacgagtgccaatgccggcgttggagtccttggcaacctccttgttagcctccttgctggtgccagagataccctcctggaccttctcggtagcttggtgaacggtgttcttgatggtatccattgctggtttatatagttttcttgtttaaaaagaaaaagataattgagttggttatgttgaggttggtacctgcccgggcggccgctcgagcgtggtcgcggccgaggtacaccataagcagtataatgaagctatgga

SEQ ID NO: 1854 - DNA, 433 bp, Cicer arietinum
caaaaccgctgggtcgaaatggtacagagcttacctggagaccgtggaatgaggcgactacctcgtccacagagcagcgttctggccgctttggggttttctcctgcaagggttttccccaaggatgcacggtcctaggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgccttcgtgccgataatatgctggatgaactagatgggagacgctgctggagggaagctctgctaagatcaattgtattgatgtccaatgggacgtgcttcaccgacaactactgtagggcaagctacgggtagagaggtgccttttgggggga

SEQ ID NO: 1855 - DNA, 427 bp, Cicer arietinum
ctaataaaccttttgaagatggatcttgaagagtgggaatcaatttctgatgatggctattttgatttcaatgaagatggtgagaaaaaaaaattcttagcaaaagggtcagaaaatattttagacatggaggattatttgtatccatcatcaccaccaagaaaacacaaccaacttgtccctttacaaattccattggaaataaaaattggtaacacttcaaatgatgttgttttgttgaaagacatgacaaagaatcaatcttttgaggttgatcaagaagaaagtgtgtcacaagttttttttaagattaaggaaaatgaatttgttgacatgaaaattgaatcaccaaagtcaaatagtggaaaaggggttactagttcaccaagaatgattattgagaaagatgtgtttggtgaaaaagaag

SEQ ID NO: 1856 - DNA, 434 bp, Cicer arietinum
aaaaattctttcttggcgcgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaag

SEQ ID NO: 1857 - DNA, 433 bp, Cicer arietinum
acagagcttacatggagaccgtggaatgaggcgactacctcgtccacagagcagcgttctagccgccttggggttttctcctgcaagggttttccccaaggatgcatagttctagggttgcagctactggcgatcttaggggttatggttctcctgcctttgggcatggaaagctacttgatctatctgtgcaagagaattctaggctggagaggaatagttcccgctgacgggatgacctcttgaaagtaatgcgccttcgtgccgatgatatgctggatgaactagacaaaatcgcagttgcatggggatatgtcctgaatcacctgctttgacatccaagatgatgtgcttgaacctaccgtagggctggctacgagtaggaaggtgccctcgggggaaggagctcgagaggctctccgttgatgcgagt

SEQ ID NO: 1858 - DNA, 293 bp, Cicer arietinum
actaggttgaattactattgcgacactgtcatcagtagggtaaaactaacctgtctcacgacggtctaatcccagctcacgttccctattggtgggtgaacaatccaacacttggtgaattctgcttcacaatgataggaagggccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 1859 - DNA, 293 bp, Cicer arietinum; identical to SEQ ID NO: 1858

SEQ ID NO: 1860 - DNA, 417 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 1861 - DNA, 435 bp, Cicer arietinum
gaaagacatcgtcaatcaagatgagagccaaatggaggaagaagcgggttcgccgcctcaagcgcaagagaagaaagatgagggctcgatccaaataaacacctcgcacctcaacctgacttgactcatctttcatgatgttacgacttcacacgcacaacgatactctggccgaagctgcgaacgctactctggcgcctatgggatgtcccgcaacgtactgagctgggatttgacttcgggaactacgtcacggtggtgggaccccgcacttgagcggctgttgggcactcaatgaacattatgggaatggggattatgacaattggacggtcgggaaccaggcggtgttaggaccaaagaccatcagtcatgctcgcaaaagacgatgcaacgagaacttgattggcagttctaagacaaagaaatacagag

SEQ ID NO: 1862 - DNA, 436 bp, Cicer arietinum
ctttcttggcacccactgttagtgcggtgctaggagcgggattttctacgggctatgcgactacccaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactacgtcagcagatgtagcgatgcgtgagagaattctggtcggtggaaaaattcgacaaat

SEQ ID NO: 1863 - DNA, 432 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccgga

SEQ ID NO: 1864 - DNA, 434 bp, Cicer arietinum
actgtttacgacatcggctgggcgcccggggctgaccccatccaagactctccctgtgttatcatgatggagtttgacaaatacaacggaccggtgttcctgaccacccccgatggcaagaagattgtcccgattctctcagttgagagggacttcctcatcggagccactttctgcgctcgcacgcagtttcccctgatcgtatgctacgccattaccgtgcacaagtcacaaagcatcacagaagatatgatcgttacggatctctcctgccaggactttcagactggtttaagctacgtggctgtctctcgcgtggaaacgctcgagggcctgatgttggaggctccatttgatcgtaatcacctggtctacgggtctcccccggatggcatgaagatgaagaagagggatcaggagcttaggaaacgaca

SEQ ID NO: 1865 - DNA, 433 bp, Cicer arietinum
gcttgtcccaacagaaaacaactaaaaacccaaattcaaagaccttgaattgaatagtcctcttttgatcataatcattagtattcatctatgatcgatttggattcggttcagtccatacccgagttataaaacacatcttcatcgaattgacaaatcgaaatcgatggggaatatattcgtcaagaaacccaaggtgacggatgtcgatcgtgcaattcttgcactcaagacccagagacgtaaacttgcccaatatcaacaaaagcttgatgctattattgaagcagaaaagcaagctgcacgagacttgattcgtgaaaagaagaaagatagggccttgctggcattaaagaaaaaaaagacacaagaagaattgttgaagcaagttgacgcctggcttataaatgttgagcaacaattagcagatatt

SEQ ID NO: 1866 - DNA, 431 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctcggccgacct

SEQ ID NO: 1867 - DNA, 303 bp, Cicer arietinum
cggccgaggtactaggttgaattactattgcgacactgtcatcagtagggtaaaactaacctgtctcacgacggtctaatcccagctcacgttccctattggtgggtggacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 1868 - DNA, 382 bp, Cicer arietinum
agatagagagataaagttgaagttcaacaccgaccggactttcggtgctccgctgatcaccgttgtggctcccacctctccgtattttacgctctaaaggaccacatgtctaacatagaggctgacaaagaaatcggacagatggatttggatgcgtctgaggggtcagttaacatgccatcgtcccaaaagcaggaggaagctttaaagaaaaaatatggaggaattgtgcccaaaaagccaccacttatttctaaggaccatgagcgtgcttactttgattctgccgattgggcattgggaaagcaaggcggtgagaagccaaagggaccacttgaggctcttcggcctaaactacagccaacacagcagcaaacacggt

SEQ ID NO: 1869 - DNA, 435 bp, Cicer arietinum
gcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacggg

SEQ ID NO: 1870 - DNA, 326 bp, Cicer arietinum
actcattaccctcaccaggcacctctctactcgtagctcgccctacaggaggtgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctataattctcctgcacagatagatcatagagctttccataccctgaggcaggaagtccatgatccccaaagatcgccagtagctgctaaccctagaaccgtgcatccttgggga

SEQ ID NO: 1871 - DNA, 433 bp, Cicer arietinum
gcttttggagcagcatgagaaattaaggggtaaggttgttttggttcagattttgaatccagctaggagcagagggaaagatattcaagacgtgaagagtgagattgaagctattgctaaagagattaatggtaaatatggtgatgataaagataactacaagccaattgtttgtataaagggtccggtttcgactcaggagaaggttgcatactatgcgatatcggaatgttgtattgtgaatgctgtgagggatggaatgaatttgatgccttgtgagtatactgtttgtagacaaggaagtgttgaattggataaagcacttggattggaaaaagatgaggctaaaaagagtgttatcattgtttctgagttcattggttgttcgccttcgctcagcggtgcgattcgtgtgaatccttggaacattgat

SEQ ID NO: 1872 - DNA, 439 bp, Cicer arietinum
acccttaatgtttttgtaggacacatcattaacatgaacagctgatgtttgatttagacattcctttgtcaaacaatagtattggtctataaggatacaatttcctacattttccatttgaatgttctcaaattttaaacctgtcactgatcccattccaccttgccatgtcttgattcttagtccattgtctgattcccttatcactgtgtcacggactgttaagtttgaaacacatgcttgggagttgtgcacaccaagacttcctatgctaatcccgtggctaggaccacaagtgacaccagctatgtccacatctgaggttccgggtccaattgaaatacaatcatccccattgcttatcatagagttatatattccaacagcctgtgagttttcaacatggattccatctgtgttagggctgagtttaggtgca

SEQ ID NO: 1873 - DNA, 109 bp, Cicer arietinum
gacgacaagggcaatgagaacgtggcggttgagaaggttacatacacaagaccagttgagccttcagcgggagggtcatcataaaattcatatagatagggggagttta

SEQ ID NO: 1874 - DNA, 215 bp, Cicer arietinum
gacgacaagggcaatgagaacgtggcggttgagaaggttacatacacaaaaccagttgagccttcagcgggagggtcatcataaaattcatatagatagggggagtttacattcagcgacgtattcaagatcagcagcagaatttatacccagtcacactctggaagaccacgagatgggactttcatatccaacaaagcatcaattggcaaggc

SEQ ID NO: 1875 - DNA, 433 bp, Cicer arietinum
actggggttggacagcatcagatgtggtctgctcaattttatagttataagagacctaggcagtggttgacttcaggtggtcttggtgctatgggatttggattacctgctgccatgggagctgctgttgctaatcctgactctgttgtggttgacatcgatggtgatggaagttttatgatgaatgttcaggagctggctacaataaaggtagagaatctccctgtaaagatattgttgctgaacaatcaacacttgggtatggttgttcagtgggaggatcggttctataaagccaatagagctcacacctatctgggagacccggctaacgagaaagaaatattccctaatatgttgaaatttgcagatgcttgtggtataccggcagctcgcgtgacaaagaaggcagaccttagagccgcaattcaga

SEQ ID NO: 1876 - DNA, 272 bp, Cicer arietinum
actgacttatgaagacaaagaaggagattggatgcttgttggagatgttccttgggggatgttcgttagttctgtgaagagactaagaatcatgaggacatccgaggctaacggactcggaccaagattggaagaaaagaacatcagacagaaaaacaagcctatatagatattattttcatggctaaaggataagagaaacttacttatcaccttatatgtaacacgaaatagaagaagcaggaaaaaacagaaattgaaaaaagtaaagg

SEQ ID NO: 1877 - DNA, 431 bp, Cicer arietinum
caatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagttcgacaatagattgcccccgaacccgctgacgggtgacgggcttgagaaatacagcaccttttgtgcc

SEQ ID NO: 1878 - DNA, 434 bp, Cicer arietinum
ctagtttcaacctcgttccaccgttcgttatcgtaatgaaaggaggaaagtccaaaggtgaatcgaagaaagccgatgctaaacttgcggtgaataagaagggtgccgccgccactaaaggcggaaggaaaccggccaagggaaaagagcccaaagatcctaacaggccaaagagacctccaagtgctttcttcgttttcatggaggagtttaggaaacagttcaacaaggaaaaccctgacaacagagctgtgtctgcggtgggtaaagctgctggagcaaaatggaagtcattgactgatgctgagaaagcaccatatgctgctaaagcagaaaaaaggaaggcagaatatgagaagaacatgaaggcctataacaagaaacaggctgaaggtccagctgctgttgaagaggaagaatccgagaaatcagaa

SEQ ID NO: 1879 - DNA, 412 bp, Cicer arietinum
actaagtctctgagccatgaaggatagttccaaagttctagtgcaccacaagcttggtgacccattgatactaattgccttgcaactccaatctctctcaaagtattttctccttgtagtccaatcaaatcattcataggaatctctttaactaatggtggagatttattatgtcctgtagttgctgatatgtctctcaaatgcaaggtatcaggtagcagtgaatgcattctatagacactcgcaaattcctctgttaaagaatatggaacaccatgattttctgttttcttcatgcccacaaatccactcaagattgaatttccaacgtgcccaaatgtgtccttgaacttctttcccaataatccataccaattggctcgcatgcctgcaagcaaagtgtctgttttaa

SEQ ID NO: 1880 - DNA, 136 bp, Cicer arietinum
gacaatttgaaggcaaagttacttgagaagttagaacaatccattacaaacattcagctgagccctgaggagataaacaatgcttcaagggacctttctccttcagcatctgctcgcaaggcaggaattcatgaat

SEQ ID NO: 1881 - DNA, 415 bp, Cicer arietinum
cgaggccaaagctcacgagagcaccgaagtcacccaccaccaacagtccaaggaggtcgagaagaagcccggtgatcaatccaagtactggctcaccgagcgcaccttcggcgagttctctcgcagcttcaacttccccactcgtgtcgaccaggacaacgtctctgccaagtttaaggacggtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgtaggcctggcttggtca

SEQ ID NO: 1882 - DNA, 271 bp, Cicer arietinum
actgacttatgaagacaaagaaggagattggatgcttgttggagatgttccttgggggatgttcgttagttctgtgaagagactaagaatcatgaggacatccgaggctaacggactcggaccaagattggaagaaaagaacatcagacagaaaaacaagcctatatagatattattttcatggctaaaggataagagaaacttacttatcaccttatatgtaacacgaaatagaagaagcaggaaaaaacagaaattgaaaaaagtaaag

SEQ ID NO: 1883 - DNA, 272 bp, Cicer arietinum
tttttcccctttgaaggcaagccgcaccgccggcctctgattccttcccaaggtttttccctgccgccacgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgtacc

SEQ ID NO: 1884 - DNA, 203 bp, Cicer arietinum
gtatgaatgtagtttattgctccactggatcaaccatccagacaggagttgctaaatcacgataacaatgctacccaaactccatcccgagcagtctattctactcagaacactctacgtgaggctgtctgcttagcagcatccctcatcgcaggcgcagaaaccacagcagatctcacaggcagcctcctcaccaccacgca

SEQ ID NO: 1885 - DNA, 437 bp, Cicer arietinum
actttaggtattccatgactaccaccaagggtgttgtatacttgccactcataaggagggccatagctgcaacctttactgtttctatgttcaaatttcagagcaacctcaatagctccaggagcattcgctcgctcgcgacggccaacaaaaacctgaccaaatccacctttaccaagtttcctctctaccttgtaaagagacgatcctcctacttgaaccttatcaggaagaggtggagtgttggcatcttcctctggagcaacggcaacagccttgtccttattagcactcaatccaccacctctttcatcaaccatcgcagccacgccttgttctataacgttcaccgtcggtggtggtggttcaacgtaagtatcaggaggaggattcaataactgtttcaacggattctcacgctccgatttcttcgccgc

SEQ ID NO: 1886 - DNA, 436 bp, Cicer arietinum
ggagcttatagtgaaaatctgccggtgatttgcatagttggtggacccaattccaatgactatggaaccaaccgtatcctccatcacaccattgggttatccgatttctcccaagagcttcgatgctttcaaacgatcacgtgttttcaggcagtggtgaataacttggaggatgcacatgaacttattgatactgcaatttctactgctttgaaagaaagcaagcctgtttacatcagcataggttgtaaccttcctgcaattcctcgtccaacttttgctagggacccagttccattttttcttgcaccaaaggtaagtaatcaagaaggattagaagcggcagtggaagaagcggctgcgtttctgaacaaagcggtgaagccagttattgtgggtgggccaaaactaagggtagcaaaggcacaaaaggcat

SEQ ID NO: 1887 - DNA, 417 bp, Cicer arietinum
acctctagatataaggtcgtggtttaagaataaaacaataacagttatatcgtcatgaaaatgccgtcgaactttcttgtcaatctgccgaaggtctgaatatcgcatttcacgttttctagctgcttcctgcaaggccgccttgataagtctcttggcactacccgcacgtggatttctgtgaacaatatcaactgcttgatcattattcaggtgctcccataaaccatctgatgcaaatataacgaaggaatcatttggttggagaggatgagaaataacagatggattagcagacaagataggcatgttcattggttcaggaagcctgaattttgcgttaattggttcccgattaaactgcgcatgtttcatatacacgtcgcctatagatctagaaacctgaataattccttt

SEQ ID NO: 1888 - DNA, 429 bp, Cicer arietinum
acttgctattttccgtcaagttgcttgccgcatgaccaacaagcttcctgcaatatcatctaatgatgatcagagaacttcagaaccaactctggagacaagaaacatgacagttcttcctccatcaacccaaacacatacagaggaaaatctcctcccctccttgctgaaaaggttaggtgatcttgaagagaaggttgacacactccaatctaagccatctgaaatgccttatgagaaggaagaattgttgaatgctgctgtctgccgggtggatgctttggaagcagagttaattgctactaaaaaggctctgtacgaagcattaatgaggcaagaagagctgcttgcttacattgaccgccaagaagaagccaagttacggaaaaagaagttttgctggtaaaatatactgctgatagcaagata

SEQ ID NO: 1889 - DNA, 430 bp, Cicer arietinum
tttggaagtgcagctaccatgaacatgtgttctaagtgccacaaagacatgatgctgaaacaggagcaggccacgcttgcagcatcttccattgggaacattatgaatgggtcatcaagcagcagtggaattgagcctgctatcactgcagatgtggatatctcagttaattcaatggaacccaataccatatctgcacaaccgctagttgcttctggctcagaggagattgtggagatgaagcccaaggatggtcctaaacggtgcagcaactgcaataagcgggttggttttacaggatttaattgtcgatgtggtaaccttttctgcgccgcacatcgctactctgacaagcataattgtccttttgattaccgcactgctgggcgggatgcgatagctaaagcaaacccggttgtcagggctgaga

SEQ ID NO: 1890 - DNA, 197 bp, Cicer arietinum
acacctttttcccatggaagtgtgatatatggaagcaatgaagaagttttgaagaaagtgagaacttgcaaagatgggaagctgaaaatatcaaagcaaggtaaccttcaccttaactgagatggaacaacaatttcaggtgacattcggagtagttgggctggggtcacaactttgcagaccctttttgttcaaga

SEQ ID NO: 1891 - DNA, 432 bp, Cicer arietinum
acaacaaccttttgctattggaggatctgggtccagttacttatatggattttttgaccaagcttggaaagatggaatgaccaaggacgaagctgaggaactagtcaaaaaggcagtttcacatgccattgctcgtgacggtgctagtggaggagttgtccgaacagtcataataaactcagagggagtgaccaggaatttctaccctggagatcaactgccgatatggcacgacgaactggagtctcataactcattgctagacattcttggtgccccagagccaatgaacatatgaagttgggactaaagagtcatcggctagattatatcccgcgctgtcagccctttctgtgaactattttatcgaatttgtgtaatcgttatattgttcggttagatattggttgttattatatatcctcatgttgt

SEQ ID NO: 1892 - DNA, 431 bp, Cicer arietinum
acaacaaccttttgctattggaggatctgggtccagttacttatatggattttttgaccaagcttggaaagatggaatgaccaaggacgaagctgaggaactagtcaaaaaggcagtttcacatgccattgctcgtgacggtgctagtggaggagttgtccgaacagtcataataaactcagagggagtgaccaggaatttctaccctggagatcaactgccgatatggcacgacgaactggagtctcataactcattgctagacattcttggtgccccagagccaatgaacatatgaagttgggactaaagagtcatcggctagattatatcccgcgctgtcagccctttctgtgaactattttatcgaatttgtgtaatcgttatattgttcggttagatattggttgttattatatatcctcatgttg

SEQ ID NO: 1893 - DNA, 436 bp, Cicer arietinum
acaacaaccttttgctattggaggatctgggtccagttacttatatggattttttgaccaagcttggaaagatggaatgaccaaggacgaagctgaggaactagtcaaaaaggcagtttcacatgccattgctcgtgacggtgctagtggaggagttgtccgaacagtcataataaactcagagggagtgaccaggaatttctaccctggagatcaactgccgatatggcacgacgaactggagtctcataactcattgctagacattcttggtgccccagagccaatgaacatatgaagttgggactaaagagtcatcggctagattatatcccgcgctgtcagccctttctgtgaactattttatcgaatttgtgtaatcgttatattgttcggttagatattggttgttattatatatcctcatgttgtgtac

SEQ ID NO: 1894 - DNA, 295 bp, Cicer arietinum
acctttgttttatactttcaaagaaagagaaaaaaaattagcttcaacaaaaaccgaggaaaaaggaacagaatgtaacaaagttaacactgaaccgatccttttgaaggtttttttttttggatattcagatgagaacgactttgcaagaaagtaacagtttctggtttttttttttttttttttcagcttgtttctttcactgcgcgtttgttatatagaaaaatctaaaaacaagagatagaaaaaataaataaaaaaatagctacttttttttattaatttttggcgggta

SEQ ID NO: 1895 - DNA, 433 bp, Cicer arietinum
actggagagagtgtagtctgactttggtgattgctgtagttatggatcctcgttttaagatgaagcttgttgagttcagtttcacaaaaatctacagtgaggatgctcatgtgtatgtaaagattgttgatgatggaattcatgagctgtttcatgagtatgcaacccttcctctgccactaacaccggcatatgcagatgaaggaaatgcgggaagcaacgcgaagatggagggatctccaggaggaactttgttgtccgataatggtcttgctgactttgatgtctacattatggaaacttctagccatcaaacgaagtctgaattagatcagtatttggaggaatcgttgttgccccgagttccagattttgatgtattaggttggtggaaactaaacaaacttaaatatcccacactctccaagatggc

SEQ ID NO: 1896 - DNA, 460 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccatctg

SEQ ID NO: 1897 - DNA, 438 bp, Cicer arietinum
acgagcatctgatgcatctattaccaaggagattgcatcagatcttcagggttggttggatgaccttactgatggtggtgtggagtatatgcctgaagatgaagtcaaatcggctgcagccgagaggcttcgaatatcaatggaaaggatagccttgttgaaggcagcccaaccacggcccaaaaccccaaaatccgaatccgacgaggaagaaggtaaagacaaaaggaaggatggggaagaagatgagaaaaagaagggacctacaacactatccaaattaactgctgaggaggctgagcatcaagctcttcaagcagcagtgctacaagagtggcatatgctctgcaaggataggaccactgaagttaactaactattttcctctttctgtattgatttgttatgtttgttttttaattttatctgttttggggc

SEQ ID NO: 1898 - DNA, 457 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccat

SEQ ID NO: 1899 - DNA, 305 bp, Cicer arietinum
gacatccttccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 1900 - DNA, 434 bp, Cicer arietinum
acgggaagtcgaggggcgcagagcccggattgtcgaaggctcgcgaagccgtaatgtcgaggtaggaagaagccacagatatcacaaaggaaaggtgcccgaaggcgatgtcaagagctcgcggagctcagtgtcgttggagacacatgtcacgaagaaaggtcaactctctgaatccctttcttcaggcagctgttagggtcccgctaagcccacagctgtctttgctgccattttggcctgcaaaaactttctgccctagcagcgcgctaacagcggacctgcccgggcggccgcccgggcaggtacaattcgacgagcttctccgcgagaatgttgcccctgcttttatgacaaaatcattgttgatttttcctgaactcagtaagcacaggatatatgttctcaaaggctgcataagtctcatctctcgc

SEQ ID NO: 1901 - DNA, 435 bp, Cicer arietinum
acaccttggtgggatggaagtgtgatatatggaagcaatgaagaagttttgaagaaagtgagaactttcaaagatgggaagctgaaaatatcaaagcaaggtaaccttcaccttaacgaagatggaacaacaatttcaggtgacattcggaatagttgggctggtgtcacaactttgcagaccctttttgttcaagaacacaatgctgtttgtgacactctcaagaatcatcacccagatttgaaagatgaagatctttatcgatatgctagattggtgacttcagcagtgattgcaaagattcacaccatagattggactgtagaactccttaaaacagacactttgcttgcaggcatgcgagccaattggtatggattattgggaaagaagttcaaggacacatttgggcacgttggaaattcaatcttgagt

SEQ ID NO: 1902 - DNA, 434 bp, Cicer arietinum
acaccttggtgggatggaagtgtgatatatggaagcaatgaagaagttttgaagaaagtgagaactttcaaagatgggaagctgaaaatatcaaagcaaggtaaccttcaccttaacgaagatggaacaacaatttcaggtgacattcggaatagttgggctggtgtcacaactttgcagaccctttttgttcaagaacacaatgctgtttgtgacactctcaagaatcatcacccagatttgaaagatgaagatctttatcgatatgctagattggtgacttcagcagtgattgcaaagattcacaccatagattggactgtagaactccttaaaacagacactttgcttgcaggcatgcgagccaattggtatggattattgggaaagaagttcaaggacacatttgggcacgttggaaattcaatcttgag

SEQ ID NO: 1903 - DNA, 419 bp, Cicer arietinum
actcattacctccaagaggcacctctctactcgtagcccgctctacagtagttgtcggtgaagcacgtcccatggacatcaatacagttgatctcagcagagattccctccagcagcgcctcccatctagttcatccagcatatcatcggcacaaaggcgctttactttcaagaggtcatcccgtcagcgggaactattcctctccagcctagaattctcttgcacagatagatcaggtggctttccacgcccaaaggcaggagaaccatgatccctaagctcgccagtagctgcaaccctaggactatgcatccttggggaaaccccttgcaggggaaaaacccaaggcggccagaacgctgctctgtagacgaggcaattgccccgttccacggtctccaggtaagctctgtacctg

SEQ ID NO: 1904 - DNA, 438 bp, Cicer arietinum
gctatgaggtgaacttttgttattttgaagctggagagaacaaacaagctctagttaaattggtagcatgtgagagatgtgcagggaaacttaactacaaaaggcagaaagagaaggagcaattagaaaaaagacaacaggagcaagatagaagaaagaggagtcgttcaaagagtaatgatgatcaagatgaggtcgaaggaagcgaagagagaaggcggaaagtatatcttgaaaccaaagctgggcaagacaggaaaaggttaagcagtgctgggagcaagtgaccaatgcaagtagatgcctaaaatacagatgaatatggtgagaccatgaatgcttgagacagaagtttgtataccctgtcgagcccttcgaaattatgcacgatataattggttaatatattaggcagaaggatgcttaggagcttgtatt

SEQ ID NO: 1905 - DNA, 254 bp, Cicer arietinum
acgtatttatttattttataatagacgagtggttgagttgactactgactaggtgtggatggtttggattggagcagcaatgatgagaaggatagagaagaagcaagtggtgtttgagaagcacagtcaatgttatctccgtaaacaataccaaagatgtcacagtatctcttgtaaaaaccgatccgatcttgaactctgctatcatgtcctctaccgcattcaagtccaccgttaatgatgttggtaacagt

SEQ ID NO: 1906 - DNA, 414 bp, Cicer arietinum
acaaagcttacctagaggccgtggaaagaggcgaccacctcgtccacagagcagcgttctagccgctttgggtttttctcctgcgagggttttccccaaggatgcacggttctaggttgcagctactggcaatcttaggggtcatggatttcttgccttagggtatggaaagctacttgatctatctgtgcaagagaattctaggctggagagggacgagttcccgctgacgggatgccctcttgaaagtaatgcgcctttgtgccgatgatatgctggatgaactagatgggagacgctgctggagggaagctctgcgaggatcaactgtattgatgtccatgggacgtgcttcaccgacaactactgtagagctggctacgagtagagaggtgcctcttggaggtaatgagt

SEQ ID NO: 1907 - DNA, 429 bp, Cicer arietinum
  misc_feature (392)..(392): n is a, c, g, or t
acagagcttacctggagaccgtgaaatgaggcgactacctcgtccggggggggggggtctggccgctttggggttttctcctgcaagggttttccccaaggatgcacggttctagggttgcagctactggcgatctttggggatcatggacttcctgcctcagggtatggaaagctacttgatctatctgtgcaagagaattctaggctgtataggaatagttcccgctgacgggatgacctcttgaaagtaaaggcggctttgtgccgatgatatgctggatgaactaggatgggagacgctgctggagggaagctctgctaagatcagctgtattgatgtccaatgggacgtgcttcaccgacaactactgtagggcgagctacgagtanagaggtgcctcttgggggtaatgagtacctgcccggg

SEQ ID NO: 1908 - DNA, 433 bp, Cicer arietinum
acttaaactttagttttcaattcatcattgaaaacaaatcacagtaggagcctttttttcccctcttatcagttggttctcattttaagttaaatctattctgggatggtttttatttccatttttatttttatatatgttgggttatacatgcctgtctgatttctaggacttggttgaatttgctgtgcctgtttactgggaatgtataaaagtagtgaggagtttgtatggaaagattctctagcccttcctcccacacaataaaaggagtgaaatgatgttgagaacatgttttctggatgaatgcgttgaataatatgttggttgttatacaatgtttgaatttttaaatatataggccctcaaagattttctagcaaagtttgaagacagggagataaaactattggtttaatagtgtcgtctttaa

SEQ ID NO: 1909 - DNA, 359 bp, Cicer arietinum
actcctcacacctcgtgaaaagttttatgttttcttcacagatatcatcaatagatactaacgctgaagctccacttgatataccacactgttcatgaatcaaactttgattccaagttgcaggaagaccctcatttggccgatccaaattcaaaacttcttgatgttcagcttctaagcaaacatcttctatcaactcattccgtgaattatttggatgccctgctgattgtcgaatccgggcttcctttagcatttgtgatctgaaatttagaggctgatatccaactaagtgacagtgctccttccagtattccatcgtcatttgtttcagcttcgcttccagccgtatgaacagt

SEQ ID NO: 1910 - DNA, 436 bp, Cicer arietinum
acttaaactttagttttcaattcatcattgaaaacaaatcacagtaggagcctttttttcccctcttatcagttggttctcattttaagttaaatctattctgggatggtttttatttccatttttatttttatatatgttgggttatacatgcctgtctgatttctaggacttggttgaatttgctgtgcctgtttactgggaatgtataaaagtagtgaggagtttgtatggaaagattctctagcccttcctcccacacaataaaaggagtgaaatgatgttgagaacatgttttctggatgaatgcgttgaataatatgttggttgttatacaatgtttgaatttttaaatatataggccctcaaagattttctagcaaagtttgaagacagggagataaaactattggtttaatagtgtcgtctttaatga

SEQ ID NO: 1911 - DNA, 379 bp, Cicer arietinum
attcgatatattcagttggaagaatgaagagtgtgtggggtgaagattgtatggagtttaaaccagagaggtggttatcggttcagggagaccggttcgaaccgcctaaagatgggtataagtttgttgcgtttaatgctggaccgaggacttgtttggggaaggatttggcttaccttcagatgaagtctgttgctgcggctgtgttgattcgttaccggatttcaccggttcccggtcaccgggttcagcagaagatgtctctcacacttttcatgaagtatggtctacgtgtgttcttgcatccacgtcagcttcagcaacccaagtaggatgtgtttgggtggttgtgtatgtcactgattcggtcatatgctgt

SEQ ID NO: 1912 - DNA, 399 bp, Cicer arietinum
actgctgcgaagtttaataatgtctatgtgaaaaacctatcagaggctatggcggatgatgacttgaagaaaatatttggagagtatggaactattactagtgctgtagtaatgagagatgtagatggtaaatcgaaatgttttggttttgtcaattttgaaaatgcagatgctgctgctaaagccgtggaggcacttaatggaaagaaatttgatgacaaggagtggtatgttggaaaagccctaaagaaatatgaaagggaacttgaactgaaagaaagacatgaccagagtatgaaggaaactgtggacaaatattatggtgcaaacttgtatgtcaaaaacttggacgacagtgttagtgatgaaaaactcagtgaactgttctctgagtttggt

SEQ ID NO: 1913 - DNA, 464 bp, Cicer arietinum
actgctatctcccaggcaaaacatggcaccccccagaaatgcataaaaaggccaccttgtaattggcctaatcaacagcggtgctattatgtttgccaggtcatcttttacgctatgcagaacacaaacatcagtatgattgctactggaaaagcttacaggcaaacaattatacagaagttctttaacatgccagcttgagatttcctctctgagtctttgcagatcgggcatggaaggtaggcatgtcaaaagttctgattgtagtttgtgcaggtcagccttcttgaggatgtcaggcaaatgctgtagtgaattaagatctacaacttgcggaactttcatggcagtgtatatggtcaatgccaggaataggaagaacccaatcaaatgcgtccaaacgttgagagtttcattgtgaatggtgaagatactaagcaaaacctgcttcaaaggccattcgg

SEQ ID NO: 1914 - DNA, 290 bp, Cicer arietinum
gattacgaaaacttagtagaataatggatccaaggcttgaaggacagtattcagagatgggggcaagaaaagcagctgcattagcctatcaatgcttaagtcacaggccaaggaatagacctacaatgtctgatgtggttaacactcttgagcctctacaagattttgatgatattccaattggaccctttgtttacacggttccaaatgatgttaacaatgaagttcaaaaagagtgtgttattgaggcaccgaaagagagaagaagggaaagtagtgggagtagtagt

SEQ ID NO: 1915 - DNA, 401 bp, Cicer arietinum
acagtcccttgttcagcttaactgaaattcatcacttattcctttaataataaccttaaaattttcatattctgcttatgtcacggccaaaaacaaaagtcgtagcccagttaatagctacatagaatctgttcctccagctagtgacacgagttaggtacgccgaacgccaaacaaaccaactgatgaaacctgccagagacaacccctttgcttccttgttctgtctaaggtccactagagccttgtaactgccgacagtcgccatgcttccaaggtgcttgtaaacaaactgatcccccaagtcaatgtctttcatgccgtttgcgtggcctccattggttttacctattttgtttaataagcctgctaagtatttaccttgcctctctgctacttgg

SEQ ID NO: 1916 - DNA, 430 bp, Cicer arietinum
gttaggagcgggattttctgcaggccacgcgaccacacaaaactgcggggatgctatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgacaatagattgcccccgaacccgctga

SEQ ID NO: 1917 - DNA, 415 bp, Cicer arietinum
acagagcttacctggagaccgtggaacgaggcgactgccttgtccacagagcagcgttctagccgccttgggtttttccctgcgaggggtttccccaaggatgtacggtcctaggttgcagctactggcgatcttaggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggaggaaagctctgctaagatcagctgtattgatgtccgatgggacgtgcttcaccgacaactactgtagggcgagctacgagtagagaggtgcctcttgggggtaatgagt

SEQ ID NO: 1918 - DNA, 441 bp, Cicer arietinum
acagtgttaggaggaactccccccaaatggaactcattgatgaaaatattggcactgctagctgttgtggattgatcaaatatagtttcagacagtggattacaggttttatgtgtagattagtggagtgctggggaaagtcaactttgccttgagcttgattctgaagttgtgatcttaattctttgaggggattaaattatatggataagcaaaatatttgataattcatcacaaaaatgaaaagattgcttaaatagaatttttagatggaagcaagccatgtttccagataagtcattcagtatgaggacaaacttggcattctttgtaagcttcgtggagagtttacaaagtggcatctcttctattaatgaagtttattaattgttgcttaatgttgttattgaatctgttacatgcctttagtttagtttttct

SEQ ID NO: 1919 - DNA, 436 bp, Cicer arietinum
acagtgttaggaggaactccccccaaatggaactcattgatgaaaatattggcactgctagctgttgtggattgatcaaatatagtttcagacagtggattacaggttttatgtgtagattagtggagtgctggggaaagtcaactttgccttgagcttgattctgaagttgtgatcttaattctttgaggggattaaattatatggataagcaaaatatttgataattcatcacaaaaatgaaaagattgcttaaatagaatttttagatggaagcaagccatgtttccagataagtcattcagtatgaggacaaacttggcattctttgtaagcttcgtggagagtttacaaagtggcatctcttctattaatgaagtttattaattgttgcttaatgttgttattgaatctgttacatgcctttagtttagtt

SEQ ID NO: 1920 - DNA, 435 bp, Cicer arietinum
caaaactgcggggatgctatcggctccctaacagcagctttcggagaaggaattttggagagttcgccttctctaacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccacgacagtcgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtat

SEQ ID NO: 1921 - DNA, 228 bp, Cicer arietinum
actgagctgggatttgacttcgggaactacgtcacggtggtggaaccccgcacttgagcggctgttgggcactcaatgaacattatgggaatggggattatgacaattggacggtcgggaaccaggcggtgttaggatcaaagaccatcagtcatgctcgcaaaagacgatgcaacgagaacttgattggcagttctaagacaaagaaatacagagtattcctctgac

SEQ ID NO: 1922 - DNA, 355 bp, Cicer arietinum
ctcagatcgattggcgtttccagaggccaactatccaatatgagtaagcttcagagtgatgctttgagagaagccatctcaggaatcacggctgattccaaggagaaaaacaggaaatttgtggagactattgaactccagattggtcttaaaaactatgatccacaaaaggataagcgtttcagtggttctgttaaattgcctcacattcctcgtcccaagatgaaaatctgtatgcttggagacgctcagcatgttgaggaggcagagaaaataggattggactggatggatgttgaagctttgaagaagctaaacaaaaataagaaattggtgaagaaacttgcaaagaagt

SEQ ID NO: 1923 - DNA, 150 bp, Cicer arietinum
agaaaatgaggagggcttgctggaaaatcttagggtcagtgattggcacgagcaaaaaatgtttgagaagtgatcagaggaaggacatggaggaaattctaagggctaagtttactactataacggaagagccagaaaattgtgaagaga

SEQ ID NO: 1924 - DNA, 347 bp, Cicer arietinum
acagaaagtgaaactcatatattgcttacagagggataacaaatatgaaaggtaaagaaaaagctattatgagttaatggaaaatgggcaacggaagcagtgaggtagatgattgaacgcattcactcagcagcaatttgattaagaggattgtcaggagatttcttccaaagcttccaaatcatatctttgtattgagtgtaggtaagacccggtttatcttgcttcaacttagggagttcaacttcttcaaatgccttgaaggaagccttgagtcgcctctcgggatgcctgtcgggtggtaagttgttatcgatactcatctgagcgatcgcttcgtcaagagt

SEQ ID NO: 1925 - DNA, 101 bp, Cicer arietinum
  misc_feature (1)..(1): n is a, c, g, or t
naataattctttcttggcacgcactgttagtgcactgttaggagcgggattttctacgggctactcggccacacaatactgcggggacgccatcggctccc

SEQ ID NO: 1926 - DNA, 437 bp, Cicer arietinum
acagagacttttccgcctggatggagacatagaaagctggggcgttgaatgtctcgaagacaatcggggtcatcttctcacggttggacttggggttgatgggagcctcggtgaggaggacggggtgctcctcgggagcgacacgcaggtcgttgtagaaggggtggtgccaaatcttctccatgtcgtcccagttggtgacaacaccgtgctctatggggtatcgcagagtgagaataccacgcttggactgagcctcatcaccaacatacgagtccttctgacccataccaatcatgataccatgatgacgggggcgaccgacaatggaagggaaaacagctcggggagcatcatcaccggcgaaaccggccttgcacatacccgaaccattgtcgatgacgagagcagcaacttcttcctccatggctgtggat

SEQ ID NO: 1927 - DNA, 380 bp, Cicer arietinum
acccaccattttcattgtggatgcatcagtcgctggcttcggacaaaagcaacttgcccactctgcaaatttaatatccgaagaggaggcgatacattggtctgagatttcgttgagatagaaactagacggcgccaaggtgctgtatcgcttgaaagggccatgacattgaagaacaaaaacattaatctgctgactagtgttggtaaagaagtgtaaaagaaaaaggaaatgccccaccctttcatctttttctctttctgggttttaggatttagtttccagaaaggtattttatcttctaaacattcttaagttagtttatgatggggtatatgtatatattgtaggccagtcgtgaggatctccccataatttgt

SEQ ID NO: 1928 - DNA, 462 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccatctgaa

SEQ ID NO: 1929 - DNA, 261 bp, Cicer arietinum
acgagcttggtcgtcagccagcaaacactaaattatcaagcaacaagacagccaggaggatccgtgttcgagggggtaatgtgaagtggagagctcttagattggatactggtaacttctcatggggtagtgaagcagtaactcgcaagactcgtcttctggatgtggtttacaatgcctcaaataacgagcttgtccgaacacagactcttgttaagggtgctattgtccaggtggatgctgcaccattcaagcagtggt

SEQ ID NO: 1930 - DNA, 436 bp, Cicer arietinum
gttctagccgctttggggttttctcctgcaagggttttccccaaggatgcacggtcctaggttgcagctactggcgatcttaggggatcatggacttcctgcctcagggtacggaaagctacttgatctatctgtgcaagagaattctaggctggagaggaatagatcccgctgacgggatgacctcttgaaagtaaatgcgccttcgtgccgataatatgctggatgaactagatgggagacgctgctggagggaagctctgctaagatcaattgtattgatgtccaatgggacgtgcttcaccgacaactactgtagggcaagctacgggtagagaggtgccttttggggggatgagtagagaaaaagctcgagcatgtatacggctccgacgcaaaaggccttgcagatgacctgagcgaggatcggtacctc

SEQ ID NO: 1931 - DNA, 436 bp, Cicer arietinum
gaagaatgggtgagtcggtgactcggataatggttggagtgaacgagtcaagcatgaagggttacccacacccttcgatcagtagcaaaggtgctttcgaatggacgattaacaagatcgttcgtaacaacgtttcttctttcattcttctctttcttcatgttcaagttcccgatgaagatggttatgaagacgtggatagtgtttatgcatcaaatgaagactttaagaacatgaaagagaaagaaagggttagagggactcatctactggaatactttgtcactaggtgtaatgaaattggggtggcttgtcaagcatggataaaggagggtgatcccaaagaagtgatactgaatgaggttaaacggctacgtccagatttactagttgtcggaagcagaggtcttggacctttccaaaaggtttttgttgg

SEQ ID NO: 1932 - DNA, 200 bp, Cicer arietinum
actctagtagatcccatagtttcaacagcttggcaactcaacatgtccaagacagggaataattgacattccaagactttatggatagttactggagtcacagatagttacttaattgatgggacaagaaggctccaaactgtttcagtcacagcttcaataaaaccaccttggaattcgatacatataaagaaagaagt

SEQ ID NO: 1933 - DNA, 431 bp, Cicer arietinum
gttaggagcgggattttctgcaggccacgcgaccacacaaaactgcggggatgctatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgacaatagattgcccccgaacccgctgac

SEQ ID NO: 1934 - DNA, 313 bp, Cicer arietinum
acatcgtccctattcctatttcacacaggcccgaagccgcggtataacaaattcatcatgaaaaccccatcccgatcacggggagattaaaaaaccttggtcaagagaggatttactcaaaagggttggttcgggttccccaccaggtgaggaaggcggagagaccgagggtctcaacgagcttggtagccaggctgacgccgacggtgtcgagaggtcgcttctcaacgaagatctgagcaatgtagccgggagcagaggtagcgaagaagatgagggatccgaggtaagcagcgcccttgtagctcagcgt

SEQ ID NO: 1935 - DNA, 454 bp, Cicer arietinum
actagtgattggtttcgaatcagtcgatggttctagaaagcaggtttctggaacaaacaaactacgttctggaaattattgggaaggagcgccaattatttgagacttcacaacaacaatgccagtataacttacaagaaaaaataaatcaacagtccatagaatacaacaaattgacaactcaaatcgaaggacaaaataaagacatacaagaaatcaaacaatttttaaaattattggtccctagaatagttggaatcgaagcatcctataaagtactttcaactgaaaatccgataatggaaagccaacaaaaaccaagaccaataaaacggaaaaaacaaagctagagctccttgccttttcgggaatgtgaaagcgattttaagtttctgcctttgctcacatgacggaatctaaaatttgtgtgttgcagatttaatttctttttttt

SEQ ID NO: 1936 - DNA, 365 bp, Cicer arietinum
cggccgaggtcaatgatatagcccttggagcaagtatattcccactttctaactatggttcttcccaatatgatataagcattttggtctggaaggacccaaaagagggaaattggtggatgcaatttgggaatgaccatgttctaggatactggccagctcctttattctcttacctcactgagagtgcctcaatgattgaatggggaggtgaagttgtgaactctgagtctgatggtcagcacacctcaacacaaatgggaagtggacattttcctcatgaaggttttggaaaagctagttatttcaagaacattcaaattgttgatggtgacaacaaactaagggctccaaaagatcttggt

SEQ ID NO: 1937 - DNA, 353 bp, Cicer arietinum
cagatcgattggcgtttccagaggccaactatccaatatgagtaagcttcagagtgatgctttgagagaagccatctcaggaatcacggctgattccaaggagaaaaacaggaaatttgtggagactattgaactccagattggtcttaaaaactatgatccacaaaaggataagcgtttcagtggttctgttaaattgcctcacattcctcgtcccaagatgaaaatctgtatgcttggagacgctcagcatgttgaggaggcagagaaaataggattggactggatggatgttgaagctttgaagaagctaaacaaaaataagaaattggtgaagaaacttgcaaagaagt

SEQ ID NO: 1938 - DNA, 128 bp, Cicer arietinum
acactgcatcatctcactcttgaggctattgttgctggtgaaaggaagatctatgaagccaaggttggggtgaaaccctgttgactttaaactccttcaagagttcaagcatgctggtgatggtgatg

SEQ ID NO: 1939 - DNA, 435 bp, Cicer arietinum
acaaagagacaatcctcctgtgattggcggttcaatagacaccatcaatgagacacagattggtgatattccccccagattaccagagcgcaattttgctgggactccatatgttcctgtttatgtgatgctaccgttgggggtgatcaatattaaatgtgagcttgttgatccggatgctctactaaagcagctgagggtgttgaaatcagcaaatgttgatggtgttatggtagactgctggtggggaatagtggaggcacatgctcctcaagagtataattggaatggttacaagagactcttccaaatgctgcgtgagcttaagcttaagctgcaggtagtaatgtcttttcatgaatgtggaggcaattttggtgatgatgtttgtattccattaccccattgggttgctgaaattggtaggagtaatcc

SEQ ID NO: 1940 - DNA, 434 bp, Cicer arietinum
acccaagtcaccggtattatttctcaaaccgacgtcgtcttacttgaaaaatggcggaacaatccaaatcccacacaacgagagttctctccatcacgaagtcgaactcgccgtcgtcatcggaaagaaagctcgtgatgtccctgaatcctctgccatggattacgttgccggttatgcactggcactggatatgactgccagggatcttcaatctgctgctaagtctgcaggtcttccgtggagtctggcaaaaggccaagacactttcacaccaattagtcctattttgcccaagacagcagtgccaaaccccgatgatctagaattatggataaaggtagatgaagaaattcggcagaagggctcaactaaggacatgatattcaaaattccatttttgattagccacattagctcgttcatgacattgt

SEQ ID NO: 1941 - DNA, 415 bp, Cicer arietinum; identical to SEQ ID NO: 1917

SEQ ID NO: 1942 - DNA, 417 bp, Cicer arietinum
acagagcttacctggagaccgtggaatgaggcgactacctcgtccacagagcagcgttctggccgctttggggttttctcctgcaagggttttccccaaggatgcatggttctagggttgcaactactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 1943 - DNA, 438 bp, Cicer arietinum
accgaatagatccaaatgttgggggagaaggctgttagaaatgaagaaagagccatcaaaagacatgtaaagaagagcatgttcttgcgaccgagtgacgaggagtcagctagtgtggccaagaaaatcccaccaactaagcatcccaagaagaacattgaagcggggaggccggttatgagagagctctcacactccatagcccattctgatatcatggaggcttgtgtcggcccatcccaagcccacgagcctttgggaaggttgcacacatcactaaatgatgtggctgaattacaaatattctgaaatccaatcgttggatctagctgtaatctagatccaacaatttgttcattggtgcagtgccacgatagcagtgcatcagtgaagatactaataaatgtttgttgggcgtcaaagacccaagcaaaggaa

SEQ ID NO: 1944 - DNA, 439 bp, Cicer arietinum
gttttcaactcaacaagaacaaatcatggcattgatggcagcaacagcaagctcagcaactgttgttaaacaatctcctttccttggacaaaggaaaggtgccagtgccaatcctcttagagatgttgtctccatgggaacttctaaattcaccatgggaaatgaattgtggtatggaccagacagagtgaaatatttaggacccttttcagctcagacaccttcatacttaactggagaattcccaggagattatggatgggacactgctggtttatctgctgatcctgaagcatttgccaagaacagggctcttgaggtgatccatggaagatgggcaatgctaggagcactaggttgcataacaccagaagtgttagaaaaatgggtgagagttgacttcaaagaaccagtttggttcaaagcaggatcccagata

SEQ ID NO: 1945 - DNA, 380 bp, Cicer arietinum; identical to SEQ ID NO: 1927

SEQ ID NO: 1946 - DNA, 312 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttact

SEQ ID NO: 1947 - DNA, 437 bp, Cicer arietinum
acaaacttagaatgtccaaagaaaaggtcatcgaaaaagcccgcagtatggtcgcatttgcccgcagtttaggctgcgatgatgtcgaattcagtcctgaagatgctggcaggtcggatagggaatttctctatcaaattcttggagaagttattaaggctggggctactacgctcaacatacctgacactgttggtataacgatgccgagtgaatttgggaaactgattgctgatataaaagctaatacccctggagttgagaatgttattatttccacccactgtcagaatgatcttggtttatctactgctaacaccatagagggtgcacgcgctggtgctaggcagctggaagtcacaattaatgggattggtgaaagggctggaaatgcctcgttggaagaggttgtgatggccctgaaatgtggaggacat

SEQ ID NO: 1948 - DNA, 284 bp, Cicer arietinum
cgcgacgcagccatgggaaggagacctgccaggtgttacagacaaattaaaaacaagccataccctaagtcacggttttgccgtggtgttcctgatcccaagatcagaatttatgatgtcggtatgaagaagaagggagttgatgagtttcccttctgtgttcatctggttagttgggagaaggaaaatgtttcaagtgaggcacttgaagctgctaggattgcttgcaacaagtatatgtctaaatttgccggaaaggatacattccacttgagagtcagggt

SEQ ID NO: 1949 - DNA, 415 bp, Cicer arietinum
acagagcttacctggaggccgtggaacgaggcgactacctcgtccacagagcagcgttctagccgccttgggtttttccctgcgaggggtttccccaaggatgtatggtcctaggttgcagctactggcgatcttaggggatcatggacttcctgcctcagggtatggaaagctacttgatctatctgtgcaagagaattctaggctagagaggaatagatcccgctgacgggatgacctcttgaaagtaaatgcgcctttgtgccgatgatatgctggatgaactagatgggagacgctgctggagggaagcgctgcgaggatcaactgtattgatgtccaatgggacgtgcttcaccgacaactactgtagggcgagctacgagtagagaggtgcctcttgggggtaatgagt

SEQ ID NO: 1950 - DNA, 433 bp, Cicer arietinum
acattacaagaacgtaaacttcaccaaaaacacataatgaaaccgaattaaggtcactttccgggaacaaagttggtggcataggcccatgcattgttgttgacagggtcagaaagatggtcagcaaggttctccaaaggaccctttccagtgacaatagcttgaacaaagaatccaaacatagagaacatggctaatctaccgttcttaagttctttgaccttcaattctgcaaaagcttcagggtcgtcagctaagcccaatgggtcaaagctaccaccagggtagagtgggtcagtgacctcaccaagaggcccaccagcaatacggtaaccttcaacagcacccatcaaaacaacttgggtagcccatatagcaaggatactttgagcatggaccaaacttgggttacccaagtagtcaagtccaccct

SEQ ID NO: 1951 - DNA, 415 bp, Cicer arietinum
acagagcttacatggagaccgtggaatgaggcgactacctcgtccacagagcagcgttctagccgccttggggttttctcctgcaagggttttccccaaggatgcacggtcctaggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggctagctacgggtagagaggtgccttttgggggaatgagt

SEQ ID NO: 1952 - DNA, 314 bp, Cicer arietinum
atcggtagcgacatcctcccgatcaacgacgccgattgcgatgggtttttctcctttgaaggcaagccgcaccgccggcctctgatcccttcccgaggtttttccctgccgccacgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 1953 - DNA, 453 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaagactattgttaatatgccttcatcaccatatcaatcaacattagatgca

SEQ ID NO: 1954 - DNA, 435 bp, Cicer arietinum
tgctgccctcgctgctaaggatgctggcaaggaaggccgaacaattctctttgttggtgatgggtctttccaattgaccgctcaggagctgagcaccatgatccgacatcacctcaagcccacaattttcgtcatctgcaacgatggcttcaccattgagcgatttatccacggtatggatgctgtctacaacgacatcaacaactggaagtacaaggacctcgtcagcgtcttcggcggcgagaagacctgcaagaccttccagatcaagaccaagactgagctcaacgagctcctcaccaacaaggagttcaacgctgctgagtgcttgcaattcgtcgagctctacatgcccagagaggatgctcctcgcgctctgatcatgactgccgaggccagtgctaggaacaacgccaagaagcactaaacggttac

SEQ ID NO: 1955 - DNA, 415 bp, Cicer arietinum
acagagcttacctggagaccgtggaacgaggcgactgcctcgtccacagagcagcgttctagccgccttgggtttttccctgcgaggggcttccccaaggatgtatggtcctaggttgcagctactggcgatcttaggggatcatggatttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacatgcttcaccgacaactactgtagggcgagctacgagtagagaggtgcctcttgggggtaatgagt

SEQ ID NO: 1956 - DNA, 415 bp, Cicer arietinum; identical to SEQ ID NO: 1955

SEQ ID NO: 1957 - DNA, 238 bp, Cicer arietinum
acccctgttgagccctactaaagctttgaaattggaacaagcggatatcaaacctgagtttgagcgatgagatttggctgcggggttttggttaataaattatagttagaatactagtcttgttttaaaagacttgatggcaataattttgacctccaattgatggggccgataagtgctgccctggattttttaagttgttctttttaatgatatttagctttgatgcttgcagcct

SEQ ID NO: 1958 - DNA, 435 bp, Cicer arietinum
gttaggagcgggattttctgcaggccacgcgaccacacaaaactgcggggatgctatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagcgatgcgtgagagaattctggtcggtggaaaaagtcgacagtatgcccccgaacccgctgacgggtgacg

SEQ ID NO: 1959 - DNA, 358 bp, Cicer arietinum
acaggcattaaacctgatttgttggtctctttgacagcaccaaaattatgtgcaaagaagtttgggcggccctcaccactttttaggaggtagatttgtcccacctgctattgctgaaaagtataagcttatacttccaccatatcctggaacatccatgtgtgtccgaattggaaagcctcctcaaattgatatttcagctctacgagaaaactatatctctccagaatttcatgaagaccaggtggaggcagaccccaataatcagtttcgtaaatggtttgatgatgcattggctgcgggtttgaaggaaccaaatgctatgggcttgtcaactgtagggaaggatggaaaaccc

SEQ ID NO: 1960 - DNA, 321 bp, Cicer arietinum
ttccccaaggatgtacggccctagggtgcagctactggcgatcttaggggatcatggagttcctgcctcatggtatggaaagctacttgatctatctgtgctagagaattctaggctgttttaggaatagttcccgctgacgggatgacctcttgaaagtaaatgcgcctttgtgccgatgatatgctggatgaactagatgggagacgctgctggaggaaagctctgctaagatcagctgtattgatgtccgatgggacgtgcttcatcgacaactactgtacggcgagctactattatagaggtgcctcttgggggtaa

SEQ ID NO: 1961 - DNA, 416 bp, Cicer arietinum
acagagcttacctggagaccgtggaacgaggcgactgccttgtccacagagcagcgttctagccgccttgggtttttccctgcgaggggtttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaggctctgctaagatcagctgtattgatgtccaatgggacgtgcttcaccgacaactactgtagggcgagctacgagtagagaggtgcctcttgggggtaatgagt

SEQ ID NO: 1962 - DNA, 432 bp, Cicer arietinum
  misc_feature (414)..(414): n is a, c, g, or t
ctcaaggatgggtctatcagaaccgctgtcgacactggttgtggggttgcaagttggggaggttatcttttgtcacgtaacatattaacagtgtcatttgcaccaagagatacacatgaagctcaggttcaatttgctcttgaacgaggtgttcctgcattgattggaattattgcatcaataaggctaccttacccctcaagagcctttgatatggctcattgctcaaggtgcctcattccatgggccaactatgatggactatacttgactgaagttgatagagtgctacgtcctggtggatattggattctatcagggccaccaataaattgggagacacattggaaagggtgggagaggactcgtgagagtctgaatgaagaacaggattcaattgagagtgtgacgaanagtctttgttggaaaaaa

SEQ ID NO: 1963 - DNA, 426 bp, Cicer arietinum
acgagcttggtcgccagccagctaacaccaagctatcaagcaacaaaactgttagacgcattcgtgttagaggtggcaatgtgaagtggagagctctcagattggatactggaaatttctcatggggaagtgaagctgtcactcgtaaaacccgtttgctcgatgtggtttacaatgcttccaacaatgagcttgtgcgaactcagacccttgtgaagagtgctatcgtgcaggttgatgctgctcctttcaagcagtggtatcttcaacactacggtgttgaaattggaaggaaaaagaaaactgcttccaaaaaagatacaccagaggaggccgaagctgttacagaagaagccaaaaagagtaaccatgtccaaagaaaattagagacccaccagaaagaacgccagcttgattcccacattg

SEQ ID NO: 1964 - DNA, 434 bp, Cicer arietinum
actacgcataattccatgcaagtaaccaccggtcattatgaatgataccagtgacacaacacctgctggaaatatcttccccgatttcttgaagcgagaacccatcactgcaagtagtgcagcagatatgcctagtcccacagatgatgctaaaacaggtcttccaggtagctcagtataaacataatacagcagtgcagaagacaaacccccagccaaaagtgacttctgactgccactcttgagatagcccattacaccacccgctccgacgagaatagcataacctagagttaatttctgagacattgacaaagccattttcctcttatctccgtccgatccttctttgcctttatcactattatctcctccgccgccgctgccaccaccgccgccgccaaaatcgtctccgtttccttcgaaacctccgc

SEQ ID NO: 1965 - DNA, 171 bp, Cicer arietinum
caagtcactatctcgtcacatacaactctataactttacgtctgtcatcatggcttgcgattgtggatctacttgtaactgcggcggtcctagctcttgctcctgtggccagagctgctcttgcaagaactgcggcaaataaactgcgccaaggtataggaggccggaggt

SEQ ID NO: 1966 - DNA, 437 bp, Cicer arietinum
gtgatagagagagagagatttcgcaatttcacaaaccctaatttcaaagagatcggcgatggcttcttctaaggatcgtgaaaacttcgtctacatcgccaagctcgccaagcaagctgagcgatacgaagagatggtggattcaatgaagagtgttgcaaatctagatgttgaactgactgttgaagaaaggaatttgctttctgttggttataagaatgtgattggtgctcgcagagcatcgtggaggattctgtcttccattgagcaaaaggaagagacaaagggaaacgatgtaaatgcaaaacggattaaggagtataggcataaggttgaatcagagctttcaaacatctgtaatgatgttatgagagtgattgatgaacaccttataccttcagctgcagctggtgaatcaactgtcttttactataaga

SEQ ID NO: 1967 - DNA, 373 bp, Cicer arietinum
acaagagatcaaggctatctagaaacaggaggactgtgaaccgtgcttatggtggagttttatccggaggtgctgtcagagaaagaatcattcgagctttcttggttgaagagcagaagattgtgaaaaaggtcttgaagatccaaaagacaaaggagaaacaagcttcaaaggcttaagtttcaagaaaagagataaagatctttttggagggattttaggtttgagtcattatagtaaaaaacaaatttattagaactgttgttcccttgttaattttgtgctcatttggtttctttgaactcattttagtgcaactgttagcctattatgatacagttttgttcggtttattgatattttcatgttttcc

SEQ ID NO: 1968 - DNA, 271 bp, Cicer arietinum
acacggccgtcggcggtgagaccggcgatggcaactccgatatgatcatcaaccttaaagatcttcttctgatgagaagagagttcggaattagctttgttaacgcacgcgagaaccacgtgagttttggatcggagacctattgcggctgaaccttgttccactgcttccatagcgtattcgacttggaataatcttcctgctggactccatgttgttacgtctgtgtcgtattgatttctaaacattttggattttgattttgattttg

SEQ ID NO: 1969 - DNA, 430 bp, Cicer arietinum
tgcttcatcaagatgctttataaatcatctatgaagtcattgaaaatggtaatggctaatttgataacaatgtttttgctaatagaggtgattgcgtgcgggttcgggttcggattcggggcagatggtgggttaaacatgaactactacttgatgagttgtccttttgttgaacctgttgttaagaatgtagtcaatagagctttggacaatgatcccacccttgcagctgctcttattagaatgcacttccatgactgcttcatacagggatgtgatgggtcagttcttattgactccactaaggataatacagcagaaaaagattcaccagcaaatttgagcctaagaggatttggaatcatagacgatatcaaagaagagcttgaaagacaatgccctggtgtggtttcatgtgctgatattcttg

SEQ ID NO: 1970 - DNA, 458 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacgataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccatc

SEQ ID NO: 1971 - DNA, 341 bp, Cicer arietinum
tgcttgcagctactcgcttatgatccttcatgatgaacaaatccctgtcactggtgacaaaatttccactttgttgaaagctgcaaaggttgatgttgaatcttattggccaagcttgtttgctaaacttgctgagaagaaaaaccttgaggatttgatattgaatgccacaggaggtggggctccggtttctgtttcagccccagttgctgctgccgcaactgcagttgctgcacctgcagaagagaagaaggaagaacccaaggaagagagtgacgacgacatgggattcagcttgtttgattaggagaacttttagtgtgatctagtctgatttttgg

SEQ ID NO: 1972 - DNA, 296 bp, Cicer arietinum
gatttcgagggccgcccgggcaggtcctgggccgactctgattggaaaggcgacaatttcacaggaagatcgacgtttggatggctcgttcagcttgaagaatctacggtctcatggagagcgaaacgacatgaaacagtagcactctcaactaccgaggccgagtatactgctctatcacaatgcgccagagaattaacatggattcggaatctgttcccagaactacaactatcactagacattccgatccttttgaatggcgataatcagggttctctgaaactctgcagaaa

SEQ ID NO: 1973 - DNA, 433 bp, Cicer arietinum
actcacaccgttgttcagcttctcaaaggtggatttcatgtttccatcattgataatttcgataattcagttatggaagccgtgcaccgtgttcgtgaacttgttggtcctcaactttctcagaacctcgatttcaccttgggcgatcttaggaataaggatgatttggagaaactcttctcaaaaactaaattcgatgccgtgattcactttgctggcttaaaagcagttggtgaaagtgttgcaaatccacgtcgatatttcgataataatcttgttggaactatcaatctttatgaagttatggccaagtataattgtaaaaagatggttttctcatcatctgcaactgtttatggccaacctgaaaagataccttgtgtggaggatttcaagctacaagccatgaatccatatggacggaccaagcttt

SEQ ID NO: 1974 - DNA, 233 bp, Cicer arietinum
acgactacactaccaccttcaaaaacgaccacgacgaagataaggagtgtgtttgcttcgacaagatcgggcctgatggcttgatcgacggtttcttcgctaagaacgttgccttgaccttcactgttcccgcctctagctcacaggttgttgctttcgacagtgactcccagggcggttgcgcttgtgccagcaacaaggttcccaccacttcggacggccagtgggccagt

SEQ ID NO: 1975 - DNA, 438 bp, Cicer arietinum
accgcctgtccgtccttcccgacggcattccttctctgtccattgaagtcatgagcaccatgggctgggagcgttacactcacgagcagttcggtatcaaccgattcggtgcttctggtgcctacaaggacgtctacaagaagttcgagttcacccctgagggcattgccaagcgcgccgtcgccaccatcgacttctggaaggacgtccccaacatccgatcccccatcaaccgtgctttccagcagatcatctagatcaaagataatagcgagtaaaaagaaacgaaggataagaataaaaactccgggaggataccagcccggacagaatgattatgcaagtgacgacgatggactttggagcaaggttttgtggatttatagcaacttagacacgtaccttggccccgggcggccgctcgaaatcactagtgaa

SEQ ID NO: 1976 - DNA, 409 bp, Cicer arietinum
cggttgtgtgatgggccatcacccaaagactggagaggtggaagaactgcctcatttacacatcattcctaacagtaccggagctgctaaggctgttggcaaagtgcttcctgttttgaatggaaaattgaccggaatggcattccgtgtcccaactgattgatgtctcagttgctgaccttacagtgaagcttgagaaggccgctacgtacaacaaaatcaaggctgctatctcggaggagtctgagggcaaggtgagaggcattctcggatacactgaagatgatgtggtctccaccgacttcactggcgatactagtcaagtatctttgatgccaaggctggaattgccttaaatgaccggtttgttatgcttgtctcatggcatgagaacgagttgggttacagt

SEQ ID NO: 1977 - DNA, 460 bp, Cicer arietinum; identical to SEQ ID NO: 1896

SEQ ID NO: 1978 - DNA, 424 bp, Cicer arietinum
tgtacaggataccccgcttccttcaccatccagcataccaagggacaaaaggcgctgtattttctcgagcccgtcacccgtcagcgggttcgggggcatactgtcgactttttccaccgaccagaattctctcacgcatcgctacatctgctgacgcagtccacgatctccagtaaccaagttgtagctcgtactcgtatgtcgtggcgggagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctagaggcgttctggttctgaggtgccgccattatatcctgacaaaagtgttgtcagagaatgtgaactctccaaaatccct

SEQ ID NO: 1979 - DNA, 436 bp, Cicer arietinum
acgagcttggtcgccagccagctaacaccaagctatcaagcaacaaaactgttagacgcattcgtgttagaggtggcaatgtgaagtggagagctctcagattggatactggaaatttctcatggggaagtgaagctgtcactcgtaaaacccgtttgctcgatgtggtttacaatgcttccaacaatgagcttgtgcgaactcagacccttgtgaagagtgctatcgtgcaggttgatgctgctcctttcaagcagtggtatcttcaacactacggtgttgaaattggaaggaaaaagaaaactgcttccaaaaaagatacaccagaggaggccgaagctgttacagaagaagccaaaaagagtaaccatgtccaaagaaaattagagacccaccagaaagaacgccagcttgattcccacattgaagagcagtt

SEQ ID NO: 1980 - DNA, 460 bp, Cicer arietinum; identical to SEQ ID NO: 1896

SEQ ID NO: 1981 - DNA, 435 bp, Cicer arietinum
actacgcataattccatgcaagtaaccaccggtcattatgaatgataccagtgacacaacacctgctggaaatatcttccccgatttcttgaagcgagaacccatcactgcaagtagtgcagcagatatgcctagtcccacagatgatgctaaaacaggtcttccaggtagctcagtataaacataatacagcagtgcagaagacaaacccccagccaaaagtgacttctgactgccactcttgagatagcccattacaccacccgctccgacgagaatagcataacctagagttaatttctgagacattgacaaagccattttcctcttatctccgtccgatccttctttgcctttatcactattatctcctccgccgccgctgccaccaccgccgccgccaaaatcgtctccgtttccttcgaaacctccgcc

SEQ ID NO: 1982 - DNA, 171 bp, Cicer arietinum; identical to SEQ ID NO: 1965

SEQ ID NO: 1983 - DNA, 432 bp, Cicer arietinum
gtgatagagagagagagatttcgcaatttcacaaaccctaatttcaaagagatcggcgatggcttcttctaaggatcgtgaaaacttcgtctacatcgccaagctcgccaagcaagctgagcgatacgaagagatggtggattcaatgaagagtgttgcaaatctagatgttgaactgactgttgaagaaaggaatttgctttctgttggttataagaatgtgattggtgctcgcagagcatcgtggaggattctgtcttccattgagcaaaaggaagagacaaagggaaacgatgtaaatgcaaaacggattaaggagtataggcataaggttgaatcagagctttcaaacatctgtaatgatgttatgagagtgattgatgaacaccttataccttcagctgcagctggtgaatcaactgtcttttacta

SEQ ID NO: 1984 - DNA, 188 bp, Cicer arietinum
caagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaac

SEQ ID NO: 1985 - DNA, 459 bp, Cicer arietinum
gattcattacctggtgccactccgccaatggtggctactaaatccaatacgagagtaataaatgttgatgttggagattctgaaatggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccatct

SEQ ID NO: 1986 - DNA, 272 bp, Cicer arietinum
aacaatttggcttttatctagtagacttggagagtgatatcattcggttgggatctctttcttcgtctgggtttggatccggacaaagtcttcccggatctttcaccttcaaatggcggttatttgatacgggacagacataattcaggatgtgagatggacatgagaccccaagccggaaatattggtctgatcatacaaaaacttgcaccgatagaaagccctcggcgacagaaatctagagggactaattttttgtctgcatttcttcc

SEQ ID NO: 1987 - DNA, 337 bp, Cicer arietinum
cttttagtatggcattggttatagctgtgttatctattttcagaatgcagaaattagctcaggaacaaaatgaaaagattgaaaaagttaatcgtgaaaggaaatatcatcagcaaaatactgcatatgagcttaatgctttgtcaatgcaatggaaggagctctgtcagaaaaatataggcatcagtgctgcgtgtgcttctgttgaaatttgcctacatgaactgagaagagaagctgcagaaagaggctggaacttggatgctatcactgaaaatggccaattaaatcattccgagtcatgagattcttatgtgcttacgtagttttgtaccct

SEQ ID NO: 1988 - DNA, 435 bp, Cicer arietinum
actggtgcacatcgtttttcttatgcttgtgtgtttccctgaacttattatgccaacagtgtttctatacgtgtttgttatcgggatgtggaactggagattccgcccgagataccctcctcacatgaacaccagactctcttacacagacggagtgaccctagacgagcttgacgaagaattcgacacatttccttccgcaaagagccctgatatagtgcggtggaggtatgatcggttaagaagtgtggctggaagggttcaaagcgtcgttggagatttagctactcaaggggagaggatccaatcacttgtgagctggcgcgatccgcgcgcgagttccatgttcatggtattttgctttgtgactgctattgtgttgtatatgacacctttccagatgcctattcttttaggtggattttactttatgag

SEQ ID NO: 1989 - DNA, 292 bp, Cicer arietinum; identical to SEQ ID NO: 1390

SEQ ID NO: 1990 - DNA, 436 bp, Cicer arietinum
actgcccagagaacctcttcttctttgcagcctcggctgccgcccggaacacgaccgggcttcgacaatttgtctcactggctgagaccactagacaaaaccgctgggtcgaaatggtacagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctct

SEQ ID NO: 1991 - DNA, 437 bp, Cicer arietinum
atttctcacactagcaatattcttaattcatcatcatgggctgttttcagttttgaggatgaggccacctcaattgtagctcctgctactctctacaaagctctagttacagatgctgacaaccttactccaaaggttattgatgccgttaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacacctaaggagattttactccttctgaagaggagctcaa

SEQ ID NO: 1992 - DNA, 433 bp, Cicer arietinum
acgcatactgcccagagaacctctttctttctgcagcctcggctgctgcccggaacacaaccgggcctcgacgatatgtctcactggatgagactactagacacaaaccgctgggtcaaaatggtatagagcttacctggagaccgtggaatgaggcgactacctcgtccacagagcagcgttctagccgccttggggttttctcctgcgagggttttccccaaggatgcacggttctagggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggacgctgctggagg

SEQ ID NO: 1993 - DNA, 433 bp, Cicer arietinum
gaataatataatgacaacacttggtggagttcgcgatgtgccaggaaaccagaacagccttgagatcgatagtctcgcccgctatgctgttgaggaacacaacaaaaaacagaattctcttctggaatttgaaagggtgataagtgcaaaacagcaagtggtttctggaaccttgcatcacatcactcttgaggcaaaagatggggtgaataaaaaggtttatgaagtcaaggtttgggaaaagtcttggatgaacttcaaggaggtgcaggagttcaagcttgttgaagatgcatctgcggagtcaagtgcttaactaggttaataataattaataaaagtcatgttcctagcttggctcgaaggtgagacgcctaaggataatttaaaaccaggatatgtatgaaatagatccaactcttgctttcaggat

SEQ ID NO: 1994 - DNA, 353 bp, Cicer arietinum
ggaggaatgtagtttattgctccactggatcaaccatccagacaggagttgctaaatcacgataacaatgctacccaaactccatcccgagcagtctattctactcagaacactctacgtgaggctgtctgcttagcagcatccctcatcgcaggcgcagagaccacagcagatctcacagccagcctcctcaccaccacgcatggtcatatcaggctgaggttcagcgctaggctgctgtgtgacgatgtctccgttgtcagaggtcatgggggcttgctgagtgggttccatggcggcgggcatcttggatgactgatggagatcgagtgatggatctggataagaggcaa

SEQ ID NO: 1995 - DNA, 292 bp, Cicer arietinum; identical to SEQ ID NO: 1390

SEQ ID NO: 1996 - DNA, 417 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaggctctgctaagatcagctgtattgatgtccaatgggacgtgcttcaccgacaactactgtagggcgagctacgagtagagaggtgcctcttgggggtaatgagt

SEQ ID NO: 1997 - DNA, 294 bp, Cicer arietinum
aaggtcttttagtttggccttggttatagctgcgatatctattttcagaatgcagaaattagctcaggaacaaaatgaaaagattgaaaaagttaatcgtgaaaggaaatatcatcagcaaagtactgcatatgagcttaatgctttgtcaatgcaatggaaggagctctgtcagaaaaatataggcatcagtgctgcgtgtgcttctgttgaaatttgcctacatgaactgagaagagaagctgcataaagaggctggaacttggatgctatcactgaaaatggccaattaaa

SEQ ID NO: 1998 - DNA, 319 bp, Cicer arietinum
acaaggttaccgtctgcagagtgtgtgaagtatgtgaaattggcaagcatggaagtggtttgaagctgttcgcctagactgggtagagcattgtcgaataagatttaatgacgggagcgcatagttggaattgggagtttcgagtcaacgatgcacaaaaaggagccaggtagacgaggtggaaagtctagggctttaaaaaggttggacttggacgactggttgatagaacgatggcaaaggagtcatgtctttgtagttgcaacttagcctgattatacgcgagaagcacaagatcaaggaatcacgtttaaagact

SEQ ID NO: 1999 - DNA, 190 bp, Cicer arietinum
ctacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 2000 - DNA, 297 bp, Cicer arietinum
acaaagcattcgcggcggattatcctgatcccgaacacttcaggatcaacatcaacctagggtggcagaagctcaacaaatactacacaattctcgacgagacaccaatatattacgtggcgttggctctccaccctgcgtatcgatggggttggttcgaagaacactggggaaaacatccggattggatcgcaactgcgaaagagatggttcaggaagtatgggagaccgaatatcgcaacctcgaggtggtattgagtccaggaaatgagcccgttgctaaacggcgaaggaagt

SEQ ID NO: 2001 - DNA, 438 bp, Cicer arietinum
acgtcaataggaaaacggtatgcaagaacagatgaacttggtgtgccttttgctgtcactgtggattcaacaacgtcagtgactattcgggagagggacagcaaggatcaagtgcgtgttgatgtggaaaaagctgcaactgttattagggaggtatccgaaggccagaggacatgggaagacgtgtggtctactttccctcaccactcgtctaccgctacagatgaatagatgattgaatttaaccaagtcaccaatcttggttggacctttcatggttttcttttgcaactttttttggtgtttgagcaatgaatgaatagaactacaaggatgttaccaattacaactacatacccatttttgttatactgaagtttattctgcatgtttctggttttgcctacaactttaaatgtgcagacctctgctcacctg

SEQ ID NO: 2002 - DNA, 330 bp, Cicer arietinum
gccaactatccaatatgagtaagcttcagagtgatgctttgagagaagccatctcaggaatcacggctgattccaaggagaaaaacaggaaatttgtggagactattgaactccagattggtcttaaaaactatgatccacaaaaggataagcgtttcagtggttctgttaaattgcctcacattcctcgtcccaagatgaaaatctgtatgcttggagacgctcagcatgttgaggaggcagagaaaataggattggactggatggatgttgaagctttgaagaagctaaacaaaaataagaaattggtgaagaaacttgcaaagaagt

SEQ ID NO: 2003 - DNA, 352 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacgagtggggaagttgaagctgcgagagaactcgccgaaggtgcgctcggtgagccagtccttgcccggg

SEQ ID NO: 2004 - DNA, 433 bp, Cicer arietinum
accctcagagacggcgtgcttggcaagctcaccggggaggatgaggcggacagaagtctggatctctcgggaagagatggtggacttcttgttgtaggcggcaagcttggaagcctcagaagcgacgcgctcgaagatgtcgttgacaaaagagttcaggatggacatggcacggttggagataccagtgtcagggtggacctgcttgaggaccttgtagatgtaagaagagtaggtctccttgcgggtcttggagcgcttcttcttgtcaccagaggcggcagtcttcttgccagcatccttcttctcaggagccttggaggcagtagcgggagccttggaggcgggcttcttgtcagcagccttgggagccatttcgaaagatgaagaggttggaaaaagtgtgggttggttgtgtcgattgagtaagaac

SEQ ID NO: 2005 - DNA, 193 bp, Cicer arietinum
cgagctacaacttggttactggagattgtggactgcgtcagcagatgtagtgatgcgcgagagaattctggtcggtggaaaaagttcgacaatagattgcccccgaacccgctgacgggtgacgggcttgagaaatacagcaccttttgtgccattggtatgctggatggtgaaggaagcggggtttccctgt

SEQ ID NO: 2006 - DNA, 415 bp, Cicer arietinum
acagagcttacctggagaccgtggaacggggcaattgcctcgtctacagagcagcgttctggccgccttgggtttttcccctgcaaggggtttccccaaggatgcatagtcctaggttgcagctactggcgatcttagaggatcatggacttcctgcctcagggtatggaaagctacttgatctatccgtgcaagagaattctaggctggagaggaatagatcccgctgacgggatgacctcttgaaagtaaatgcgcctttgtgccgatggtatgctggatgaactagatgggagacgctgctggagggaagctctgcgaggatcaactgtattgatgtccaatgggacgtgcttcaccgacaactactgtagagctggctacgagtagagaggtgcctcttggggggatgagt

SEQ ID NO: 2007 - DNA, 451 bp, Cicer arietinum
accattagaagcgatctccactgcactctttgcatcaggggcagaattactggtctgaactggttgttgctgcgaagcatggaatgctcgggcttttgccctgtgtttctttccatcagcatggagaacaagcgcttgcttacttgtagcttttgtattgcagagactacagaaacaaggaggccgttcagataaacccacattaatatcaacttctggcctttgcttcccatctttgacaggcttggcagctgcagcattcaaagttttgccttggccttttggaccatacttttccgcttcggtaatacattgagtgtgattctgaacggtgtctcgaccaaacatttggccacagtcaatgcacgaaagcttgttggcggagcaagttcggaagtgattgggcaacttgggttttttgagattgtcaccgcaatcttcgcattgaaac

SEQ ID NO: 2008 - DNA, 435 bp, Cicer arietinum
accattagaagcgatctccactgcactctttgcatcaggggcagaattactggtctgaactggttgttgctgcgaagcatggaatgctcgggcttttgccctgtgtttctttccatcagcatggagaagaagcgcttgcttacttgtagcttttgtattgcagagactacagaaacaaggaggccgttcagataaacccacattaatatcaacttctggcctttgcttcccatctttgacaggcttggcagctgcagcattcaaagttttgccttggccttttggaccatacttttccgcttcggtaatacattgagtgtgattctgaacggtgtctcgaccaaacatttggccacagtcaatgcacgaaagcttgttggcggagcaagttcggaagtgattgggcaacttgggttttttgagattgtcaccgca

SEQ ID NO: 2009 - DNA, 374 bp, Cicer arietinum
accgttgtttcgttggtggtctagcctggaccaccgacagcgacgccccagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtggaggtggatatggcggagga

SEQ ID NO: 2010 - DNA, 449 bp, Cicer arietinum
actagtgattggtttcgaatcagtcgatggttctagaaagcaggtttctggaacaaacaaactacgttctggaaattattgggaaggagcgccaattatttgagacttcacaacaacaatgccagtataacttacaagaaaaaataaatcaacagtccatagaatacaacaaattgacaactcaaatcgaaggacaaaataaagacatacaagaaatcaaacaatttttaaaattattggtccctagaatagttggaatcgaagcatcctataaagtactttcaactgaaaatccgataatggaaagccaacaaaaaccaagaccaataaaacggaaaaaacaaagctagagctccttgccttttcgggaatgtgaaagcgattttaagtttctgcctttgctcacatgacggaatctaaaatttgtgtgttgcagatttaatttcttt

SEQ ID NO: 2011 - DNA, 443 bp, Cicer arietinum
gattttcgagcgggccgcccgggcaggtacagagcttacctggagaccgtggaacgaggcgactacctcgtccacagagcagcgttctagccgccttgggtttttccctgcgaggggtttccccaaggatgtatggtcctaggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctacgagtagagaggtgcctcttgggggtaatgagt

SEQ ID NO: 2012 - DNA, 416 bp, Cicer arietinum
acagagcttacctggagaccgtggaacgaggcgactgccttgtccacagagcagcgttctagccgccttgggtttttccctgcgaggggtttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggacgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 2013 - DNA, 388 bp, Cicer arietinum
cgctggcgctgcactcgctcacactctcggcaaggatggacgccgagtgcttgtcattgaaagaggtctgagtgagcctgatagaattgttggagagttgctacaacctggcggctatctcaaattagttgaactgggccttgaagattgtgtgaacaatattgatgcgcagcaagtgtttggttatgcacttttcaaagatgggaaacatacccgtctctcttatcccttggataagtttcactcagatgtatctggcagaagctttcacaatggccgttttattcagagaatgcgagagaaggctgcttcccttcccaatgtaaatttggagcaaggaacagtcacttccctacatgaagagaaggggacaatcaaaggtgtacct

SEQ ID NO: 2014 - DNA, 193 bp, Cicer arietinum; identical to SEQ ID NO: 2005

SEQ ID NO: 2015 - DNA, 435 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacacagtccacaatctccagtaaccaagttgtagctcgtagtcgactgtcgcggcggcagggaaaaacctcgggaagggatcagaggccggcggtgcggcttgccttcaaaggagaaaaacccatcgcaatcggcgtcgttgatcggaaggatgtcgctacgaatgcccggggcatcgtcctccgatatctaagacgttctggttctgaggtgccgccattagatccgacaaaggtgttgtcagagaaggcgaactctccaaaattccttctctgaaaactgctgt

SEQ ID NO: 2016 - DNA, 358 bp, Cicer arietinum
accgttgtttcgttggtggtctagcctggaccaccgacagcgacgccccagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtggagg

SEQ ID NO: 2017 - DNA, 424 bp, Cicer arietinum
accattagaagcgatctccactgcactctttgcatcagggggagaggtacgggtctgaactggttgttgctgcgaagcatggaatgctcgggcttttgccctgtgtttctttccatcagcatggagaagaagcgcttgcttacttgtagcttttgtattgcagagactacagaaacaaggaggccgttcagataaacccacattaatatcaacttctggcctttgcttcccatctttgacaggcttggcagctgcggcattcaaagttttgccttggccttttggaccatacttttccgcttcggtaatacattgagtgtgattctgaacggtgtctcgaccaaacatttggccacagtcaatgcacgaaagcttgttggcggagcaagttcggaagtgattgggcaacttgggttttttgaga

SEQ ID NO: 2018 - DNA, 428 bp, Cicer arietinum
tagccaggagacgaagatgtttgcaggttgagttgtgagttactctaccaacacttgaatcggaagggactcaacacagacgcaactaccacaacacaacacaatcacggcgtcctctgatcccaacaaattgttaaccaaagctgataaactaacaagacttagtctcaccagatggagtgctgattggaagagtgctactgttctatatgaacaggctgctaatgggtttagagttgccaagaacactgagaaagccaaaacagcatttgagaaagcttcgaaaggacaagagatgctttcttcaccttgggatgcagctaagcacatggaatctgctgctgctctggccaaggaactgagtaactggaaagaagtagcagacttctatcaaaaggcatctgaactctacttggagtgtgggagac

SEQ ID NO: 2019 - DNA, 417 bp, Cicer arietinum; identical to SEQ ID NO: 1860

SEQ ID NO: 2020 - DNA, 437 bp, Cicer arietinum
ctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgctttta

SEQ ID NO: 2021 - DNA, 437 bp, Cicer arietinum
tagccaggagacgaagatgtttgcaggttgagttgtgagttactctaccaacacttgaatcggaagggactcaacacagacgcaactaccacaacacaacacaatcacggcgtcctctgatcccaacaaattgttaaccaaagctgataaactaacaagacttagtctcaccagatggagtgctgattggaagagtgctactgttctatatgaacaggctgctaatgggtttagagttgccaagaacactgagaaagccaaaacagcatttgagaaagcttcgaaaggacaagagatgctttcttcaccttgggatgcagctaagcacatggaatctgctgctgctctggccaaggaactgagtaactggaaagaagtagcagacttctatcaaaaggcatctgaactctacttggagtgtgggagaccacaacctg

SEQ ID NO: 2022 - DNA, 436 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctcggccgacctcggcc

SEQ ID NO: 2023 - DNA, 434 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctcggccgacctcgg

SEQ ID NO: 2024 - DNA, 340 bp, Cicer arietinum; identical to SEQ ID NO: 156

SEQ ID NO: 2025 - DNA, 338 bp, Cicer arietinum
  misc_feature (336)..(336): n is a, c, g, or t
cttttagtatggcattggttatagctgtgttatctattttcagaatgcagaaattagctcaggaacaaaatgaaaagattgaaaaagttaatcgtgaaaggaaatatcatcagcaaaatactgcatatgagcttaatgctttgtcaatgcaatggaaggagctctgtcagaaaaatataggcatcagtgctgcgtgtgcttctgttgaaatttgcctacatgaactgagaagagaagctgcagaaagaggctggaacttggatgctatcactgaaaatggccaattaaatcattccgagtcatgagattcttatgtgcttacgtagttttgtaccntg

SEQ ID NO: 2026 - DNA, 444 bp, Cicer arietinum
ccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccatctg

SEQ ID NO: 2027 - DNA, 180 bp, Cicer arietinum
gccgaggtgaaccttcacgatgcaaagctcagtggttttgacatcccgcgccgagagcaagatattggtcaatgcgtgttggctcgcaaacaacccggcccaatggaaaaagcccgaggaatttaggcccgagaggttcttagaggaagagtctcatgtcgaggctaatggaaatgactt

SEQ ID NO: 2028 - DNA, 241 bp, Cicer arietinum
acaaaggaccatggaaacgaaagaaaatcaagaatcctaactacaaaggaaaatggaaaactccatggatagataatccagagtttgaagatgaccccgatctttatgtgcttaagcctatcaaatatgttggcatcgaagtttggcaggttaaaggcggttcagtatttgacaacattttgatttgtgatgatcctgattatgcataacaagttgttgatgaagtgtttgccaataggga

SEQ ID NO: 2029 - DNA, 424 bp, Cicer arietinum
ccatggaaacgaaagaaaatcaagaatcctaactacaaaggaaaatggaaaactccatggatagataatccagagtttgaagatgaccccgatctttatgtgcttaagcctatcaaatatgttggcatcgaaatttggcaggttaaaggcggttcagtatttgacaacattttgatttgtgatgatcctgattatgcaaaacaagttgttgatgaagtgtttgccaatagggagattgaaaaagaggcttttgaggaagcagagaaaataaaaaaagcccaagaggaggaggaggctcaaagagcaagagaggaaggtgagaggcgaataaaagagaggggtcatgaccgacgacaccgggacagatatagagaccgatatagaaagcatcgccgtgattacatggatgattacgatcatgatg

SEQ ID NO: 2030 - DNA, 392 bp, Cicer arietinum; identical to SEQ ID NO: 1458

SEQ ID NO: 2031 - DNA, 435 bp, Cicer arietinum
acaagggaccaactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcacacctcccaca

SEQ ID NO: 2032 - DNA, 382 bp, Cicer arietinum
ggccacgtcagcgccggtcatggtcttgtcggtaagcacaggtaagcatcctggaggtagaggtaacgccggaggtatgcaccaccaccgtatcctcttcgacaaataccatcctggttatttcggtaaggtcggtatgcgttatttccacaaactccgtagcaaattctactgccccattgtcaacatagacaagctatcttctctcatttctcaagaggtcgaggacaaagcttctaaggaaaacaaagcacctgttattgatgttactcaatttggattcttcaagcttttgggtaaaggtgttttgcctcagaatcagccatttgttgtgaagactaaactcatttccaagatcgctgagaagaagattaaggaagcc

SEQ ID NO: 2033 - DNA, 436 bp, Cicer arietinum
cactttcagagtggaaaaagtaaaaagagtttatataattttttgctaattaattaaggtttgagttttacattgagaagccaaaatggctaccttgattggaaaggagagtggtttgaacttgaaggagacagagctttgccttggtttgcccggtggtggtggttctggttctgaggtggaaactcaaagagctgctggaaagagaggtttttctgagacagttgatctgaagctgaatcttcaatccaacaaggaagatctgaatgacaattctaagaatgtttccaaggacaagactctccttaaggaccctgccaagccacctgctaaggcacaagtagttggttggccaccagtgaggtcatacaggaagaacatgatggcacaaaaggttaacaatagtgatcaggatggcaatgagaagacaacaagt

SEQ ID NO: 2034 - DNA, 435 bp, Cicer arietinum
gaataatataatgacaacacttggtggagttcgcgatgtgccaggaaaccagaacagccttgagatcgatagtctcgcccgctatgctgttgaggaacacaacaaaaaacagaattctcttctggaatttgaaagggtgataagtgcaaaacagcaagtggtttctggaaccttgcatcacatcactcttgaggcaaaagatggggtgaataaaaggtttatgaagtcaaggtttgggaaaagtcttggatgaacttcaaggaggtgcaggagttcaagcttgttgaagatgcatctgcggagtcaagtgcttaactaggttaataataattaataaaagtcatgttcctagcttggctcgaaggtgagacgcctaaggataatttaaaaccaggatatgtatgaaatagatccaactcttgctttcaggattta

SEQ ID NO: 2035 - DNA, 450 bp, Cicer arietinum
ttggtttcgaatcagtcgatggttctagaaagcaggtttctggaacaaacaaactacgttctggaaattattgggaaggagcgccaattatttgagacttcacaacaacaatgccagtataacttacaagaaaaaataaatcaacagtccatagaatacaacaaattgacaactcaaatcgaaggacaaaataaagacatacaagaaatcaaacaatttttaaaattattggtccctagaatagttggaatcgaagcatcctataaagtactttcaactgaaaatccgataatggaaagccaacaaaaaccaagaccaataaaacggaaaaaacaaagctagagctccttgccttttcgggaatgtgaaagcgattttaagtttctgcctttgctcacatgacggaatctaaaatttgtgtgttgcagatttaatttctttttttttttt

SEQ ID NO: 2036 - DNA, 436 bp, Cicer arietinum
acaagggaccaactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcacacctcccacat

SEQ ID NO: 2037 - DNA, 435 bp, Cicer arietinum
cactttcagagtggaaaaagtaaaaagagtttatataattttttgctaattaattaaggtttgagttttacattgagaagccaaaatggctaccttgattggaaaggagagtggtttgaacttgaaggagacagagctttgccttggtttgcccggtggtggtggttctggttctgaggtggaaactcaaagagctgctggaaagagaggtttttctgagacagttgatctgaagctgaatcttcaatccaacaaggaagatctgaatgacaattctaagaatgtttccaaggacaagactctccttaaggaccctgccaagccacctgctaaggcacaagtagttggttggccaccagtgaggtcatacaggaagaacatgatggcacaaaaggttaacaatagtgatcaggatggcaatgagaagacaacaag

SEQ ID NO: 2038 - DNA, 433 bp, Cicer arietinum
cactttcagagtggaaaaagtaaaaagagtttatataattttttgctaattaattaaggtttgagttttacattgagaagccaaaatggctaccttgattggaaaggagagtggtttgaacttgaaggagacagagctttgccttggtttgcccggtggtggtggttctggttctgaggtggaaactcaaagagctgctggaaagagaggtttttctgagacagttgatctgaagctgaatcttcaatccaacaaggaagatctgaatgacaattctaagaatgtttccaaggacaagactctccttaaggaccctgccaagccacctgctaaggcacaagtagttggttggccaccagtgaggtcatacaggaagaacatgatggcacaaaaggttaacaatagtgatcaggatggcaatgagaagacaaca

SEQ ID NO: 2039 - DNA, 434 bp, Cicer arietinum
acgtaaaagaggacactgaaagtcccttgcttataaatgctgatcagagaagctgttaatggagacagatatgatttatcatctatagagcataatattgtcggataaagcactacacagatcatggtgttgtctatggttgaagatttatgcacctgttaatgattatgggatgacagcatattctaactaaggatgcaacagatctaccgttcctcttaggagaagtgtcattctcagaggatgcttccagtatttgattgggtcccaagaatattctgttggcttatgaacttcttcgattgtttatctctttttgcaggttggatttggaaagatcagatgtagaatcccacagctgttggtgtgatttaagatttcaagaaatgacctgcttttgtcatgatcaaccatgccgaactatatcgtgcttc

SEQ ID NO: 2040 - DNA, 435 bp, Cicer arietinum; identical to SEQ ID NO: 2034

SEQ ID NO: 2041 - DNA, 297 bp, Cicer arietinum
acaaagcattcgcggcggattatcctgatcccgaacacttcaggatcaacatcaacctagggtggcagaagctcaacaaatactacacaattctcgacgagacaccaatatattacgtggcgttggctctccaccctgcgtatcgatggggttggttcgaagaacactggggaaaacatccggattggatcgcaactgcgaaagagatggttcaggaagtatgggagaccgaatatcgcaacctcgaggtggtattgagcccaggaaatgagcccgttgctaaacggcgaaggaagt

SEQ ID NO: 2042 - DNA, 453 bp, Cicer arietinum; identical to SEQ ID NO: 1623

SEQ ID NO: 2043 - DNA, 392 bp, Cicer arietinum; identical to SEQ ID NO: 1458

SEQ ID NO: 2044 - DNA, 168 bp, Cicer arietinum
aacgagctcctcaccaacaaggagttcaacgctgctgactgcttgcaattcgtcgagctctacatgcccagagaggatgctcctcgcgctctgatcatgactaccgaggccagtgctaggaacaacgccgagaagcactctacggttactcaagaaagagtgaaattt

SEQ ID NO: 2045 - DNA, 435 bp, Cicer arietinum
ctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagt

SEQ ID NO: 2046 - DNA, 297 bp, Cicer arietinum
acgtataagaggacactgaaagtcccttgcttataaatgctgatcagagaagctgttaatggagacagatatgatttatcatctatagagcataatattgtcggataaaggactacacagatcatggtgttgtctatggttgaagatttatgcacctgttaatgattatgggatgacagcatattctaactaaggatgcaacagatctaccgttcctcttaggagaagtgtcattctcagaggatgcttccagtatttgattgggccccaagaatattctgttggcttatgaacttc

SEQ ID NO: 2047 - DNA, 433 bp, Cicer arietinum
acaagggaccaactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcacacctccca

SEQ ID NO: 2048 - DNA, 438 bp, Cicer arietinum
actaaggcgaaagaagccatggataagggagagcttgtttctgatgacttggttgttggcattattgatgaggccatgaagaaaccatcatgtcaaaaaggtttcatcctggatggttttccaagaactgtggttcaagcacagaagcttgacgaaatgctggaaaagcagggtgctaaaattgacaaggtgctcaattttgcaattgatgatgcaatccttgaggagaggattactggacgctggatacacccatccagtggcagaacctaccatacaaagtttgctccttccaaggttcctggggttgatgatgttactggtgaaccccttatccagcgcaaggatgacactgcagctgttcttaagtcgagactggatgcatttcacaggcagactgaaccggttattgattactattcaaagaagggcattgtt

SEQ ID NO: 2049 - DNA, 457 bp, Cicer arietinum; identical to SEQ ID NO: 1898

SEQ ID NO: 2050 - DNA, 288 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttt

SEQ ID NO: 2051 - DNA, 458 bp, Cicer arietinum
actagtgattggtttcgaatcagtcgatggttctagaaagcaggtttctggaacaaacaaactacgttctggaaattattgggaaggagcgccaattatttgagacttcacaacaacaatgccagtataacttacaagaaaaaataaatcaacagtccatagaatacaacaaattgacaactcaaatcgaaggacaaaataaagacatacaagaaatcaaacaatttttaaaattattggtccctagaatagttggaatcgaagcatcctataaagtactttcaactgaaaatccgataatggaaagccaacaaaaaccaagaccaataaaacggaaaaaacaaagctagagctccttgccttttcgggaatgtgaaagcgattttaagtttctgcctttgctcacatgacggaatctaaaatttgtgtgttgcagatttaatttctttttttttttt

SEQ ID NO: 2052 - DNA, 344 bp, Cicer arietinum
acataaaacataaaccatcgtccgccactctatagtataaaccataaaccacttaaatcattattatgttctccaggaaccttttccaaaaccccgtctatcaaatttcactctttcttgagtaaccgtttagtgcttcttggcgttgttcctagcactggcctcggtagtcatgatcagagcgcgaggagcatcctctctgggcatgtagagctcgacgaattgcaagcactcagcagcgttgaactccttgttggtgaggagctcgttgagctcagtcttggtcttgatctggaaggtcttgcaggtcttctcgccgccgaagacgctgacgaggtccttgc

SEQ ID NO: 2053 - DNA, 454 bp, Cicer arietinum; identical to SEQ ID NO: 1935

SEQ ID NO: 2054 - DNA, 377 bp, Cicer arietinum
ctctaatcccccatctggtggcagcagaagaagaaccaccatcaccaccggcatttatgctccccctaaccgtgatcacattgcgctggcattagcaatggcttatcaggaagccactaatcaccataaacagcgaccgcctattaatgatctcggtccaaatgataagatacctgatgcatctattgttgcttatcctcccagggtttttggtccttgagcaactgggtgcaacagcttcagcactgagttttacttgtaaaaaatgtgttccactgctaccaattacagctaggagcattggtaatttctgctgcgtatcatatgtatagataataatcattttagagactaaaactgggcaaactatagcatgt

SEQ ID NO: 2055 - DNA, 423 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgcct

SEQ ID NO: 2056 - DNA, 448 bp, Cicer arietinum
actagtgattggtttcgaatcagtcgatggttctagaaagcaggtttctggaacaaacaaactacgttctggaaattattgggaaggagcgccaattatttgagacttcacaacaacaatgccagtataacttacaagaaaaaataaatcaacagtccatagaatacaacaaattgacaactcaaatcgaaggacaaaataaagacatacaagaaatcaaacaatttttaaaattattggtccctagaatagttggaatcgaagcatcctataaagtactttcaactgaaaatccgataatggaaagccaacaaaaaccaagaccaataaaacggaaaaaacaaagctagagctccttgccttttcgggaatgtgaaagcgattttaagtttctgcctttgctcacatgacggaatctaaaatttgtgtgttgcagatttaatttctt

SEQ ID NO: 2057 - DNA, 440 bp, Cicer arietinum; identical to SEQ ID NO: 1649

SEQ ID NO: 2058 - DNA, 457 bp, Cicer arietinum; identical to SEQ ID NO: 1898

SEQ ID NO: 2059 - DNA, 448 bp, Cicer arietinum; identical to SEQ ID NO: 2056

SEQ ID NO: 2060 - DNA, 460 bp, Cicer arietinum; identical to SEQ ID NO: 1896

SEQ ID NO: 2061 - DNA, 166 bp, Cicer arietinum
gattcagatccaaaccatagattagatctaaaatggcaacaaccacctttgcaaccgccgtaggaagggggggcgcatcctcccccgccctcagggtgaggacacccacaaagtgatggccaggaatcgcttgaggcaagctatggcacggggaaatggtgggagg

SEQ ID NO: 2062 - DNA, 309 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtc

SEQ ID NO: 2063 - DNA, 341 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttgacagagacgttgtcctggtcgacacgagtggggaagttgaagctgcgagagaactcgccgaaggtgcgctcggtgagccagt

SEQ ID NO: 2064 - DNA, 331 bp, Cicer arietinum
acggactcaaaagataacgtgaacataaccagtgaccaacgaatattcacccaaatacgaccgtaacgccttcatcattctcgaggtgggatatagaaccgattccacacagcttactcccaagcatcaccgaaggtgttctcgccggagtaggtaatgtataggaaaccgtcctcatccttgtgttcctcgtagatactgctcatgagggcggccgttgggggaagcacctcgtcgacgaagatgaagatggccttctcgggggagagcttgattcgcttgcggatgacgtagacgaactgaccgacggtcaaatcggcggggacaaggt

SEQ ID NO: 2065 - DNA, 431 bp, Cicer arietinum
acccaagtcaccggtattatttctcaaaccgacgtcgtcttacttgaaaaatggcggaacaatccaaatcccacacaacgagagttctctccatcacgaagtcgaactcgccgtcgtcatcggaaagaaagctcgtgatgtccctgaatcctctgccatggattacgttgccggttatgcactggcactggatatgactgccagggatcttcaatctgctgctaagtctgcaggtcttccgtggagtctggcaaaaggccaagacactttcacaccaattagtcctattttgcccaagacagcagtgccaaaccctgatgatctagaattatggataaaggtagatgaagaaattcggcagaagggctcaactaaggacatgatattcaaaattccatttttgattagccacattagctcgttcatgacat

SEQ ID NO: 2066 - DNA, 434 bp, Cicer arietinum
acaatgcaatgcttcaattaactcttccggatttgataactagtattatcagctgcagacagcttccactgcaagtttggttgataagccagaacacaagttggttttgaaattctcttcacttaattttatgacacaatcgtttttgtttaggcacgccttttcaaccactatgctagaattaggatcatggcaatctcccttaaggtaagctccacattttccagaaggagttccaaagctagcaaattttacagcagttataacagtgttactggggcatgttaaacgtgcaaaaggaaggtttttgttgttctctatcttattttcatgctcagaaaggagtccaacagagggatgatccttggcaacaagggcacacaatccagatactttacgtctcacaaatgtaatctttgttggatcaccacctt

SEQ ID NO: 2067 - DNA, 434 bp, Cicer arietinum
acccaagtcaccggtattatttctcaaaccgacgtcgtcttacttgaaaaatggcggaacaatccaaatcccacacaacgagagttctctccatcacgaagtcgaactcgccgtcgtcatcggaaagaaagctcgtgatgtccctgaatcctctgccatggattacgttgccggttatgcactggcactggatatgactgccagggatcttcaatctgctgctaagtctgcaggtcttccgtggagtctggcaaaaggccaagacactttcacaccaattagtcctattttgcccaagacagcagtgccaaaccctgatgatctagaattatggataaaggtagatgaagaaattcggcagaagggctcaactaaggacatgatattcaaaattccatttttgattagccacattagctcgttcatgacattgt

SEQ ID NO: 2068 - DNA, 404 bp, Cicer arietinum
gtcgaaattaattattttagatggagtcatacaggaaggttatgattgtggggataatgttgttggccattgccaatgcaatgttgttggttaatggtcagtcctattgtcacatgacaaaatcagggcttaattcatgcaagccttatgtgagtggtgacaattctgttgatgatcaaattccatccaatgcttgttgctctgctatttccaaagctgatcttcaatgtttgtgtcgttacatggattcagggttgctttctttctatggtgttgatccaaaacaagccatggaactacctgttaagtgtaagcttatggactcattccattgctaagactatgtccatctacaattactatgcaaaagctctagctactagattaataatgtaatggtttct

SEQ ID NO: 2069 - DNA, 298 bp, Cicer arietinum
actcaggattggtcttgagatgtctgtatatggttatgtatctccagtatccaattttctcagacaaatatgtagcatagaaaataaatttgggcttgaaaaaagtgtattttctagcttttgtcaagaatcccaagtctaatgccaaattgaagtcagataaacccttatttaaaaacccagcatgcctagcttcatccctagacatcagagagaaaatttcagccaccacagggttggttttcttgagcctccttccaagctctttgtagagaagaaaaccagagaattcagcagg

SEQ ID NO: 2070 - DNA, 308 bp, Cicer arietinum
gcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgt

SEQ ID NO: 2071 - DNA, 415 bp, Cicer arietinum
acagagcttacctggagaccgtggaacgaggcgactacctcgtccacagagcagcgttctagccgccttgggtttttccctgcgaggggtttccccaaggatgtatggtcctaggttgcagctactggcgatcttaggggatcatggacttcctgcctcagggtatggaaagctacttgatctatctgtgcaagagaattctaggctggagaggaatagatcccgttgacgggatgacctctcgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctacgagtagagaggtgcctcttgggggtaatgagt

SEQ ID NO: 2072 - DNA, 408 bp, Cicer arietinum
gattcagatccaaaccatagattagatctaaaatggcaacaaccacctttgcaaccgccgtaggaatgggtggcgcatcacgtctcgcctcagggtttgtgaaaccacaagtgatggccaggaatcgcttgaggcaagctatggcacggggaaatggtgggagggttacatgcttccagagggattggctgcggagggatttcaatgtgattgggtttgggttaattggttggttggcaccgtctagcataccggctatcgacggtaaaagtctgactggacttttctttgatagcattggaactgaacttgctcacttcccaacccctcctgctctcacttcacagttttggttatggctgatctgttggcatttgggactgttcatctccctcacttttggccaaa

SEQ ID NO: 2073 - DNA, 439 bp, Cicer arietinum
actaaagataaaaacagattatttttttacccaaagttgtctttgagaattatgtgaacaactactttacttaaacagtggaaatttacattgaatagaatgcatggtataacaccaaataagataacaatacatcaattcatttctcaacagtttgaacaaaataataatagaatctagtttatttgtccacaatcttcaattacaacaggttcagatgtcttgccactatgagaacccaccttctccatttcctgaacaacactgtatccatcaacaacttttccaaatacaacatgtttcccatcaagccatggggtctttgtagtgccggcccctgattccttcccaaggtttttccctgccgccacgacatacgactacgagctacaacttggttactggagattgtggactgcgtcagcagatgtagcgatgc

SEQ ID NO: 2074 - DNA, 241 bp, Cicer arietinum
accttcactcctacataatcaccaagtgcccgcataaccttctcaatctgctgggcaagctcacgagttggtgccgagaccaaggcttggcattctgttacattatagtcaagttgctacagaattccagagcagaaagttgctgtcttccctgttccagactgagcctgttgtataacatcaagtcccctgcagaatggaactattcccctttgttgaatagctgatggcttctcaaaac

SEQ ID NO: 2075 - DNA, 436 bp, Cicer arietinum
ctgataccatggcggttgaaaggtctggaattgccaaagatgttacagaattgattggcaaaaccccattagtatatctaaatagacttgcggatggttgtgtggctcggattgctgccaaactggaattgatggagccatgctctagtgtaaaagacaggattgggtatagtatgattgctgatgcagaagagaaggggcttatcacacctggacagagtgtcctcattgaaccaacaagtggtaatactggcattggattagcctttatggcagcggccaagggttacaagctcataattacgatgcctgcttcaatgagtcttgaaagaagaatcattctattggcttttggagctgaattggttctgacagatcctgcaaagggaatgaaaggagctgttcagaaagctgaagagatactggctaagacacc

SEQ ID NO: 2076 - DNA, 414 bp, Cicer arietinum
  misc_feature (271)..(271): n is a, c, g, or t
ataattctcacttgtttgtttcaatcatcatccatgtcgactactgctggtcaagtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaagggtcagactcctatgtttcctcgtatatttggccatgaagctggagggattgtggagagcgtangggagggtgtgactaatctgaaaccaggggatcatgctctgcctgtattcactggggagtgtggggaatgtccacattgtaagtctgaggaaagcaacatgtgtgatcttcttaggatcaacacagataggggtgtcatgatc

SEQ ID NO: 2077 - DNA, 220 bp, Cicer arietinum
accgtctctcaaattataaagaattgcttgcttttctttattgcttgccaatataagtgtatcaccattctcagaaaaacacaacggaaatagaaacaaccgaagatacatcacactccaaccaaacgtatttacttgaagattctgataactaattttaacgaattgagttcaagattcttcaactccaaattcagtcatcttccacataacaaaatga

SEQ ID NO: 2078 - DNA, 434 bp, Cicer arietinum
actgaacttgggatcaaagcacctgcttccaagttttacaatctctttgcaacacaacttcatgaagtgcaaaaccattgtgaaagagttcatcacaccaagctacaacaaggggaagactggcatcactctgattcggttaaacactggaagtatgtcatagatggcaaagtacagagacgtataggcaattgttgcctcctctgggttttgatgttgttgggccaactattgctgtcttgatggaatgtctctatttttcttaccatttcgagagatctcattttgttatgtggaagatgactgaatttggagttgaagaatcttggactcaattcgttaaaattagttatcagaatcttcaagtaaatacgtttggttggagtgtgatgtatcttcggttgtttctatttccgttgtgtttttctgagaat

SEQ ID NO: 2079 - DNA, 355 bp, Cicer arietinum
acatgcttacatggacgtcgatgagcacgacctcgatggaaccgaagatttcgccggtgcattgagcacaccctacgctatacacggaaccgaccaaacggtgctatggcgcgattgcgaggcgtctatcatatccattgaatctgaggggcatgctactgtgataaagaagatggcgaggagacagggttggtgtattgtgcctcgaggctatgcactatactgtgttggagatggtggtcaattaaagaagaagacctgactgcttctatgtgtattatccgaacagcttctctctcatcttgagcccgtgttccaaacccaaactcaagctcaatatgctattgtctagacg

SEQ ID NO: 2080 - DNA, 417 bp, Cicer arietinum
gtcgaaattaattattttagatggagtcatacaggaaggttatgattgtggggataatgttgttggccattgccaatgcaatgttgttggttaatggtcagtcctattgtcacatgacaaaatcagggcttaattcatgcaagccttatgtgagtggtgacaattctgttgatgatcaaattccatccaatgcttgttgctctgctatttccaaagctgatcttcaatgtttgtgtcgttacatggattcagggttgctttctttctatggtgttgatccaaaacaagccatggaactacctgttaagtgtaagcttatggactcattccattgctaagactatgtccatctacaattactatgcaaaagctctagctactagattaataatgtaatggtttcttttgcacttgttt

SEQ ID NO: 2081 - DNA, 433 bp, Cicer arietinum
acccaagtcaccggtattatttctcaaaccgacgtcgtcttacttgaaaaatggcggaacaatccaaatcccacacaacgagagttctctccatcacgaagtcgaactcgccgtcgtcatcggaaagaaagctcgtgatgtccctgaatcctctgccatggattacgttgccggttatgcactggcactggatatgactgccagggatcttcaatctgctgctaagtctgcaggtcttccgtggagtctggcaaaaggccaagacactttcacaccaattagtcctattttgcccaagacagcagtgccaaaccctgatgatctagaattatggataaaggtagatgaagaaattcggcagaagggctcaactaaggacatgatattcaaaattccatttttgattagccacattagctcgttcatgacattg

SEQ ID NO: 2082 - DNA, 435 bp, Cicer arietinum
cggccgaggtctctaatgtgggcgagcacaaagaatgataccctaaaggggaaagtttcagctctaattgccggtctatctgcctgtcaggagaaaattggaacaggatatctctcggcatttccacctgagtttttcgaccgatttgaagctattcaacctgtgtgggctccctattacacaattcacaagatcttggctggcttgttggatcaatatactgtagccggaaaccctcaagctctcaaaatggtgacatggatggttgattacttttacaaccgagtggtgaatgtaatatcaaagtacactctaaatagacactatgaatcactgaatgacgaaactggaggaatgaatgatatactttacagattatatagcataacgggcgattcaaagcatctattgttggcgcaccttttcgacaagcca

SEQ ID NO: 2083 - DNA, 114 bp, Cicer arietinum
ttttctagccattggagtcccaggaagtgccaaggacttcttcaatcaagttgaatcattagctcttctggagagcaaaagggttcccatcccattggtgctgtcacttcctga

SEQ ID NO: 2084 - DNA, 424 bp, Cicer arietinum
cacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatgtcatactctcttcttcttttcattttgttgtggaagtgtgagattgtaagtcaagtgtgtacctggcccgggcg

SEQ ID NO: 2085 - DNA, 341 bp, Cicer arietinum; identical to SEQ ID NO: 202

SEQ ID NO: 2086 - DNA, 347 bp, Cicer arietinum
acaaggagcgaatgaccaagccaggcctacaatgctatttcatgctaagaaacttctcaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacgagtggggaagttgaagctgcgagagaactcgccgaaggtgcgctcggtgagccagtacctgc

SEQ ID NO: 2087 - DNA, 344 bp, Cicer arietinum
actggctcaccgagcgcaccttcggcgagttctctcgcagcttcaacttccccactcgtgtcgaccaggacaacgtctctgccaagtttaaggacggtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgtaggcctggcttggtcattcgctccttgtcct

SEQ ID NO: 2088 - DNA, 231 bp, Cicer arietinum
cttcccgaggcttttccctgccgccgcgacagtcgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgtacct

SEQ ID NO: 2089 - DNA, 368 bp, Cicer arietinum
  misc_feature (357)..(357): n is a, c, g, or t
acaaggagcgaatgaccaagccaggcctacaatgctatttcatgctaagaaacttcccaacaccgatccatgcaatgctaaagtcgtaaagatgagtcattactgatctcgacttgtcgtgaaatctgagagctggataataaggtcgtcaagattccgggttgtggtgtgttgtcgcgtttactcgaggttgatgcggcgagactcgtgcttcttggccttgggaacaacaatgctcaggataccgtccttaaacttggcagagacgttgtcctggtcgacacgagtggggaagttgaagctgcgagagaactcgccgaaggtgcgctcggtgacccagtacctcggccatcatcnactcttacctc

SEQ ID NO: 2090 - DNA, 432 bp, Cicer arietinum
acactagatggacaaggtgaactgtggtggcaaaagtttcaccatgggcagcttagttataccagaccttacctaattgaaatcatgtattcagataatattcagatatccaatctcactttggttaattctccctcctggaatgtccatcctgtttacagtagcaacgttattgttcaaggaatcacaattcttgcgcccgtgaactcgccaaatacagatggaatcaaccctgactcttgcacggacacacgaattgaggactgttatatagtgtcaggggacgattgtgtggctgtgaagagtggttgggatgagtatggtatagcttatggaatgccaacgaagcaactggtaatcagaaggctcacttgtatttctccaacgagtgccgtgattgctttagggagtgaaatgtctggtggaatcgaa

SEQ ID NO: 2091 - DNA, 438 bp, Cicer arietinum
ccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccatagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacatt

SEQ ID NO: 2092 - DNA, 432 bp, Cicer arietinum
aattctctgaacttgttaatgatttttacaataatgggttgccttcaaatctttctgctagtaggaatccaagtttggattatggtttcaaaggtgctgaaattgcaatggcttcttattgttctgagttgcaatatcttgctaaccctgtcactacacatgttcaaagtgctgaacaacataaccaagatgttaactctttgggtttgatttcatctagaaaaacaaatgaggctattgagatcttaaagttgatgtcttcaactttcttgattgcactttgtcaagcaattgatttgaggcatttggaggagaatttgaagaacactgtgaagaacactgtgagtcaagttgcgaagaggacgctaacgactggcgtgaatggtgaactacatccatccagattttgtgagaaagatttgctcaaagttg

SEQ ID NO: 2093 - DNA, 458 bp, Cicer arietinum; identical to SEQ ID NO: 1835

SEQ ID NO: 2094 - DNA, 457 bp, Cicer arietinum; identical to SEQ ID NO: 1898

SEQ ID NO: 2095 - DNA, 461 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccatctga

SEQ ID NO: 2096 - DNA, 461 bp, Cicer arietinum; identical to SEQ ID NO: 2095

SEQ ID NO: 2097 - DNA, 437 bp, Cicer arietinum
aagacgaccagcgccttaggcaactaaattaaggcctgatcaaattccccatttaccttgtcattagcaggaatcctgcaatatacacctgatattccttcttggaacttttccagatcctcaaccaccatataatgaaagtggatgagacatagactacaatatcacacagaacgtctgtctatattcgccttacgtcgagcaaaacgttgccgcctcatcgatgcaaaagtatcgcgttagaaaaaacactaccgacgataagatagttgagaaatgcaacacagtgaccaaacagtcttgctccccaccaatgtggcattcctataacaacgcggacattccaaatgataattacctcgccctcgtcgtggacatggaccgttcgagtggctcggtgtggtttgtggaacgaacgactagagaatatctggata

SEQ ID NO: 2098 - DNA, 436 bp, Cicer arietinum
acaaaggaccatggaaacgaaagaaaatcaagaatcctaactacaaaggaaaatggaaaactccatggatagataatccagagtttgaagatgaccccgatctttatgtgcttaagcctatcaaatatgttggcatcgaagtttggcaggttaaaggcggttcagtatttgacaacattttgatttgtgatgatcctgattatgcaaaacaagttgttgatgaagtgtttgccaatagggagattgaaaaagaggcttttgaggaagcagagaaaataaaaaaagcccaagaggaggaggaggctcaaagagcaagagaggaaggtgagaggcgaagaaaagagaggggtcatgaccgacgacaccgggacagatatagagaccgatatagaaagcatcgccgtgattacatggatgattacgatcatgatgaact

SEQ ID NO: 2099 - DNA, 432 bp, Cicer arietinum
acttccatataatctatatatacccccggaaacggcaaatcgcacgctggctcggatgatacccaaaatgatgatggccgcagagcgatgaagaccgtccgccgcaattcctatccatatcaggtttaggagattgacaccaacgactgcatttactttgttaagcaatctttgaaatgggaatgtccatcaatgagacagcaaggtgtttgcgcttttgcaattcgacacgggaaaataaaggaggaacagcaattgaggaaatgtcgatgtgacgaatcagcccaccagactcatgacgcaaagcaaaggaagaaggggaaatgtaatggtgagtctgtgactccatatatagaatggtattgtctcagacattcgtccttccgcgggaatatgcacggacgggcggagataagacgactatgtcgcgtg

SEQ ID NO: 2100 - DNA, 344 bp, Cicer arietinum
  misc_feature (340)..(340): n is a, c, g, or t
acaccattgtcgatagcagaccctctaatcgacgactcataacattcgcatcatcacgtcagaacgtaaatgattattttcgccctcataaaaaaagccttgtccatagaccacttcacgccgaggcaccgattgtcgtttgtgttgacttcaagctttgatcacatttttttccctctgtgtatattcagcgtcaaaagccagaatgccgaatgcaactccaaatgccatgccaccatagaacctgtcccaagagaaactttttatatttattcctcaacaacgactgtggcaagacccttggggttcttgacgttcacagcctggacgtagctgtacnttgc

SEQ ID NO: 2101 - DNA, 433 bp, Cicer arietinum
acaaaggaccatggaaacgaaagaaaatcaagaatcctaactacaaaggaaaatggaaaactccatggatagataatccagagtttgaagatgaccccgatctttatgtgcttaagcctatcaaatatgttggcatcgaagtttggcaggttaaaggcggttcaatatttgacaacattttgatttgtgatgatcctgattatgcaaaacaagttgttgatgaagtgtttgccaatagggagattgaaaaagaggcttttgaggaagcagagaaaataaaaaaagcccaagaggaggaggaggctcaaagagcaagagaggaaggtgagaggcgaagaaaagagaggggtcatgaccgacgacaccgggacagatatagagaccgatatagaaagcatcgccgtgattacatggatgattacgatcatgatga

SEQ ID NO: 2102 - DNA, 433 bp, Cicer arietinum
acagcctgatcgggttgtgattgctaatggacctgcatttggatgtgtgttgatgaaggatttcctcaaggcgctttcgaagcgtctcaaacacaacaatgctgcatatgaaaactaccataggatttttatcccagatggtaaacctttgaagtctgcaccaaaagagcctttgagggttaatgttatgttccaacatatacaacagatgctgtccagtgaaacagctgtgattgctgagacaggtgactcatggtttaactgtcaaaagctgaaattgcctgagggatgtgggtatgagtttcaaatgcaatatggctcaattggatggtccgttggtgcaactcttggctatgcacaagcggtcccggagaagcgagtgattgcttgcattggtgatggaagctttcaggtaactgctcaggatgtatca

SEQ ID NO: 2103 - DNA, 432 bp, Cicer arietinum
ctttagggctaaatctcgtaagaatagtgccgaatctgaatctgatcagagtcatagtagtccgaaaccgaactcacaagagaagcctgttttggattggaacatgaggtatagaattgcacttggtgtggcaaggtctattgcatatctacatgaggagtgtttggaatgggttttgcattgcgatattaagccggagaatattctcttaggcgacgattgttgccctaagatatcggattttggattggcgaaactaaggaaaaaagaagacatgatgactataccaagaaggaggggaactcccggttatatggcacctgaatggataacggccgatccaataacttccaaagccgatgtctatagctttggcatggtgctattggagcttgtgagtggagtgaggaactttgagattcaaggttcttt

SEQ ID NO: 2104 - DNA, 437 bp, Cicer arietinum
actgcctatgtgaccttccaagatgcatattctcaagaaactgcatgtttactcagtggagcgactattttagatcagcgtgtatgcataacacgctgggggcaatatgaagatgaatttgatttttggaacaggcccaactatagtcacgagcaggagggagcttcaactacacaacatagcagtcaatttgtttcctctgcaggagaagcagttgctatgactcaagaagtcgtcaagaccatgctggcaaagggatacgttcttagtaaagatgcattagctaaggctaaagacttcgatgagtcgcatcgggtttcggccactgcaacagccaaggtttcagaattgagccagagaatcggcctcaccaataagatctctgccggttttgaagctgttaaatcggtcgatcagaagtataatgtgacggaaac

SEQ ID NO: 2105 - DNA, 436 bp, Cicer arietinum
acatggatggaattcggttgaatgatttagaagctctagaagcatatggagtgaataatcaaaagattgttgaggagattactcgtgcctatgcccaccaaatatatgttgatgggttttttaacggtgatcctcatccaggaaattttcttgtgagcaaggaatctccacatcgtcccattttactcgactttgggcttacgaagaaactttcaaacaccattaagcaagcacttgcaaagatgtttttggcatctgttgagggggaccatgtggcccttctgtccgcctttgcagaaatggggcttaagctgcgtctggacatgccagagcaggcaatggaggtcacagctatatttttccgtgcaacaacaccagcaaaagaatccatagaaacattaaaatctctagagaatcaaagaaacaaaaatatgaa

SEQ ID NO: 2106 - DNA, 435 bp, Cicer arietinum
gtcggcggcaactggaaatgcaatggcaccactgatgaggtgaagaagattgttactactttgaatgaagctaaggtccctggtgaagatgttgttgaagttgttgtgagccccccttatgtgttccttcccgttgtgaaaagtttactccgctctgacttccatgttgctgctcaaaactgttgggttcgcaaaggtggtgcttataccggagagattagtgctgaaatgcttgttaatttggatattccctgggttattcttggtcactctgaacgaaggcagcttctaaatgaatcaaatgagtttgtcggagataaagttgcgtatgcactttcactagggaggaaagttattgcttgcatcggtgagactcttgaggagcgtgaagctggaactacaatcgctgttgttgctgagcaaacaaaggcaatt

SEQ ID NO: 2107 - DNA, 434 bp, Cicer arietinum
gtcggcggcaactggaaatgcaatggcaccactgatgaggtgaagaagattgttactactttgaatgaagctaaggtccctggtgaagatgttgttgaagttgttgtgagccccccttatgtgttccttcccgttgtgaaaagtttactccgctctgacttccatgttgctgctcaaaactgttgggttcgcaaaggtggtgcttataccggagagattagtgctgaaatgcttgttaatttggatattccctgggttattcttggtcactctgaacgaaggcagcttctaaatgaatcaaatgagtttgtcggagataaagttgcgtatgcactttcactagggaggaaagttattgcttgcatcggtgagactcttgaggagcgtgaagctggaactacaatcgctgttgttgctgagcaaacaaaggcaat

SEQ ID NO: 2108 - DNA, 449 bp, Cicer arietinum; identical to SEQ ID NO: 2010

SEQ ID NO: 2109 - DNA, 435 bp, Cicer arietinum
ccggttcacctcgaatttcactcacgcgccaagcttctttcgccggcgacaagaaccaccacgttcaatcgccaaggctttcattgcatttccactccaactgcggcaaggacacaaatccagaaggaatcaacagagctttatcggaaagcgcggcgattaagtctccgagcgagaatttcggcttttgccggaatctaaatcgaatcggaactcactattctccgttacaggataccggattcttcggcggcggatgcgatcacggagatacgacagtcaccaccggcgggagcggcggtgaaaggattaaaatcggtgcgtattatgaagaaatgttgaagtcaaatccaacggatgcacttttgctgagaaattacggcaaatttcttcacgaggtagagaacaacacggcgagagcagaggaatattacg

SEQ ID NO: 2110 - DNA, 341 bp, Cicer arietinum
acaaggagcgaatgaccaagccaggcctacaatgctatttcatgctaagaaacttctcaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacgagtggggaagttgaagctgcgagagaactcgccgaaggtgcgctcggtgagccagt

SEQ ID NO: 2111 - DNA, 461 bp, Cicer arietinum
gattcattacctggtgccactccgccaatggttgctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccatctga

SEQ ID NO: 2112 - DNA, 458 bp, Cicer arietinum
gattcattacctggtgccactccgccaatggttgctcctaaatccaataggagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccatc

SEQ ID NO: 2113 - DNA, 351 bp, Cicer arietinum
acaaggagcgaatgaccaagccaggcctacaatgctatttcatgctaagaaacttctcaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacgagtggggaagttgaagctgcgagagaactcgccgaaggtgcgctcggtgagccagtacctgcccgg

SEQ ID NO: 2114 - DNA, 460 bp, Cicer arietinum; identical to SEQ ID NO: 1896

SEQ ID NO: 2115 - DNA, 460 bp, Cicer arietinum; identical to SEQ ID NO: 1896

SEQ ID NO: 2116 - DNA, 460 bp, Cicer arietinum; identical to SEQ ID NO: 1896

SEQ ID NO: 2117 - DNA, 113 bp, Cicer arietinum
actaggttgaattactattgcgacactgtcatcagtagggtaaaactaacctgtctcacgacggtctaatcccagctcacgttccctattggtgggtgaacaatccaacactt

SEQ ID NO: 2118 - DNA, 326 bp, Cicer arietinum
acggtcatcaacatcaaggttcctccagcagacagcgaggaccccgaagagcaggaagcgcggaagatcttcgaaagtttcaagcctgagatgcgcaaggccttggagacgggcaacttggacgaagtgaacaaggtgctgggtgaaatgaagattgacgaggctgaggaactcgtgggtctctttggcgaggccaacattttgagcctggaggaagaaatcattgacgctacaacagaggaagggaagcagcagctgaaagagattgaagccgcggcttctgtggacaagaaagaagaatacggtgatcctgagtaagcaagagt

SEQ ID NO: 2119 - DNA, 415 bp, Cicer arietinum
acagagcttacctggagaccgtggaatgaggcgactacctcgtccacagagcagcgttctggccgctttggggttttctcctgcaagggttttccccaaggatgcacggtcctaggttgcagctactggcgatcttaggggatcatggacttcctgcctcagggtatggaaagctacttgatctatccgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagagctggctacgagtagagaggtgcctcttggggggatgagt

SEQ ID NO: 2120 - DNA, 435 bp, Cicer arietinum
acactagatggacaaggtgaactgtggtggcaaaagtttcaccatgggcagcttagttataccagaccttacctaattgaaatcatgtattcagataatattcagatatccaatctcactttggttaattctccctcctggaatgtccatcctgtttacagtagcaacgttattgttcaaggaatcacaattcttgcgcccgtgaactcgccaaatacagatggaatcaaccctgactcttgcacggacacacgaattgaggactgttatatagtgtcaggggacgattgtgtggctgtgaagagtggttgggatgagtatggtatagcttatggaatgccaacgaagcaactggtaatcagaaggctcacttgtatttctccaacgagtgccgtgattgctttagggagtgaaatgtctggtggaatcgaagat

SEQ ID NO: 2121 - DNA, 407 bp, Cicer arietinum
acagagcttacctggagaccgtggaacgaggcgactacctcgtccacagagcggcgttctagccgccttgggtttttccctgcgaggggtttccccaaggatgtatggtcctaggttgcagctactggtgatcttaggggatcatggacttcctgcctcagggtatggaaagctactcgatctatctgtgcaagagaattctaggctggagaggaatagatcccgctgacgggatgacctcttgaaagtaaatacgcctttgtgccgatgatatgctggatgaactagatgggagacgctgctggagggaagctctgcgaggatcaactgtatcgatgtccaatgggacgtgcttcaccgacaactactgtagggcgagctacgagtagagaggtgcctcttggggg

SEQ ID NO: 2122 - DNA, 344 bp, Cicer arietinum
actggctcaccgagcgcaccttcggcgagttctctcgcagcttcaacttccccactcgtgtcgaccaggacaacgtctctgccaagtttaaggacggtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgtaggcctggcttggtcattcgctccttgtacc

SEQ ID NO: 2123 - DNA, 341 bp, Cicer arietinum; identical to SEQ ID NO: 537

SEQ ID NO: 2124 - DNA, 423 bp, Cicer arietinum
gagtaaattacgttttcaactcaacaagaacaaatcatggcattgatggcagcaacagcaagctcagcaactgttgttaaacaatctcctttccttggacaaaggaaaggtgccagtgccaatcctcttagagatgttgtctccatgggaacttctaaattcaccatgggaaatgaattgtggtatggaccagacagagtgaaatatttaggacccttttcagctcagacaccttcatacttaactggagaattcccaggagattatggatgggacactgctggtttatctgctgatcctgaagcatttgccaagaacagggctcttgaggtgatccatggaagatgggcaatgctaggagcactaggttgcataacaccagaagtgttagaaaaatgggtgagagttgacttcaaagaacca

SEQ ID NO: 2125 - DNA, 193 bp, Cicer arietinum; identical to SEQ ID NO: 2005

SEQ ID NO: 2126 - DNA, 435 bp, Cicer arietinum
actgttgaacaactttgtttgtgaaaaacggcaccgtcatgattcttctcattttccgccaatgttcaccgtaaacggtgaaaaccatatcctgtccttttccggtgaagatatcgaaaacaacgttccttgttcgggaaccgaattcgacaccttgagtgtggagaacctcttttgcgagttcaggtgatgaaactacgacgaggtttctttgacccatacgaaggaggaagatatcgccgaaccgttttgctaagtcggtgagattacggtggttgagatcatcgccgacttgaagccagttaccgaagacggggactgggattggacctggtggaagtttgaatcttttgccacggagttttgaaattgtgatggcgatagtggcggcgatgaaaagggctaaaagggtcttttccaataggagaagatcca

SEQ ID NO: 2127 - DNA, 435 bp, Cicer arietinum
actattactactcacggttgcacccatttgagcagctttttgtaacaatgcagtggctgacatgtgaggcgaagttgcagcagataaatgaagaccattttcttcaaagatgttgttgagagagtttgaacttagttgaagtgaaggagatgaagaaaggcttcgactgaatatcgatcctcctccagtaatgttgttgttgttcatgaatggttttgatatgaggtcatgatgaggtagtgatgatgatgatagtggatgtttgtgatcatcatctgagattgaacggttgatcaattgtgatgatgaagttacattaccaatttggtgtgagggaaggattggttgttggcattgcaagcttgatgatattaattgtattgatcctccttcgttggctttgttgttttcttcagctaatgcgtcacaaaatgc

SEQ ID NO: 2128 - DNA, 460 bp, Cicer arietinum; identical to SEQ ID NO: 1896

SEQ ID NO: 2129 - DNA, 408 bp, Cicer arietinum
acatgatggcgttgacaccagtaagctgaccaagaagaatcataatgttggcgtagacaagagcgcgacgagcacggggctcagtaaagaagtccatccaagggaagcgatggttcttggcaccctcagcgacagcattctcctctgaaatgacagaggcactcatgacgtagaactcctcacgagactcacggtcctcaataccgcgaatgcgcttccaaaccttgtatgcatcgaggcgacgcttctggtggataaggaaacggggagactcggggaggaagagcatgccgaagaacatgatggttgagaagaggagggatgaacccagaatgtagcgccagttgccggggacgttaaggaagattgcgccgacagcgtagccaaggacttcaccgagggcgatgt

SEQ ID NO: 2130 - DNA, 302 bp, Cicer arietinum
acattgctgagcatctctggtcgtgcttttcagtaagagatcatgaactgatcggagatctactgcagccttgtggtcgatgtgattacaatgttgaagttgatggtgagtgtgctcgccttggaatccttgttcagagcctcccacatgtccttcaatgaattctgcattttcttctttggcagaaatctgcttctgagatgcagaggtactattattttgcacagtttggagttcagaagaaacaaaagagccaatccccctggcagactcaggtttcttgtcaaaattttcaggtttgg

SEQ ID NO: 2131 - DNA, 464 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccatctgaaga

SEQ ID NO: 2132 - DNA, 301 bp, Cicer arietinum
acgaccacatcatgggttacatcaaggctggtaaggacgagggtgctaccattgagaccggtggtgagcgcctcggcaacaagggttacttcatcaagcccactatcttctctaatgtccgccccgacatgaagatcatgcaggaggagatctttggccctgtctgcgccatttccaagttcaaggacgagaaggaggtcatcgaccttgcccacgacaccgcctacggtcttgctgccgccgtccacaccaagaacctcaacacagctctccgagtttccaacgcattgaaggctggtac

SEQ ID NO: 2133 - DNA, 299 bp, Cicer arietinum
acgaccacatcatgggttacatcaaggctggtaaggacgagggtgctaccattgagaccggtggtgagcgcctcggcaacaagggttacttcatcaagcccactatcttctctaatgtccgccccgacatgaagatcatgcaggaggagatctttggccctgtctgcgccatttccaagttcaaggacgagaaggaggtcatcgaccttgcccacgacaccgcctacggtcttgctgccgccgtccacaccaagaacctcaacacagctctccgagtttccaacgcattgaaggctggt

SEQ ID NO: 2134 - DNA, 431 bp, Cicer arietinum
actgttgaacaactttgtttgtgaaaaacggcaccgtcatgattcttctcattttccgccaatgttcaccgtaaacggtgaaaaccatatcctgtccttttccggtgaagatatcgaaaacaacgttccttgttcgggaaccgaattcgacaccttgagtgtggagaacctcttttgcgagttcaggtgatgaaactacgacgaggtttctttgacccatacgaaggaggaagatatcgccgaaccgttttgctaagtcggtgagattacggtggttgagatcatcgccgacttgaagccagttaccgaagacggggactgggattggacctggtggaagtttgaatcttttgccacggagttttgaaattgtgatggcgatagtggcggcgatgaaaagggctaaaagggtcttttccaataggagaaga

SEQ ID NO: 2135 - DNA, 460 bp, Cicer arietinum; identical to SEQ ID NO: 1896

SEQ ID NO: 2136 - DNA, 461 bp, Cicer arietinum; identical to SEQ ID NO: 2095

SEQ ID NO: 2137 - DNA, 435 bp, Cicer arietinum
gtgaaaactcaaaactgttatttagaagaaagaaaattgtaatttatatttttaataagatctggaaaaaaacatagaaagagaaacaacatgtgaattacacaaatgagatttgcaaacagaggaaacagaagagattgattgatgaagaaagagaaagagaaaggaattgctgtgtcaagccccatcagtggcgaagaagacagtgatgataaacaacaacacccttccttttcctccgccagattctcttcccgtaacgcttcttccaaatacgatttcgtcaaggtaaaggtgtggttgggtgataatgcggatcattactatgttctttccagatttttgctcagtagaatgctaactgtaaccaagattccaaaccatgtagctatcaaaattgctctcgaactgaagaagctgctcatagacaatagc

SEQ ID NO: 2138 - DNA, 461 bp, Cicer arietinum; identical to SEQ ID NO: 2095

SEQ ID NO: 2139 - DNA, 461 bp, Cicer arietinum; identical to SEQ ID NO: 2095

SEQ ID NO: 2140 - DNA, 374 bp, Cicer arietinum
acaaacattgcattttatttattcaagtcttgtagtaaatatcacaatgtccaatatagtcaaacaaggtaaaagcaaatacaactcaatacattgtgcttcaatgacatatcacaacttaataatattctagttgttatcccaccaaaattgtttttgaagattgacaataatattattgacaatcttcaaaagctttggtgagaacttcagaagaaatttttggattagaaccaaacacagcattagcaatagtgacaacacctggattttggctactaagtccagcaacagcaattgcattttcatatcccacattcaattggaagtgaatgagaccaattgggaacacaaacacatctcccttgttgagt

SEQ ID NO: 2141 - DNA, 299 bp, Cicer arietinum
tgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 2142 - DNA, 437 bp, Cicer arietinum
gttgttgcagtcgaaccagttgttgctgctgcggctgctattcctggtgagccaatggatatcatgactgctgttcagcttgtgctgagaaagtcccgggcttatggtggccttgcacgaggtcttcatgaaagcgcaaaggtgattgagaagcacgctgctcaactctgtgttctagctgaagactgtgaccaacctgattatgtcaagttggtgaaagccctttgcgcagagcacaatgttagcttattgactgttccaaatgcaaagacccttggagagtgggctggtttgtgtaagattgattcagagggtaaagctaggaaggtaactggctgctcctgcgtggttgtcaaggattttggtgaagagcacgaagcatacaatgttgttttgcagcacgtgaaatctaactgagttgcaatatgcatcagttt

SEQ ID NO: 2143 - DNA, 436 bp, Cicer arietinum
actaaacaacatccttaaagacaaaggtccactcggtggagaggtagttgtccagactgcaccgtgatcccgatccagtaacttgcagacaaagttctgagtctcgcagagctgcacagcagttatgtctctctttccttgctgataccataggacaaaagccaagtaatgagggttgctgctgctttcatcaatcttaatagtaatgtttttatttgggtagctacatgaaacactggagatatcgacgagaggccttggttaagtttacatatataacaaaaacaggaaaaattgatgcatggaaaaaaggacaattccatgactcaaattgtggctttttaatcatacgataataaatgttgcatcattcaagactctccttcacagcaaaagttgatgcatgcatgaaactgtgtggaagaatatcttaccg

SEQ ID NO: 2144 - DNA, 281 bp, Cicer arietinum
acgaatatcatataaggggctaccaggatcattcagcgaggaagctgcagttaaagcttaccctaattgtgaaacagtctcatgcagtgattttgaagaagcttttaaggctgttgagttgtggctgactgacaaagttgtccttcctattgaaaatacatctggtggaagcattcatcggaactatgatttacttcttcgccataggcttcacattgttggtgaggtgcagttggctactaacttctcccttctagctctgcctggtgtccgaaaagagt

SEQ ID NO: 2145 - DNA, 435 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgctttatgaggattcaagaaagtatcagctgaaaaacccggagtc

SEQ ID NO: 2146 - DNA, 438 bp, Cicer arietinum
cgaacggaagcagtccgaaatccagcaaatatgaagatcatcgcggcgtatttgctggccgttttgggcggtaaagcagcccctacctctgatgatatcaaacacatcctcacttcagttggaattgaggccgaggatgagaagattgagttgctcttgggtgaagtcaagggaaaagattttgccgggctaattgctagtggaagagaaaagttgtcttcagtgccatctggtggaggtgctgttgctgtttctgccgcacctggtggaggtgctgcagcagctgctgcacctgctgctgaagccaaggaagaaaagaaggttgaagaaaaagaagaatctgatgatgacatgggcttcagtttgttcgactaaaaggtctgatctttttgccggaaaatttgcaattcctgttagagttgtagttgaaacacaaca

SEQ ID NO: 2147 - DNA, 415 bp, Cicer arietinum
actccaaatatcttagcaacaacccactaggcagagtcctcacaattactatcacccttacccttggctggcccctttacttggctctcaatgtttcaggcaggccttatgataggtttgcttgccactttaacccatatggtcccatttactcagatcgtgagcgtctacaaatatatgtatcagatgcaggaatccttgcagtatgctatgggctttatcttctcgccatggctaaaggacttgcctgggttgtgtgtgtttatggagttccactgctagtagtcaatggattcttggtgctgattacatttttgcagcatactcaccctgcgttgccacattacgattcctctgagtgggactggttgagaggagctttagcaacagtggacagggattatggtatcctgaa

SEQ ID NO: 2148 - DNA, 415 bp, Cicer arietinum; identical to SEQ ID NO: 2147

SEQ ID NO: 2149 - DNA, 436 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccggagtct

SEQ ID NO: 2150 - DNA, 408 bp, Cicer arietinum
acaatgctgagaaaaggggtaaacgccaagtaatgattaggccatcctccaaagtcattatcaagttccttatcgttatgcaaaagcacggatacattggcgagttcgagtatgttgatgatcatagatctggaaagatcgttgttgaattgaatggtaggttgaataaatgtggtgttattagtccacgttttgatgttggtgttaaggagattgaaggttggactgctaggcttctcccttcaagacagtttgggtatattgtcttgactacctcagctggcattatggatcatgaagaggccaggagaaagaatgttggtggtaaggtccttggattcttctactaggctagttttttattaaggatcttttctatttcagtttttgatttaccgaatgtaatgg

SEQ ID NO: 2151 - DNA, 407 bp, Cicer arietinum
acatgatggcgttgacaccagtaagctgaccaagaagaatcataatgttggcgtagacaagagcgcgacgagcacggggctcagtaaagaagtccatccaagggaagcgatggttcttggcaccctcagcgacagcattctcctctgaaatgacagaggcactcatgacgtagaactcctcacgagactcacggtcctcaataccgcgaatgcgcttccaaaccttgtatgcatcgaggcgacgcttctggtggataaggaaacggggagactcggggaggaagagcatgccgaagaacatgatggttgagaagaggagggatgaacccagaatgtagcgccagttgccggggacgttaaggaagattgcgccgacagcgtagccaaggacttcaccgagggcgatg

SEQ ID NO: 2152 - DNA, 436 bp, Cicer arietinum
ctttagggctaaatctcgtaagaatagtgccgaatctgaatctgatcagagtcatagtagtccgaaaccgaactcacaagagaagcctgttttggattggaacatgaggtatagaattgcacttggtgtggcaaggtctattgcatatctacatgaggagtgtttggaatgggttttgcattgcgatattaagccggagaatattctcttaggcgacgattgttgccctaagatatcggattttggattggcgaaactaaggaaaaaagaagacatgatgactataccaagaaggaggggaactcccggttatatggcacctgaatggataacggccgatccaataacttccaaagccgatgtctatagctttggcatggtgctattggagcttgtgagtggagtgaggaactttgagattcaaggttctttggtg

SEQ ID NO: 2153 - DNA, 302 bp, Cicer arietinum; identical to SEQ ID NO: 2130

SEQ ID NO: 2154 - DNA, 302 bp, Cicer arietinum; identical to SEQ ID NO: 2130

SEQ ID NO: 2155 - DNA, 439 bp, Cicer arietinum; identical to SEQ ID NO: 1808

SEQ ID NO: 2156 - DNA, 250 bp, Cicer arietinum
gcaagccgctctcgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtat

SEQ ID NO: 2157 - DNA, 414 bp, Cicer arietinum
acatcttttatcatgtgccactttacaggaaagctcccactccatttatcttgctgccaaaaatccatatcctgattaaaatcaactgaaccaatcatctctgcaactccgcagaattgaccactggcattaacagaaaaaaataggaagataggacagactccgggtttttcagctgatactttctttgaatcctcataagcattttccagcttcttgtttccatgaggtgtagaagaccacacattgtatttgatgcttttgtgcacatcatcctcgctgtatgattttataacaaaaaactttgcattatcatagtcaagagggaaatcctctttgttgtattgatcggtataaatgatgatgttcccttcctcgttaccacctcctaccttggttgtataagctttcacg

SEQ ID NO: 2158 - DNA, 115 bp, Cicer arietinum
gggcggttcgaagatttttcattccgttgccatgtgtgctaaagcgattccgtcccaatgcttaaccgagcatgaatagcgtcctaaaccaggcttttgtttttcgccttgcaac

SEQ ID NO: 2159 - DNA, 336 bp, Cicer arietinum
actcaacaagggagatgtgtttgtgttcccaattggtctcattcacttccaattgaatgtgggatatgaaaatgcaattgctgttgctggacttagtagccaaaatccaggtgttgtcactattgctaatgctgtgtttggttctaatccaaaaatttcttctgaagttctcaccaaagcttttgaagattgtcaataatattattgtcaatcttcaaaaacaattttggtgggataacaactagaatattattaagttgtgatatgtcattgaagcacaatgtattgagttgtatttgcttttaccttgtttgactatattggacattgtgatat

SEQ ID NO: 2160 - DNA, 433 bp, Cicer arietinum
ctttagggctaaatctcgtaagaatagtgccgaatctgaatctgatcagagtcatagtagtccgaaaccgaactcacaagagaagcctgttttggattggaacatgaggtatagaattgcacttggtgtggcaaggtctattgcatatctacatgaggagtgtttggaatgggttttgcattgcgatattaagccggagaatattctcttaggcgacgattgttgccctaagatatcggattttggattggcgaaactaaggaaaaaagaagacatgatgactataccaagaaggaggggaactcccggttatatggcacctgaatggataacggccgatccaataacttccaaagccgatgtctatagctttggcatggtgctattggagcttgtgagtggagtgaggaactttgagattcaaggttctttg

SEQ ID NO: 2161 - DNA, 394 bp, Cicer arietinum
accaaaggcgatatatattatacaatgaattaaaatagaaattaacgataggtcaagaaaatcatattatataatatacttgacactactaaaatgtctcaattgaaaaggataatccgacagaacctaatactagtaataactaataattatactaatgttatgtttaatactactactcttaccggagttgcaaattttcacggcagaaagatcatagcttttagtcgaacaaactgaagcccatgtcatcatcagattcttctttttcttcaaccttcttttcttccttggcttcagcagcaggtgcagcagctgctgcagcacctccaccaggtgcggcagaaacagcaacagcacctccaccagatggcactgaagacaacttttctct

SEQ ID NO: 2162 - DNA, 422 bp, Cicer arietinum
cgaacggaagcagtccgaaatccagcaaatatgaagatcatcgcggcgtatttgctggccgttttgggcggtaaagcagcccctacctctgatgatatcaaacacatcctcacttcagttggaattgaggccgaggatgagaagattgagttgctcttgggtgaagtcaagggaaaagattttgccgggctaattgctagtggaagagaaaagttgtcttcagtgccatctggtggaggtgctgttgctgtttctgccgcacctggtggaggtgctgcagcagctgctgcacctgctgctgaagccaaggaagaaaagaaggttgaagaaaaagaagaatctgatgatgacatgggcttcagtttgttcgactaaaaggtctgatctttttgccggaaaatttgcaattcctgttagagttg

SEQ ID NO: 2163 - DNA, 438 bp, Cicer arietinum
gttttcaactcaacaagaacaaatcatggcattgatggcagcaacagcaagctcagcaactgttgttaaacaatctcctttccttggacaaaggaaaggtgccagtgccaatcctcttagagatgttgtctccatgggaacttctaaattcaccatgggaaatgaattgtggtatggaccagacagagtgaaatatttaggacccttttcagctcagacaccttcatacttaactggagaattcccaggagattatggatgggacactgctggtttatctgctgatcctgaagcatttgccaagaacagggctcttgaggtgatccatggaagatgggcaatgctaggagcactaggttgcataacaccagaagtgttagaaaaatgggtgagagttgacttcaaagaaccagtttggttcaaagcaggatcccagat

SEQ ID NO: 2164 - DNA, 436 bp, Cicer arietinum
cgaacggaagcagtccgaaatccagcaaatatgaagatcatcgcggcgtatttgctggccgttttgggcggtaaagcagcccctacctctgatgatatcaaacacatcctcacttcagttggaattgaggccgaggatgagaagattgagttgctcttgggtgaagtcaagggaaaagattttgccgggctaattgctagtggaagagaaaagttgtcttcagtgccatctggtggaggtgctgttgctgtttctgccgcacctggtggaggtgctgcagcagctgctgcacctgctgctgaagccaaggaagaaaagaaggttgaagaaaaagaagaatctgatgatgacatgggcttcagtttgttcgactaaaaggtctgatctttttgccggaaaatttgcaattcctgttagagttgtagttgaaacacaa

SEQ ID NO: 2165 - DNA, 438 bp, Cicer arietinum; identical to SEQ ID NO: 2163

SEQ ID NO: 2166 - DNA, 436 bp, Cicer arietinum
gttttcaactcaacaagaacaaatcatggcattgatggcagcaacagcaagctcagcaactgttgttaaacaatctcctttccttggacaaaggaaaggtgccagtgccaatcctcttagagatgttgtctccatgggaacttctaaattcaccatgggaaatgaattgtggtatggaccagacagagtgaaatatttaggacccttttcagctcagacaccttcatacttaactggagaattcccaggagattatggatgggacactgctggtttatctgctgatcctgaagcatttgccaagaacagggctcttgaggtgatccatggaagatgggcaatgctaggagcactaggttgcataacaccagaagtgttagaaaaatgggtgagagttgacttcaaagaaccagtttggttcaaagcaggatcccag

SEQ ID NO: 2167 - DNA, 115 bp, Cicer arietinum
gggcgtttcgaagatttttcattccgttgccatgtgtgctaaagcgattccgtcccaatgcttaaccgagcatgaatagcgtcctaaaccaggcttttgtttttcgccttgcaac

SEQ ID NO: 2168 - DNA, 431 bp, Cicer arietinum
gaataatataatgacaacacttggtggagttcgcgatgtgccaggaaaccagaacagccttgagatcgatagtctcgcccgctatgctgttgaggaacacaacaaaaaacagaattctcttctggaatttgaaagggtgataagtgcaaaacagcaagtggtttctggaaccttgcatcacatcactcttgaggcaaaagatggggtgaataaaaggtttatgaagtcaaggtttgggaaaagtcttggatgaacttcaaggaggtgcaggagttcaagcttgttgaagatgcatctgcggagtcaagtgcttaactaggttaataataattaataaaagtcatgttcctagcttggctcgaaggtgagacgcctaaggataatttaaaaccaggatatgtatgaaatagatccaactcttgctttcagga

SEQ ID NO: 2169 - DNA, 408 bp, Cicer arietinum
acgttccttcttgttgcgttgctcttgaaggagtcctcttaagaatgtgtccgttttgttagcaatattcttaacccttttctctaagttttcaaaatcaaaaaatttaagtaatggaaggaaatcagttttgttgtttgcaccagacaattgcaacaattctgttaccatatccctaaattgacttgcttcttgaagatcactcatgtcacaatcttctccgtagtatctctttccagagatcattcgcatgatgttgttgaaggtcatatcgtagaatctgaaactaagttctacttcagcaaaggaagtggatgaatcctcggccaacttcgtgattaatcgttgagtctcatcccttcggactccagagaagttgttgatgcggtggttcgaaagaacatcgag

SEQ ID NO: 2170 - DNA, 434 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccggagt

SEQ ID NO: 2171 - DNA, 420 bp, Cicer arietinum
  misc_feature (417)..(417): n is a, c, g, or t
acaatgctgagaaaaggggtaaacgccaagtaatgattaggccatcctccaaagtcattatcaagttccttatcgttatgcaaaagcacggatacattggcgagttcgagtatgttgatgatcatagatctggaaagatcgttgttgaattgaatggtaggttgaataaatgtggtgttattagtccacgttttgatgttggtgttaaggagattgaaggttggactgctaggcttctcccttcaagacagtttgggtatattgtcttgactacctcagctggcattatggatcatgaagaggccaggagaaagaatgttggtggtaaggtccttggattcttctactaggctagttttttattaaggatcttttctatttcagtttttgatttaccgaatgtaatggaggatgtcnttg

SEQ ID NO: 2172 - DNA, 379 bp, Cicer arietinum
gcttcttctagaactggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcgtcaaatacaatgtgtggtcttctacacctcgtggaaacaaga

SEQ ID NO: 2173 - DNA, 315 bp, Cicer arietinum
actcattacctccaagaggcacctctctactcgtagccagctctacagtagttgtcggtgaagcacgtcccattggacatcaatacagctgatctcagcagagcttccctccagcaacgcttctatctagttcatccagcatatcatcggcacaaaggcgctttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatc

SEQ ID NO: 2174 - DNA, 436 bp, Cicer arietinum; identical to SEQ ID NO: 2149

SEQ ID NO: 2175 - DNA, 419 bp, Cicer arietinum
gcttcttctagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagc

SEQ ID NO: 2176 - DNA, 434 bp, Cicer arietinum; identical to SEQ ID NO: 2170

SEQ ID NO: 2177 - DNA, 430 bp, Cicer arietinum
gaataatataatgacaacacttggtggagttcgcgatgtgccaggaaaccagaacagccttgagatcgatagtctcgcccgctatgctgttgaggaacacaacaaaaaacagaattctcttctggaatttgaaagggtgataagtgcaaaacagcaagtggtttctggaaccttgcatcacatcactcttgaggcaaaagatggggtgaataaaaggtttatgaagtcaaggtttgggaaaagtcttggatgaacttcaaggaggtgcaggagttcaagcttgttgaagatgcatctgcggagtcaagtgcttaactaggttaataataattaataaaagtcatgttcctagcttggctcgaaggtgagacgcctaaggataatttaaaaccaggatatgtatgaaatagatccaactcttgctttcagg

SEQ ID NO: 2178 - DNA, 437 bp, Cicer arietinum
gtcggtggccactggaaatgcaatggcaccactgatgaggtgaagaagattgttactactttgaatgaagctaaggtccctggtgaagatgttgttgaagttgttgtgagccccccttatgtgttccttcccgttgtgaaaagtttactccgctctgacttccatgttgctgctcaaaactgttgggttcgcaaaggtggtgcttataccggagagattagtgctgaaatgcttgttaatttggatattccctgggttattcttggtcactctgaacgaaggtagcttctaaatgaatcaaatgagtttgtcggagataaagttgcgtatgcactttcactagggaggaaagttattgcttgcatcggtgagactcttgaggagcgtgaagctggaactacaatcgctgttgttgctgagcaaacaaaggcaattgc

SEQ ID NO: 2179 - DNA, 410 bp, Cicer arietinum
acatcttttatcatgtgccactttacaggaaagctcccactccatttatcttgctgccaaaaatccatatcctgattaaaatcaactgaaccaatcatctctgcaactccgcagaattgaccactggcattaacagaaaaaaataggaagataggacagactccgggtttttcagctgatactttctttgaatcctcataagcattttccagcttcttgtttccatgaggtgtagaagaccacacattgtatttgatgcttttgtgcacatcatcctcgctgtatgattttataacaaaaaactttgcattatcatagtcaagagggaaatcctctttgttgtattgatcggtataaatgatgatgttcccttcctcgttaccacctcctaccttggttgtataagcttt

SEQ ID NO: 2180 - DNA, 434 bp, Cicer arietinum
catcagacaaaatggcccccgccgctggagcaaagaagcaaaagaagaagtggtccaagggaaaggtcaaggacaaggcccaacacgccgtcgttctcgacaagaccacctctgagaagctctacaaggatgtgcagtcttaccgtctcgtcaccattgccaccctcgtcgaccgaatgaagatcaacggctctctggcacgacagtgccttgccgacctcgaggagaagggcatcatcaagcctgtggtcactcacagcaagatgaagatctacacccgtgccgtcggtggttctgactaaatgcaatgaacgataaacttgagtctcacgattgtgcgtctgggcggcctggacgatagacaggccgcatggtcggagggtgttgcaaggcgaaaaacaaaagcctggtttaggacgctattcatgctcggt

SEQ ID NO: 2181 - DNA, 434 bp, Cicer arietinum; identical to SEQ ID NO: 2180

SEQ ID NO: 2182 - DNA, 439 bp, Cicer arietinum
gttgttgcagtcgaaccagttgttgctgctgcggctgctattcctggtgagccaatggatatcatgactgctgttcagcttgtgctgagaaagtcccgggcttatggtggccttgcacgaggtcttcatgaaagcgcaaaggtgattgagaagcacgctgctcaactctgtgttctagctgaagactgtgaccaacctgattatgtcaagttggtgaaagccctttgcgcagagcacaatgttagcttattgactgttccaaatgcaaagacccttggagagtgggctggtttgtgtaagattgattcagagggtaaagctaggaaggtaactggctgctcctgcgtggttgtcaaggattttggtgaagagcacgaagcatacaatgttgttttgcagcacgtgaaatctaactgagttgcaatatgcatcagtttga

SEQ ID NO: 2183 - DNA, 299 bp, Cicer arietinum; identical to SEQ ID NO: 2141

SEQ ID NO: 2184 - DNA, 149 bp, Cicer arietinum
actgaatttgcgatcaaagcacctgcttccaagttttacaatctctttgcaacacaacttcatgaagtgcaaaaccattgtgaaagagttcatcacaccaagctacaacaaggggaagactggcatcactctgattcggttaaacactg

SEQ ID NO: 2185 - DNA, 432 bp, Cicer arietinum; identical to SEQ ID NO: 1863

SEQ ID NO: 2186 - DNA, 327 bp, Cicer arietinum
actgctcgctgtacggctctaacggagtgctcagcaacaacctcgggtgcaacctttggtgaatcggatcctggtgtcaccatgttaggcttcaagagagttccttcaaggaggacatgttggtcactcaaggacttgtaggttgctgcaaggacacgctcagtgatggcggcacacttgtgaatgtcgtgagatccgtcaacaaggatctcaggctcgacaataagaacaagcccgttctcttggcatatgacggcgtatcgggccaaaccatatgcattctcatggatagaatgctcagatggttcgttggggccgattttgagg

SEQ ID NO: 2187 - DNA, 430 bp, Cicer arietinum
catcagacaaaatggcccccgccgctggagcaaagaagcaaaagaagaagtggtccaagggaaaggtcaaggacaaggcccaacacgccgtcgttctcgacaagaccacctctgagaagctctacaaggatgtgcagtcttaccgtctcgtcaccattgccaccctcgtcgaccgaatgaagatcaacggctctctggcacgacagtgccttgccgacctcgaggagaagggcatcatcaagcctgtggtcactcacagcaagatgaagatctacacccgtgccgtcggtggttctgactaaatgcaatgaacgataaacttgagtctcacgattgtgcgtctgggcggcctggacgatagacaggccgcatggtcggagggtgttgcaaggcgaaaaacaaaagcctggtttaggacgctattcatgct

SEQ ID NO: 2188 - DNA, 390 bp, Cicer arietinum
gaatattatcatgacaacacttggtggagttcgcgatgtgccaggaaaccagaacagccttgagatcgatagtctcgcccgctatgctgttgaggaacacaacaaaaaacagaattctcttctggaatttgaaagggtgataagtgcaaaacagcaagtggtttctggaaccttgcatcacatcactcttgaggcaaaagatggggtgaataaaaggtttatgaagtcaaggtttgggaaaagtcttggatgaacttcaaggaggtgcaggagttcaagcttgttgaagatgcatctgcggagtcaagtgcttaactaggttaataataattaataaaagtcatgttcctagcttggctcgaaggtgagacgcctaaggataatttaaaa

SEQ ID NO: 2189 - DNA, 439 bp, Cicer arietinum; identical to SEQ ID NO: 1808

SEQ ID NO: 2190 - DNA, 436 bp, Cicer arietinum
gcttcttcgagaactggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccggagtct

SEQ ID NO: 2191 - DNA, 326 bp, Cicer arietinum; identical to SEQ ID NO: 2118

SEQ ID NO: 2192 - DNA, 433 bp, Cicer arietinum
tacactcttcactcgcgtagcagcggcatcaactagtctcaggaggagaaaaatgtctcacaggaagttcgagcacccaaggcacggatcattgggatttctcccaaggaagcgtgctgctcgtcacagaggaaaagtgaaggcattccctaaggatgacccaacaaaggcacccaagcttactgccttcttgggttacaaggctggtatgacacacattgtcagagaagtcgagaaaccaggatccaagcttcacaagaaggagacctgtgagccagttacaatcattgagacccctccaatgattgttgttggtgttgttggttatgtgaaaactccccgcggtcttcggactttgaatactgtttggactcagcatttgagtgaagaaatcaagcgtaggttctacaagaattggtgcaagtccaagaag

SEQ ID NO: 2193 - DNA, 135 bp, Cicer arietinum
gattagtgcttaactaggttaataataattaataaaagtcatgttcctagcttggctcgaaggtgagacgcctaaggataatttaaaaccaggatatgtatgaaatagatccaactcttgctttcaggatttagt

SEQ ID NO: 2194 - DNA, 431 bp, Cicer arietinum
actgttatagacttgctctctgaagcgcaaaccaccgagaagcatgctcatacctaagataagcaataaattcgctaagattgaacctaatagagatgcctggacaatgcgaatttcgtctttcgttaaggcatagatgaagataatgagttccacggcgttgccaaaagtgacattcagcaacgcgccgagagcatcacccatctttcgggcaacagactcggtagcataagctaagagaccagcaagaggaataatggcaactgcattgagaccaaaaacaatacctccattgatgccatctacctgggatactgcaataccaacagggacgaagatgaggaggatgttgagccagctgtggaagatagaaattttgacacttcgcttaacttcagcgaagaatctgttcattttgctggttggattgg

SEQ ID NO: 2195 - DNA, 430 bp, Cicer arietinum
actgttatagacttgctctctgaagcgcaaaccaccgagaagcatgctcatacctaagataagcaataaattcgctaagattgaacctaatagagatgcctggacaatgcgaatttcgtctttcgttaaggcatagatgaagataatgagttccacggcgttgccaaaagtgacattcagcaacgcgccgagagcatcacccatctttcgggcaacagactcggtagcataagctaagagaccagcaagaggaataatggcaactgcattgagaccaaaaacaatacctccattgatgccatctacctgggatactgcaataccaacagggacgaagatgaggaggatgttgagccagctgtggaagatagaaattttgacacttcgcttaacttcagcgaagaatctgttcattttgctggttggattg

SEQ ID NO: 2196 - DNA, 392 bp, Cicer arietinum
gcttcttccagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgc

SEQ ID NO: 2197 - DNA, 398 bp, Cicer arietinum
gaataatataatgacaacacttggtggagttcgcgatgtgccaggaaaccagaacagccttgagatcgatagtctcgcccgctatgctgttgaggaacacaacaaaaaacagaattctcttctggaatttgaaagggtgataagtgcaaaacagcaagtggtttctggaaccttgcatcacatcactcttgaggcaaaagatggggtgaataaaaggtttatgaagtcaaggtttgggaaaagtcttggatgaacttcaaggaggtgcaggagttcaagcttgttgaagatgcatctgcggagtcaagtgcttaactaggttaataataattaataaaagtcatgttcctagcttggctcgaaggtgagacgcctaaggataatttaaaaccaggata

SEQ ID NO: 2198 - DNA, 350 bp, Cicer arietinum
gtcggttgccactggaaatgcaatggcaccactgatgaggtgaagaagattgttactactttgaatgaagctaaggtccctggtgaagatgttgttgaagttgttgtgagccccccttatgtgttccttcccgttgtgaaaagtttactccgctctgacttccatgttgctgctcaaaactgttgggttcgcaaaggtggtgcttataccggagagattagtgctgaaatgcttgttaatttggatattccctgggttattcttggtcactctgaacgaaggtagcttctaaatgaatcaaatgagtttgtcggagataaagttgcgtatgcactttcactagggaggaa

SEQ ID NO: 2199 - DNA, 417 bp, Cicer arietinum
accaatggcccaaactggctcataggccaaaacaacattatcccaatttgatactttagctgcaattgcctttgtttgctcagcaacaacagcgattgtagttccagcttcacgctcctcaagagtctcaccgatgcaagcaataactttcctccctagtgaaagtgcatacgcaactttatctccgacaaactcatttgattcatttagaagctaccttcgttcagagtgaccaagaataacccagggaatatccaaattaacaagcatttcagcactaatctctccggtataagcaccacctttgcgaacccaacagttttgagcagcaacatggaagtcagagcggagtaaacttttcacaacgggaaggaacacataaggggggctcacaacaacttcaacaacatcttcacc

SEQ ID NO: 2200 - DNA, 373 bp, Cicer arietinum
accaccaaacaccaagcaataaacaaagatctaggtgctctcgctcctattcggcttcgtagacacgaaaatcagatgttgatcaaggttgggaacccagtcatttgtagcaggattacttttatatcctctgaattgaatttcaccaacatcaacatagcttgcaggtaacttaatctcatatccatcttcaccaccttctctcaccgcttttataaacccacttcccgtcgcatgatgctgtttatcaatggacaacaactccttgtaatagtgagtctccacaaactcatcttgcggatccaccaaattctctgaggaaagtatagcgagagaattaatagattgaagagattgaagtttttgaagctct

SEQ ID NO: 2201 - DNA, 413 bp, Cicer arietinum
gatttcgaggcggccgcccgggccggtactggtgcttccggagcactatcatgtgtgccaaatgaatcaaatcttgacgtttcccgagcaggtaaagatacactatcatgtgtgccagacgaatcaaatcttgagaagtcaaaagcgttttccaaccagtctttgggcctttgtggtgaggtgcttgagctgaaaagtggggtgcttggaacagaatcatcaaaactgaatccaccggtcttctggaagagatcaccagcctgtggtgaagcggttttaatggggttgaggcccaggtccccagaactaaagagataattgtctccagctccatcaagatctctctcctcctttgtggtgctactggcattgaatccccaaactgaatcaatatcatcatttgtgtcgaaggt

SEQ ID NO: 2202 - DNA, 384 bp, Cicer arietinum
gcttcttctagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcgaatacaatgtgtggtcttctacacctcatggaaacaagaagctg

SEQ ID NO: 2203 - DNA, 226 bp, Cicer arietinum
cttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 2204 - DNA, 366 bp, Cicer arietinum
cggcacctcagaaccagaacgccttagatatcggaggacggtgcccgtggcatcggtagcgacatccttccgatcaacgacgccgattgcgatgggtttttcctctttgaaggcaagccgcaccgccggcctctgattccttcccaaggtttttccctgccgccacgacatgcgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgt

SEQ ID NO: 2205 - DNA, 264 bp, Cicer arietinum
gcttcttccagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccctgaaagcttatacaaccaaggtaggaggtggtaacgaggaagggaacatcctcatttataccgatccatacaacaaagaggat

SEQ ID NO: 2206 - DNA, 255 bp, Cicer arietinum
gcaagccgcaccgccggcctctgattccttcccaaggtttttccctgccgccacgacatacgactactagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatccctgt

SEQ ID NO: 2207 - DNA, 439 bp, Cicer arietinum
tggtcccggccgaggtgcttcttctagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaa

SEQ ID NO: 2208 - DNA, 422 bp, Cicer arietinum
gcgggattttctgcaggccacgcgaccacacaaaactgcggggatgctatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagcgatgcgtgagagaattctggccggtggaaaaagtcgacagtatgcccccgaacccgctgacgg

SEQ ID NO: 2209 - DNA, 409 bp, Cicer arietinum
acatcttttatcatgtgccactttacaggaaagctcccactccatttatcttgctgccaaaaatccatatcctgattaaaatcaactgaaccaatcatctctgcaactccgcagaattgaccactggcattaacagaaaaaaataggaagataggacagactccgggtttttcagctgatactttctttgaatcctcataagcattttccagcttcttgtttccatgaggtgtagaagaccacacattgtatttgatgcttttgtgcacatcatcctcgctgtatgattttataacaaaaaactttgcattatcatagtcaagagggaaatcctctttgttgtattgatcggtataaatgatgatgttcccttcctcgttaccacctcctaccttggttgtataagctt

SEQ ID NO: 2210 - DNA, 438 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccggagtctgt

SEQ ID NO: 2211 - DNA, 438 bp, Cicer arietinum
gtcgcagatagagagagtgagtgccgcatccttgtttcttgcagaatccgcgtggtaacggcggctaaacaatttccgatcaattcactccacaagatttaatggcggcgaagttgcagcagttgcagtccaaagcatgtcaagcatctaaatttatatccaagcatggatctgtttactacaagcaattgttggagcagaacaagcaatacattcaggaacctcctaccattgagaaatgcaatcttttgtctaagcaattactttacactcgcctagctagtattccggttcgttgtgaggccttccggaaggaacttgattatgtcaagcaattatggaagaacaagcaagatttaaaggttgaggatgcgggcactgctgctttgtttggcttggaatgctatgcattgttttgtgttggtgagattgttggaa

SEQ ID NO: 2212 - DNA, 238 bp, Cicer arietinum
gcttcttcgagaagtggattttctgaatttgcatcaaatgctaatgggcagtctgcagttgctaaacttaggccgaagctagacatttacaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcattt

SEQ ID NO: 2213 - DNA, 436 bp, Cicer arietinum; identical to SEQ ID NO: 2149

SEQ ID NO: 2214 - DNA, 216 bp, Cicer arietinum
gatttcgagcgggccgcccgggcaggtcgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatccctgt

SEQ ID NO: 2215 - DNA, 255 bp, Cicer arietinum
gcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatccctgt

SEQ ID NO: 2216 - DNA, 343 bp, Cicer arietinum
cgagggagtaatcatcagcatgtgtctgccaagcgttcataacgtcttggttctgtgagacgggtgcatcacctagcgtggtcgcggccgaggtaccatcactagcacacattgtggactctctcaatgataccttattgaaaatgattatttagtttataaacggacgtggaccaattaagtgtttgaatgtatgttttaggaggaaatgattttagcagcagcaccaggtcttgcaagtggaacacaaacgagattatgtgctcttggaacagtgagaccaggtctttcatccatgctaaccttagcatcagcacctttcaatatttgtccatttggtcct

SEQ ID NO: 2217 - DNA, 414 bp, Cicer arietinum
acctgggaagatgggagcacctccaaagagtgatgttccaattattacaccaaatgagctcactgaagctgatggtttgttgtttggttttccaacaagatttggaatgatggctgcacaattcaaatcatttttggatgcaactggaggcctatggaacaaacagtcacttgcaggaaagcctgctggcatcttttacagcactggttctcaaggaggtggccaagagactacaccgttgacatctattactcaacttgttcaccatggaatgatatttgtgccagttggatacacatttggagctggcatgtttgagatggagaaggtgaaaggtggttcaccttatggttcaggaacatatgcaggggatggctcaagacagcctagtgagttagaattggctcaagcttt

SEQ ID NO: 2218 - DNA, 390 bp, Cicer arietinum
cagaaacttgagtcttctatacacaagtctttcttttttagaccaatctctacttttcaaacacattaaaaaatgggttttcgtttacctagtatcatcagaagggctgcaaaccaagcatcttctaaaggcgtggatgtgccaaagggatatcttgcagtgtatgtaggagagaaaatgaagcggtttgtaatcccaatatcatatttgaatcaaacttcattccaggaattgttgaaccaagctgaggaacaattcggatatgagcatccaacgggtggtctcacaattccttgcagagaagacgttttcttagatattacttctcgtttgaatttttgctgatctcttcagaagaaggagctgacatagattatttgaggcaaattt

SEQ ID NO: 2219 - DNA, 416 bp, Cicer arietinum
acatcttttatcatgtgccactttacaggaaagctcccactccatttatcttgctgccaaaaatccatatcctgattaaaatcaactgaaccaatcatctctgcaactccgcagaattgaccactggcattaacagaaaaaaataggaagataggacagactccgggtttttcagctgatactttctttgaatcctcataagcattttccagcttcttgtttccatgaggtgtagaagaccacacattgtatttgatgcttttgtgcacatcatcctcgctgtatgattttataacaaaaaactttgcattatcatagtcaagagggaaatcctctttgttgtattgatcggtataaatgatgatgttcccttcctcgttaccacctcctaccttggttgtataagctttcacgga

SEQ ID NO: 2220 - DNA, 189 bp, Cicer arietinum; identical to SEQ ID NO: 318

SEQ ID NO: 2221 - DNA, 429 bp, Cicer arietinum
acctacagtagccctgcatcgagaatcaatcaattttttaacaccagatgggagttgaactaaacagtatgttgatgttggctctttcaagatctttgcattggttccagccgctcgaacaagctttccaccttgcccggggttcagttcaatgttatgaatgattgttccaattcgcattgctgagagaggcatacaactcccaatctgagagttaatgtcagaatacatcatcctctcacgtgcctcttgaggaatcgcattcgcaatctcggcggcggaagagtaacggcgaatggcattagtgaacaaattgagcaccgacgatgcggcgcgacctcttaataacgacatagccattcatacaaagactattttgatcaatgaataaaccgatagacagtcctcaccagagagtgacggtggtcg

SEQ ID NO: 2222 - DNA, 216 bp, Cicer arietinum; identical to SEQ ID NO: 2214

SEQ ID NO: 2223 - DNA, 216 bp, Cicer arietinum
gatttcgagcgggccgcccgggcaggtcgagcttcaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatccctgt

SEQ ID NO: 2224 - DNA, 279 bp, Cicer arietinum
cgctgttagcgctctgctagggtagagaatttttgcaggctaaaatggcagcaaaagcagctgtggggctaacgggaccctaacagctgcctgaagaaagggattcagagagttgacctttcttcgcgacgagtgtctgcaacgacattgagcttcgcgagctcttgacatcgccttcgggcgctacttctcacgtgttatttgcggcttcttcttaccccgacattccggcttcgcgagccttcgacaatccgggctctgcgcccctcgacttcccgt

SEQ ID NO: 2225 - DNA, 399 bp, Cicer arietinum
acatatgcgcaatgctcttcaagcaacaggccaactgcatgagcccggtaataagttagatcagtggatgagcccctgtagcgactgaccctcagtctgcatgttccccacgaagcaactccttgctcgtcgcctatggccacctcccgtgttgacatgtgccggagtagctgaacacaatcagatcggagagcaatgaaattgttactacatgaagtcgaatatctaacgcgtgcttcaaggtgactgatatcttggttgtagatatgtgaaagagtctggatgatgtctttatgcccgtcatggtcgcttgtctgggcgtagaatttttgagctttggcatagtcctccgggtcgttgagtttgtagcccaatgcatcttcttcgatgctctgaagt

SEQ ID NO: 2226 - DNA, 400 bp, Cicer arietinum
actatgtataagtaaaattcattatacagtatatatactactggtcgggatgcaaatctcaaatgctctgtaatgatacgaagttacaaacatagaatatgaaatgtatcccattaattcattggcctcaagccctcaagcaaagtcctgatatacaggattcaactcaagttgctcagtcaatttctgtaggacatccttcataagttttgtcagcttttctttatccaactccacaccatctttttctttggctatatcagcaaaaacagtatcataaagaagaacagctgcatcgccagcttcaaataaaggtaaacccaactccttagtgtttctcttgaggaagctccttattatttctgtgcttcctaaatcatcctttgcatcggatttttcc

SEQ ID NO: 2227 - DNA, 198 bp, Cicer arietinum
gcgtactgcccagagaccctcttcttctttgcagccccggctgctgcccggaacacaaccgggcttcgacaatttgtctcactggctgagaccactagacaaaaccgctgggtcgaaatggtacagagcttacctggagaccgtggaatgaggcgactacctcgtccacagagcagcgttctggccgctttggggttt

SEQ ID NO: 2228 - DNA, 290 bp, Cicer arietinum
attcgatatattcagttggaagaatgaagagtgtgtggggtgaagattgtatggagtttaaaccagagaggtggttatcggttcagggagaccggttcgaaccgcctaaagatgggtataagtttgttgcgtttaatgctggaccgaggacttgtttggggaaggatttggcttaccttcagatgaagtctgttgctgcggctgtgttgattcgttaccggatttcaccggttcccggtcaccgggttcagcagaagatgtctctcacgcttttcatgaagtatggtcta

SEQ ID NO: 2229 - DNA, 224 bp, Cicer arietinum
gcggccgcccggcaggtaccctgttacagaggcttaggttctatttttttcacttttaaatttcttttgtcatgaatagcatagggtgaatgctccttcctagttaaaattttgttcaagttccctttgattctgtatttcctatggtgatgtattttaaaaaactggcctattttatcaatgtaggctgatgtaatatttattatagaattcaaattacgctt

SEQ ID NO: 2230 - DNA, 240 bp, Cicer arietinum; identical to SEQ ID NO: 342

SEQ ID NO: 2231 - DNA, 396 bp, Cicer arietinum
ctgatacctttgccgttgaaaggtctggaattgccaaagatgttacagaattgattggcaaaaccccattagtatatctaaatagacttgcggatggttgtgtggctcggattgctgccaaactggaattgatggagccatgctctagtgtaaaagacaggattgggtatagtatgattgctgatgcagaagagaaggggcttatcacacctggacagagtgtcctcattgaaccaacaagtggtaatactggcattggattagcctttatggcagcggccaagggttacaagctcataattacgatgcctgcttcaatgagtcttgaaagaagaatcattctattggcttttggagctgaattggttctgacagatcctgcaaagggaatgaaag

SEQ ID NO: 2232 - DNA, 426 bp, Cicer arietinum
acatgatctgtcaccatcccggttccgatgacaattctcgtccaccttttctccgtcgaacccgccgcaacggaggtgaccggtcacctttcaatccggtgatcgtcctacgcggaagtggatcaacggaggtaacagaaggtggtagcacaggagagagtcgggggtttgagcttttctatgatgatggtgctggttctggtcttagacctttacccccaagtatgtcagagtttcttttgggatctggatttgatagactgttagaacaactttctcagattgaaatcaacggtattggaagatatgatcatccaccagcttcaagaacagccgtggattcattaccgactattgaaatcaatgggtgtcatttggatatggaatcacactgtgcagtttgcgaagaggcttttcagttaggta

SEQ ID NO: 2233 - DNA, 307 bp, Cicer arietinum
acagagcttacctggagaccgtggaacgaggcgactacctcgtccacagagcagcgttctagccgccttgggtttttccctgcgaggggtttccccaaggatgtatggtcctaggttgcagctactggcgatcttaggggatcatggacttcctgcctcagggtatggaaagctactcgatctatctgtgcaagagaattctaggctggagaggaatagatcccgctgacgggatgacctcttgaaagtaaatgcgcctttgtgccgatgatatgctggatgaactagatgggagacgctgctggag

SEQ ID NO: 2234 - DNA, 368 bp, Cicer arietinum
ggcggcacctccgaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgt

SEQ ID NO: 2235 - DNA, 436 bp, Cicer arietinum
actgtgacattgtcacaacaacaacccacaagagcttaaggggccccagggctggtatgatcttctaccggaagggacctaagccacccaagaagggtcagcccgagaatgcagtttatgattttgaagacaaaatcaactttgctgttttcccctcccttcagggtggtcctcacaaccaccagattggtgcccttgctgttgctttgaaacaggccacgacgcccggattcaaggcatatgccaagcaagttaaggccaatgcagttgcacttggaaattacttgatcagcaagggatacagccttgtcactggaggaactgaaaatcatcttgtcttgtgggatcttcgccctcttggcttgaccggcaataaggtggaaaaactttgtgatctatgtaacatcactgtgaacaagaatgctgtttttggtga

SEQ ID NO: 2236 - DNA, 183 bp, Cicer arietinum
ggtatgttatgttatgtatatttttcgtccggggggccaaaggcccccaaaagtctcctactggagcacaggacgtgctgagctaaactatctacaattgctgtcgcgctggactcctcctagaatacccgccatgtccactcgcatcaacggagagcctctcgagctccttcccccgagggc

SEQ ID NO: 2237 - DNA, 394 bp, Cicer arietinum
actaatttgtctagaaaacgacaacaaaagcctaattattgatggcagaaacaatagttgccaaaacaacaacatagtagccaaaaccaaaaacattttcatttgagtaggtggtgagggtccaaaatccaaaacatggccaaacaaatttggcaccttattgtaagttacaacaccctgtcagaaatttcaaccgaatatccctgtctcaaaatctacccttcttatttgttgctgccagaaaattctaaaaataaaactaaaaagccctcgcctatctgatcaacaaccttagtcaaagcaagagataataaaaccaaaactaagtgatgctatcactttgatggattagtctggttgctattctccaaagtctcttccaccttctcatcta

SEQ ID NO: 2238 - DNA, 437 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccggagtctg

SEQ ID NO: 2239 - DNA, 416 bp, Cicer arietinum
atggaatcattattgtttatgatgtgacagatgaagagagcttcaataatgtgaagcaatggctcagtgaaattgaccgctatgccagtgataatgttaacaagctcttggttggcaacaagtgtgatctgacagcaaatagagctgtgccatatgaaacagctaaagcatttgcagatgaaataggcataccttttatggagacaagtgcaaaagattctacaaatgtcgaacaggcctttatggcaatggcttcttccatcaaggatagaatggcaagccaacctacaaacaatgcaaggcctccaaccgtgcagataagaggacagccagttgggcagaaaggtggctgctgctcatcttaaccacaagatattcagatctatttcatttggtctactgctcattgcatgtaa

SEQ ID NO: 2240 - DNA, 256 bp, Cicer arietinum
accactgttgttccctctcctacttgctgttgtgttcttcaatatttgtctcagcatctgattctcattctgcaaagttgaaagcttttctttaagctctgaattcttcttctctaagtcattgacttttgattccaagtcactcaagtatgcctttttcctctcccttgcttgctgagctgaaactctgttcctcagtagcctcttaagccgtttgctttctttgtcagctgggcttctccctctcttcttttga

SEQ ID NO: 2241 - DNA, 435 bp, Cicer arietinum
cgtccaagttggtccacccattggcaactacggcttcatgaacatcactaccactagtgccccaaacactggtggattgaaaactcaagatgttgaagaaggcagcgtcaacatcagctacgttgcaggctttatgaaggcagggtttcccagggtccacttagacaaacccctgttctttttaaggtttatcctggaagacgagctggtggggttgtggctgatatgatggctgcaaacgagttgaattctcatatgttctttcaaagcagttctaaaggtattagtcagcatcttatgttacttttaggtggctttgaaacaactactggagagcagtggcttgcttttcgtgattatgggaaatatagcgcagcagactatgcaaaagttgcgagtgagaaggtatcaaaactgtcttcatggaatagcttt

SEQ ID NO: 2242 - DNA, 280 bp, Cicer arietinum
cgctggcgctgcactcgctcacactctcggcaaggatggacgccgagtgcttgtcattgaaagagatctgagtgagcctgatagaattgttggagagttgctacaacctggcggctatctcaaattagttgaactgggccttgaagattgtgtgaacaatattgatgcgcagcaagtgtttggttatgcacttttcaaagatgggaaacatactcgtctctcttatcccttggataagtttcactcagatgtatctggcagaagctttcacaatggccgt

SEQ ID NO: 2243 - DNA, 435 bp, Cicer arietinum
cttcaaggttttcgaacttccgcgctcgaatctcttgacgcggcgttgtctccgcttgcggctggttctttagccgaaggtgaacgaggtgacgcgctttataagagagccgagttgaaactcgcgacgagtgaacgcggacgagttgactcggcgctgaaggatttgactgagtcggttattttgagtcctaagaacgcgaaagcttggtctgcgttgggagagtgctatgaaggaaagaaaatggaagaggaagctaagaaggcttataaggaggctcttgagttggagccacatttttctgtgccgctagaagcacttaacagtaataatggaacaaaagtcgaagatctgtcttgaacttcttttggggaagaatgtctgttggaggagaggtgtttcattagctgtgtaaccacattttatctcaatggt

SEQ ID NO: 2244 - DNA, 410 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctccaggtaa

SEQ ID NO: 2245 - DNA, 446 bp, Cicer arietinum
gccgaggtgcttcttcgagaagtggattttctgaatttgcatcaaatgctaatgggcagtctgcagttgctaaacttaggccgaaggctgacattaacaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccggagtctgt

SEQ ID NO: 2246 - DNA, 416 bp, Cicer arietinum
actgtgacattgtcacaacaacaacccacaagagcttaaggggccccagggctggtatgatcttctaccggaagggacctaagccacccaagaagggtcagcccgagaatgcagtttatgattttgaagacaaaatcaactttgctgttttcccctcccttcagggtggtcctcacaaccaccagattggtgcccttgctgttgctttgaaacaggccacgacgcccggattcaaggcatatgccaagcaagttaaggccaatgcagttgcacttggaaattacttgatcagcaagggatacagccttgtcactggaggaactgaaaatcatcttgtcttgtgggatcttcgccctcttggcttgaccggcaataaggtggaaaaactttgtgatctatgtaacatcactgtgaac

SEQ ID NO: 2247 - DNA, 270 bp, Cicer arietinum
gcttcttcgagaagtggattttctgaatttgcatcaaatgctaatgggcagtctgcagttgctaaacttaggccgaaggctgacattaccaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccct

SEQ ID NO: 2248 - DNA, 358 bp, Cicer arietinum
acctgttatgcgaggtgaatctgccggaacctcagcttctcgtccaggcaatggttcaactgctggtcctgaacgcgctcagggggccgtagagggtcaaaagaagagagggagaagcccagctgacaaagaaagcaaacggcttaagaggctactgaggaacagagtttcagctcagcaagcaagggagaggaaaaaggcatacttgagtgacttggaatcaaaagtcaatgacttagagaagaagaattcagagcttaaagaaaagctttcaactttgcagaatgagaatcagatgctgagacaaatattgaagaacacaacagcaagtaggagagggaacaacagtggtacctcg

SEQ ID NO: 2249 - DNA, 426 bp, Cicer arietinum
ttccaacactgtactagaaatagtttaaggttgtgcagaaacagatatacaaaatacatcatcacttcaacttcactctcaaatcccatcaccaacctttccgtcctaatccttggaagaagatgggttcaaaatctgagactttcacttttgaggaggtggctaagcacaataacaagaatgattgttggatcatagtcaacggaaaggtatatgatgttaccccatttttggatgatcatcccggaggtgatgagtctctactctctgctacagggaaggatgccaccgtcgatttcgaagacgttggccacagtgattcagctcaagagaccatggcaaagtaccctgcccgggcggccgcccgggcaggtacttatctctacacaacacgacgagactgtcaccaataatgaaattgctgct

SEQ ID NO: 2250 - DNA, 258 bp, Cicer arietinum
accatgcgatcatccctctcaaatgctgtcaaagttcaggcagaagaattaaccaaagaggactttcagggctccaagtggttggtgttgagatatgcaatacttaatttggaagttattcaagcagccattcttttagccaaacaggaaggtctttttgtttccttggatttggctagttttgagatggttagaaatttcaaacagccacttctgaagctattggagtctggaaacatagacctttgctttgctaat

SEQ ID NO: 2251 - DNA, 417 bp, Cicer arietinum
actactgattgagcctttactgagcaccacctcatttgctccttccaccctgccaaagtcatgaccattgagataaaatgtggttacacagctaatgaaacacctctcctccaacagacattcttccccaaaagaagttcaagacagatcttcgacttttgttccattattactgttaagtgcttctagcggcacagaaaaatgtggctccaactcaagagcctccttataagccttcttagcttcctcttccattttctttccttcatagcactctcccaacgcagaccaagctttcgcgttcttaggactcaaaataaccgactcagtcaaatccttcagcgccgagtcaactcgtccgcgttcactcgtcgcgagtttcaactcggctctcttataaagcgcgtcacctcgttc

SEQ ID NO: 2252 - DNA, 371 bp, Cicer arietinum
acaaatgatagaaagccgattaagtcaaaactgaaccggaacacaaagccccttaagccgtttatggaagccccagctcaatcttccatgagccgccaccacaatctttcaattcaactcttcttttcttcacaggaaccacgtgatgaacacgtgaaaccggttcaaacccaagagtcttttctaaaccaacattttcctctcctctttcaccggttcggtccacccgtttcaaatctctggttgactccggttcatctctaaataagttcatcgaagtctcagccgtttcaaccgaagccatactttcatcactctctttactctctccatccaccgccgccgcatttaccgcctcagactggtggctt

SEQ ID NO: 2253 - DNA, 392 bp, Cicer arietinum
gcaagtctcttcaggatatcattgccattctgggtatggatgagttgtctgaggccgacaagcttactgtcgagcgtgcccgtaatatccagcgtttcctgagccagcctttcactgtcgcccaggttttcactggtatcgagggtaagctcgtcgaccttaaggagaccatcaactccttcaaggccatccttaacggtgagggtgacagccttcctgagggtgccttctacatggttggtgacttcgcctccgccaaggccaagggtgagaagattcttgctgagcttgagggtcagtaaggggtttaagtattgaagttaatgccgcgggagaccggaggagagaaataaaggacctgtgtatagagaagaggaacaaaggtcccggga

SEQ ID NO: 2254 - DNA, 294 bp, Cicer arietinum
cttccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtat

SEQ ID NO: 2255 - DNA, 436 bp, Cicer arietinum; identical to SEQ ID NO: 2149

SEQ ID NO: 2256 - DNA, 436 bp, Cicer arietinum; identical to SEQ ID NO: 2149

SEQ ID NO: 2257 - DNA, 437 bp, Cicer arietinum
gcttcttcgagcagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccggagtctg

SEQ ID NO: 2258 - DNA, 200 bp, Cicer arietinum
aacattgttttacagatcatctccatttattacaagaaatcgagtgctcaattactatgattttggatgaacaaaggcttaataaaccagcactaaatatgcgtgcctcattatatccaaaaccatagtaatgaaatccttcatttctcagagataaacactacactccaatgtcctaataatttcccagttgtatttac

SEQ ID NO: 2259 - DNA, 432 bp, Cicer arietinum
acattgctttacaaggcctagacattgtgaacacagaaacaatgcaacctgttcctgctgatggtaaaactgttggcgagatcgtgatgcggggtaatgctgtgatgaaaggctacttaaagaaccctaaagctaatgaagagtcctttgctaatggatggtttcattctggtgatcttgctgtaaagcatccagatggatacatagaaattaaagacagatcaaaggacatcatcatctcaggtgctgaaaatatcagcagtgtagagatagagaatactctatactcgcatcctgcaatactcgaagcatcggtggttgcgaggccagatgagaaatggggtgagtctccgtgtgcatttgtgacattgaagccgggagtggatagcagtaacgagcagcttctagttgaggatatactgaagttctgca

SEQ ID NO: 2260 - DNA, 422 bp, Cicer arietinum
cagaaacttgagtcttctatacacaagtctttcttttttagaccaatctctacttttcaaacacattaaaaaatgggttttcgtttacctagtatcatcagaagggctgcaaaccaagcatcttctaaaggcgtggatgtgccaaagggatatcttgcagtgtatgtaggagagaaaatgaagcggtttgtaatcccaatatcatatttgaatcaaacttcattccaggaattgttgaaccaagctgaggaacaattcggatatgagcatccaacgggtggtctcacaattccttgcagagaagacgttttcttagatattacttctcgtttgaatttttgctgatctcttcagaagaaggagctgacatagattatttgaggcaaatttgtataggccggcactcacttattttttcatta

SEQ ID NO: 2261 - DNA, 344 bp, Cicer arietinum
acacctttgattgtccccttctcttcatgtagggaagtgactgttccttgctccaaatttacattgggaagggaagcagccttctctcgcattctctgaataaaacggccattgtgaaagcttctgccagatacatctgagtgaaacttatccaagggataagagagacgagtatgtttcccatctttgaaaagtgcataaccaaacacttgctgcgcatcaatattgttcacacaatcttcaaggcccagttcaactaatttgagatagccgccaggttgtagcaactctccaacaattctatcaggctcactcagatctctttcaatgacaagcactcggcg

SEQ ID NO: 2262 - DNA, 436 bp, Cicer arietinum
acaccttggtgggatggaagtgtgatatatggaagcaatgaagaagttttgaagaaagtgagaactttcaaagatgggaagctgaaaatatcaaagcaaggtaaccttcaccttaacgaagatggaacaacaatttcaggtgacattcggaatagttgggctggtgtcacaactttgcagaccctttttgttcaagaacacaatgctgtttgtgacactctcaagaatcatcacccagatttgaaagatgaagatctttatcgatatgctagattggtgacttcagcagtgattgcaaagattcacaccatagattggactgtagaactccttaaaacagacactttgcttgcaggcatgcgagccaattggtatggattattgggaaagaagttcaaggacacatttgggcacgttggaaattcaatcttgagtg

SEQ ID NO: 2263 - DNA, 123 bp, Cicer arietinum
acttagggttgtgaacaatgttcttggaggtgtgtcttttgtgatgttggcaaggttgacagggtcacaaggtgttggtagtgaagagaaggtgtcaaaattggaggttggattagatgagaa

SEQ ID NO: 2264 - DNA, 362 bp, Cicer arietinum
ccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgcgttgttttgtgacacattttattatatttagtgtgcttaatttggttgccaaatgtcatactctcttcttcttttcattttgttgtggaagtgtgagattgtaag

SEQ ID NO: 2265 - DNA, 417 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcgcgcatcactacatctgccgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcattgatcggaaggatgtcgctaccgatgccacgggcaccgtcctccgatatctaaggcgttctggttctgaggtgccgccattagatccgacaaaggcgttgtcagagaaggtgaactctccaaaattcc

SEQ ID NO: 2266 - DNA, 408 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaag

SEQ ID NO: 2267 - DNA, 424 bp, Cicer arietinum
gcaaaccttaatagggtcacctgctgaaacaaattattcatttgattgattctgtcatggtagacaaggtccaatacatgtagcatctgcaaatatgcaatggtatataaagaccagtcaaaccagctccagtttaaatctatctcaataaccctttatgcaacttaaaagacaaaatttgttcttttatgtaaactttgaaggtttatttttcagaatataaagtctcttcgatcctcctgattacaatactaagactgccaccactttccaatgctttaacagcagctcggtgtgcagctttatgccacttgagcaaattataagattgcataactgaccatcttgcttgattagacatctcagctacagacagtggaggctcaagaagaagacagatgcttctaaatagattttcatcatt

SEQ ID NO: 2268 - DNA, 326 bp, Cicer arietinum
acacagtttacaaaagagacttggtggagcttatgagaaacctcccgggacctttgttcctcttctctatacacaggtcctttatttctctcctcccgtctcccgcggcattaacttcaatacttaaaccccttactgaccctcaagctcagcaagaatcttctcacccttggccttggcggaggcgaagtcaccaaccatgtagaaggcaccctcaggaaggctgtcaccctcaccgttaaggatggccttgaaggagttgatggtctccttaaggtcgacgagcttaccctcgataccagtgaaaacctgggcgacagtgaaag

SEQ ID NO: 2269 - DNA, 154 bp, Cicer arietinum
acatgggcttaaagacgtatttatgtatatcatctcaatttgtctctcttgatactatgattgtaatttttatatttttgttcttttgtttatgtcacgaaagaagtgttgctgtaaccgtttacaaaatctataattttgtgcccctttgttg

SEQ ID NO: 2270 - DNA, 436 bp, Cicer arietinum
ccaagatgtgaagctgcttaactttttgttgagcccagttggtcgtagggttgagtgggccttgaaacttaagggtgttgattatgagtatatagaagaagatatattcaacaaaagcaatctccttttggaattgaacccggttcataagaaagttccggttcttgttcatggacagaaatcgatggcagagtcactaattattcttgaatacattgatgaaacatggaagcaatatccattgctacctcatcatccttatcaaagagctcttgctcgcttttgggctaagttatctgatgagcttgcgctgggtgcatggagggcaatggttaggagaggtgatgaacgggaaaaggttctgaaggaagcgatagaagtaatggagaagatagaacaattgattaaagggaataaattctttggagggaacaat

SEQ ID NO: 2271 - DNA, 387 bp, Cicer arietinum
accaccattaaccagaatctccataatgtgggctttcttcagcttcaatcccttcatcttcttgatctgagtgtgaaccagaacaccgataacagttgcatacttcttcagtttctcaagctgggtctgaatgttcttctttccttcatcggttacatactgctttgaatacttattgaaagccttcttcttggacttgcaccaattcttgtagaacctacgctagatttcttcactcaaatgctgagtccaaacagtattcaaagtccgaagaccgcggggagttttcacataaccaacatcaccaacaacattcattggaggggtctcaatgattgtaactggctcacaggtctccttcttgtgaagcttggatcctggtttctc

SEQ ID NO: 2272 - DNA, 439 bp, Cicer arietinum
atattcatattcatattatttttacattaagggatggcaggaattgattttgaggatttgttaccagtaattgctaataagctaggtggtgaaggtttaatgaaggaactttgtaaagggttcaatttacttatggacaaagacaaaggtgtgattacattggagagtttaaggaaaaactctgctttaatgggtttgaaagatttgaaggaagatgagttagtgagcatgatgagagaaggagatgttgatggtgatggtgcactcacagagatggagttttgtgttttgatgtttagattaagtccacagttgatggaggaatcatggtttttgcttgaagaagcattgcatcatgaactcaacaataaccattgatattgaatatgactcgttattaagtcattgttaacctttattatcatgttcttgactattt

SEQ ID NO: 2273 - DNA, 254 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaa

SEQ ID NO: 2274 - DNA, 214 bp, Cicer arietinum
cttttgtggaatatagtggcagttactactgctgggatcaagggagaaggtcctaccatctggtttcttgctattatatattttatttctggtgttccaggatcctatgtaatgtggtatcgtcccctttatcgcgctatgaggacggacagtgctctgaagtttggctggttttttgtggcttacatgttgcacattggcttttgcatttttg

SEQ ID NO: 2275 - DNA, 244 bp, Cicer arietinum
taccatggtcccccccgacgtgcccaaacaactcctctcttctcaaggctctctctgctggcgatgtcccatctcacacatcatctcaagctgcacggacggggtctgtcatatagactcccaacaatgccgaggatccgtcacaagataaccccaatccaaccagcaaaatgaacagattcttcgctgaacttaagcgaagtgtcaaaatttctatcttccacagctggctcaacatcctcct

SEQ ID NO: 2276 - DNA, 439 bp, Cicer arietinum; identical to SEQ ID NO: 1808

SEQ ID NO: 2277 - DNA, 314 bp, Cicer arietinum
cgtctctcgtctccaaacattacctacttcattcgcaagcacaagattcttcaaatttcattgttgtttccattccatttccacccatacctgattcagatttacatatggcaactgaaacaaaggctgtcactgaggatgtcaagatcgatctctttgaagacgatgatgaatttgaagagtttgaaattaatgaagagtgggatgataaggaggaagggaaagaagtaactcaacagtgggaggatgattgggatgatgacgatgttagtgatgatttctctcttcagttgagaagggagttggagagcagt

SEQ ID NO: 2278 - DNA, 279 bp, Cicer arietinum
acgggaagtcgaggggcgcagagcccggattgtcgaaggctcgcgaagccggaatgtcggggtaagaagaagccgcaaataacacgtgagaagtagcgcccgaaggcgatgtcaagagctcgcgaagctcaatgtcgttgcagacactcgtcgcgaagaaaggtcaactctctgaatccctttcttcaggcagctgttagggtcccgttagccccacagctgcttttgctgccattttagcctgcaaaaattctctaccctagcagagcgctaacagcg

SEQ ID NO: 2279 - DNA, 279 bp, Cicer arietinum
  misc_feature (196)..(196): n is a, c, g, or t
  misc_feature (199)..(199): n is a, c, g, or t
gatttggtggattcttgaattacgcgattttaccgaagatataataatagatgagaatgtaataccaacaggggtacaagcaggacaagtttttgaacttcaatctttggatgaaagttcaagcaaaaaatttgtatttactgttcaaaagagaaatctacggtcagcaactaatgataccgattacacagaggcnacntgaaaccaaaactacaaatctctttaatggccaatccatttcagagacttcttgatttagcaccacgtagccaggttcaa

SEQ ID NO: 2280 - DNA, 288 bp, Cicer arietinum
actattattcactggcctaccaataattctattaccaaaagttgaagaattagcaacaaaaaaatcaaatccaatctcaaaagtgtctaaatcagatttgagtgtgacattttccaatgaccccttttcaattgaaaaccaatcagatgaaaaccaataaagaattggcctaggtgaattttgacttttgtaatacaaagccaaccctttgggctccaaaaccaaactatatggcccatttaaattttccttttctgaaagcctactaataagttttgaaggcccatt

SEQ ID NO: 2281 - DNA, 419 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagc

SEQ ID NO: 2282 - DNA, 358 bp, Cicer arietinum
gcactgttagcgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagatt

SEQ ID NO: 2283 - DNA, 230 bp, Cicer arietinum
aagataagcaataaattcgctaagattgaacctaatagagatgcctggacaatgcgaatttcgtctttccttaaggcatagatgaagataatgagttccacggcgttgccaaaagtgacattcagcaacgcgccgagagcatcacccatctttcgggcaacagactcggtagcataagctaagagacccgcaagaggaataatggcaactgcgttgagaccaaaaacaat

SEQ ID NO: 2284 - DNA, 382 bp, Cicer arietinum; identical to SEQ ID NO: 1868

SEQ ID NO: 2285 - DNA, 396 bp, Cicer arietinum
aaggtactgttatagacttgctctctgaagcgcaaaccaccaagaagcatgctcatacctaagataagcaataaattcgctaagattgaacctaatagagatgcctggacaatgcgaatttcgtctttcgttaaggcatagatgaagataatgagttccacggcgttgccaaaagtgacattcagcaacgcgccgagagcatcacccatctttcgggcaacagactcggtagcataagctaagagaccagcaagaggaataatggcaactgcattgagaccaaaaacaatacctccattgatgccatctacctgggatactgcaataccaacagggacgaacatgaggaggatgttgagccagctgtggaagatagaaattttgacgcttcgctta

SEQ ID NO: 2286 - DNA, 384 bp, Cicer arietinum
acaccaaaatggcgcccatgaagaactttctaattctgcaaaggatggtgttgttttaaatgtagaccctgtagttgctgaaattgtagaaaatgtagatccaaatggaaattatgaaaatttcgaccagtcagatagcgttggaaatgataatttgtctatggaagaaatgaaagaaggaacaaatgacaatatagagggaaatgatgttactaaggaagaggaagtggaaatcattgatgaaacaggtaaatctaggacacgaaagggtcctgtcaagaataagaatgcaaaacaaccaagtcctagaggtgttcatacaagttcagttagaaagaacaaagacgggaaagatgaagaggcatcagcagcatcttctgtttc

SEQ ID NO: 2287 - DNA, 390 bp, Cicer arietinum
acaccaaaatggtgtccatgaagaactttctaattctgcaaaggatggtgttgttttaaatgtagaccctgtagttgctgaaattgtagaaaatgtagatccaaatggaaattatgaaaatttcgaccagtcagatagcgttggaaatgataatttgtctatggaagaaatgaaagaaggaacaaatgacaatatagagggaaatgatgttactaaggaagaggaagtggaaatcattgatgaaacaggtaaatctaggacacgaaagggtcctgtcaagaataagaatgcaaaacaaccaagtcctagaggtgttcatacaagttcagttagaaagaacaaagacgggaaagatgaagaggcatcagcagcatcttctgtttcaaacgg

SEQ ID NO: 2288 - DNA, 248 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttgcctcctaaaatcaacaaaactactcgtaatgattatgatgctatgattaa

SEQ ID NO: 2289 - DNA, 396 bp, Cicer arietinum
accaggcctctgcatttcttcgaacacatgtccacgtttctgattaagaacactgtagataccaccaagagcttgctcaggagcttggatttccacaaggtaaacaggctcaagaagcctaggtttggctgtcagctgtgaggcatagaccactctcctggcagtaggaatgatctgaccacctcctctatggatagcatcagtgtggaggacaacatcacacacttcaaaacaaatggctctcatgttttcttctgctaaagcaccttctttagatgcccactggaatccagcaacaacagaatccttgatttcattcaaatactggactcccttacacatatcaaccaccatgttgggtccagtggtctcaggtccaaaacaccaaatcttctt

SEQ ID NO: 2290 - DNA, 311 bp, Cicer arietinum; identical to SEQ ID NO: 1565

SEQ ID NO: 2291 - DNA, 405 bp, Cicer arietinum
attgtttctggccctcaacctgagcgtggccttgacaagctcaggaagctcaccaccaacgtcaaagatgaaggaggtagtagccagttaatgaggaactcttctctgccttcaacgccgacaaccccagggactccggcaacacctccatcggcgcgtaaagttgacaacgtttggaggagcgtgttcaatcctgggagtaactcagccactaagacaattggtgctcatgtttttgacaaaccactccccaacacccccactgtctatgattggatgtatagcggtgatacaaggagcaagcaccgctagctgatgtggcaccaaactctccctcggttgcatgtaaatattctcctgttttcttgatcaactgccacgtgttgctacttgattggtctcttg

SEQ ID NO: 2292 - DNA, 164 bp, Cicer arietinum
ctttcttggcacgcactgttagtgcactgttaggagcgggattttctacgggctactcggccacacaatactgcggggacgccatcggctccctaacagcagttttcagagaaggaattttggagagttcaccttctctgacaacgcctttgtcggatctaatg

SEQ ID NO: 2293 - DNA, 364 bp, Cicer arietinum
gcggcaaaacttcatatttgggaaaaggaaagtttaaaaaacaacatatctcaggatataattcctcacacgagaaacaaggatagaaaaattacacgagtcatgcatatgatagacaaaaaaatctacgacagataaaaaggttggtagaaggatctaaacaaaagaaattcataatctaatcttcatcctcctcatctccatcaccaccagcagccttcttagcagcagccttgaggttccttcgcttcacgcgaccaggacgaccaccaccaagaggacttgtgagtgagaagtcaatgtgcttctgtgaatcaactctcaccatgaacgatgggatgttgaccacctgccttccaaccct

SEQ ID NO: 2294 - DNA, 197 bp, Cicer arietinum
aaaaattgggggtgctttctgattgaaaaccatgaaattgaggggaaactgatggaaaaggtgaaaaagacaatcaatagttactatgaagaaaatttgagggaaagtttctaccaatctgagatagtaaagagattggagaaaaagaagaacacctctgacatagactggtaaagtgcattcttcatttggcatcg

SEQ ID NO: 2295 - DNA, 341 bp, Cicer arietinum; identical to SEQ ID NO: 537

SEQ ID NO: 2296 - DNA, 150 bp, Cicer arietinum
ctactctctacaaagctctagttacagatgctgacaaccttactccaaaggttattgatgccattaagagtgttgaaattgttgaaggaaatggtggccctggaaccatcgagaaattcactttcgtcgaagagggagaaaccaagtttg

SEQ ID NO: 2297 - DNA, 406 bp, Cicer arietinum
ctacacaataattctcacttgtttgtttcaatcatcatccatgtcgtctactgctggtcaagtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaagggtcagactcctatgtttcctcgtatatttggtcatgaagctggagggattgtggagagcgtaggggagggtgtgactaatctgaaaccaggggatcatgctctgcctgtattcactggggagtgtggggaatgtccacattgtaagtctgaggaaagcaacatgtgtgatcttcttaggatcaacacagat

SEQ ID NO: 2298 - DNA, 435 bp, Cicer arietinum
acatacatatacatacccatacagaagaaaagtatttttttttacagaaaaaacaaaagaagcaaattatatattgtcttctccagcggttgattttggtttcttcactatcaaaacagggcacttcacattctgtgcgcagtgattgctcacgcttccaaggaaagccctcttgatgacaccatagccgtgacttcccatgaccaaaatatcaacacccaatttttgaaccgcatgacatatcacgtccctcggatcgccattctctatcttggtctccacattttggaggtctttacaaactctcttggctttctccaagacacaatcggcaacttgttggctatacttctccatggttgcagttatgtcagatgaaaaaaggtatcctgtgccatcaaaggccgaataaacggcacgagggggcttaacata

SEQ ID NO: 2299 - DNA, 338 bp, Cicer arietinum
accaccactctcagtcagcagactcacaaatccatcctctgagatatcaataagctggtagtcagtgcgattgacatgaggaacatcacagttatgagaagaaggaacaatatcttcaagttttttgccagtgaagatgtcaataccaacaaagtgacactttgcatgaccatgcttcccagtttttgaagttgaaacttccactaccttgcagggtctgtttttgataacaatgtgaccatttttgcgaatggtgccagcttgttgtggatatgtctttgatgctccagcatcagccttggactcgaaatggtgttcctcgtccgacctgcccgggc

SEQ ID NO: 2300 - DNA, 351 bp, Cicer arietinum
acctctgtagagtttcccaaaagctccttgagcaaaagcctcgcccatatttagcttcctcaaatcaattgtccactcatcaaaattttcaagcccctcagtaggagaattattgtccatcagagcttgagctaaagcatcgtcactcaatgcatgtgtgactcttccacgacgattgactctgtgtgcaacagagtagttatcattggcacgcctcttcaacccttggtggtccaacatgcgggtatgggaatcattggacccaacactgctgttatcaatagacattgcaaccgatcctccaccattgcttgtttgcaagctaccaacgctgtcgattgacatattgtt

SEQ ID NO: 2301 - DNA, 401 bp, Cicer arietinum
acagcagcacactagccaatgtcaaggcacctccttgactgaatccacagataaatatattgttagggtttacgccagcggctatttccttgtctatagtagcatgaacattttgaacagcattaagcaaactactttcgtcatttggagactcagctgtaacaggaatctccttaatgtcaaaccatgaaggcattacagaaccatggttgcaagtgacagaggcgtagggggcggaagggaaggaccatttggtgtctctgaattggggagaagtgaataatgtcttgattggttcatttgcaggaccagagtcaccaagaccgtgaagccacagaataaagcttcgagccattggttctgttactgtatctccagaagaacgaaacgtgtttttgggg

SEQ ID NO: 2302 - DNA, 277 bp, Cicer arietinum
tgtttttgggtcaactgagacatccacaccttgtgaagctgattggatattgttgtgaagaggaacataggcttctggtttatgagtatttaccaagaggaagcttagagaatcaactatttagaagatattcagcatctttaccatggtcaacaagaatgaaaattgctgttggagctgcaaagggtctagcctttttacatgatgcaaagaaaccagtcatctatagagatttcaaagcatcaaacatcttattagactctgattataatgcaaa

SEQ ID NO: 2303 - DNA, 434 bp, Cicer arietinum
cacaattttccaattaagaaaaagttagggttagggatttcgcaccttttcccaaaatctcatcaaaatcaaatcactatgtcttcaacgaaaaagatcacccttaagagttccgatggagaggcctttgaggtcgatgaagcggtggctttggagtcacagacgattaagcacatgattgaagatgattgtgccgacagtggaattcctcttcctaacgtgacaagcaagatcttggcgaaggtaatcgagtattgtaagaaacatgttgaggctgcgagttctgatgataaacctactgaggatgatcttaaggcttgggatgctgattttgttaaggttgaccaggctacgctcttcgatctcatactggctgcaaactacttgaacatcaagagccttcttgatcttacctgccagacagttgcagacat

SEQ ID NO: 2304 - DNA, 360 bp, Cicer arietinum
gcaagtggctctctagatggacagcaaagattggttgtgaagggaagatttgcaccaaagaattttgaaggaattttgcgacgatatgtcaatgaatatgtcatttgccttggatgcaaaagtccggacacaatactttctaaggagaaccgattgttctttctccgttgtgaaaagtgtggatcaggaagatcagttgcaccgatcaaagctggttttgttgctcgtgttggccgtaggaccgcaggggggacatgattttatctttctttttctttttaatctaaatgtgtaaactaagggaataaaccatttcccaacttttgacctatacatacatggggtattttgtacctcggc

SEQ ID NO: 2305 - DNA, 293 bp, Cicer arietinum
actaggttgaattactattgcgacactgtcatcagtagggtaaaactaacctgtctcacgacggtctaaacccagctcacgttccctattggtgggtgaacaatccaacacttggtgaattctgcttcacaatgataggaagagtcgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 2306 - DNA, 198 bp, Cicer arietinum
ctctgcctcactacaacatgctccggagccatgtaaagaagaagttatccattctgagctctccttcacctcctcccgaccttccagttcctgcaaatgagaaattggttgcttgggttggtgatgagattgtgacacgtgagagtgctaaggtttctgtgtttgactcaattgtccaaggaggtgactcagtttggg

SEQ ID NO: 2307 - DNA, 310 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacaggatgacctcttgaaagtaaatgcgcctttgtgccgatgatatgctggatgaactagatgggagacgctgctggagg

SEQ ID NO: 2308 - DNA, 342 bp, Cicer arietinum
actcgccgtcccccttaccgtcatatccgtcattccacaagttggggcgagcggcgcctatggtgttgcgtgggcggttccattcttgtgggccgctgtttggggtatcatcaccatcaagtggtgtaagagagacatgaagcgggagagagaagagtgggaacttggagttgaccctgaaaaagagattaagagaaagggatcatctatcgagacggcatcatagtgggggtgtgagagtttggtggtggtgatttaatagcgagcatggtggcatacacaatatccgcaggccttgggcgtttaggagtgagagcagcactaacgataacgatcagaatc

SEQ ID NO: 2309 - DNA, 416 bp, Cicer arietinum
gattgttgacgatgagatcaactctacaattgttaggcctctacctcaaggtgccaaactccgtgctgtcattgatacatgctttagtgggacagttcttgatttaccatttatgtgcaggattaaccgaaaaggttattatggatgggaagatcatagaagttctagagctggctacaagggcactagaggtgggctagcagtttgtttttcagcttgtgatgatgatggaaatgcagcagacacatcggcctttagtggtagtgaaagtgctggtgccttgacttacagtttcatccaagccatgcaagttcaacctaaactgacttatggtcaattgcttagtgccatgcgttctacaatccgtggggcaagagaaggaacttttggcacggattatcaacagcatgccatgg

SEQ ID NO: 2310 - DNA, 134 bp, Cicer arietinum
actgcaaaacatcttaaccactgtctgaccccgacctctagttactgggtccacccgggcccttcttcttgtttttcttcttatttttcttgccctgcttttgatcaccagaagccccttccccctctggtgta

SEQ ID NO: 2311 - DNA, 268 bp, Cicer arietinum
acaatatcctactttgatatcccctacgttagattgttaaacgacttgggtattctctcaatttcaatggatgacagaataaaactaatcgtcaaaaatctaacgtcaaagggaataacaaagataaaatgctaataaaatttgttaaataaggaaaccacaacaacagaaatgataactacccttaaatccaactctggggcaagatattgtaacctttgattggcttggatagatcaccgccagtgagacctttcacgctgcttgc

SEQ ID NO: 2312 - DNA, 184 bp, Cicer arietinum
cggccgaggtggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 2313 - DNA, 418 bp, Cicer arietinum
ctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcagaagtggcaaagccaagggtgatggtcttttcaaggcacttgagggttattgtttggccaatcctaa

SEQ ID NO: 2314 - DNA, 430 bp, Cicer arietinum
gataaaatcaaatcacttttacattatggtgatgaaagaacagagaaaattagtgttaatgttacttatggtaatggtaataattatgggttgtatgttgaaaggttcaaatgggtttagtttgtgtaacatgaatgaagatggattggatgcttgtaagccagcagtgactcagccaccagaagatccaaagcctgaatgctgcaaggcacttaatggagctgacttgagatgtctttgttcttataagaactcatcagagttacctttatttggaattgacccaattcttgcttcttcacttcctgctaaatgtaatctcactcctccagataactgctaagcttgtttcattgatctattttgtgtgtgtgtgttttgttttgttttaaaccctccatttctcatggcaatagggccttaataatct

SEQ ID NO: 2315 - DNA, 426 bp, Cicer arietinum
ctgataccatggcggttgaaaggtctggaattgccaaagatgttacagaattgattggcaaaaccccattagtatatctaaatagacttgcggatggttgtgtggctcggattgctgccaaactggaattgatggagccatgctctagtgtaaaagacaggattgggtatagtatgattgctgatgcagaagagaaggggcttatcacacctggacagagtgtcctcattgaaccaacaagtggtaatactggcattggattagcctttatggcagcggccaagggttacaagctcataattacgatgcctgcttcaatgagtcttgaaagaagaatcattctattggcttttggagctgaattggttctgacagatcctgcaaagggaatgaaaggagctgttcagaaagctgaagagatactgg

SEQ ID NO: 2316 - DNA, 326 bp, Cicer arietinum
cggacgaggaacaccatttcgagtccaaggctgatgctggagcatcaaagacatatccacaacaagctggcaccattcgcaaaaatggtcacattgttatcaaaaacagaccctgcaaggtagtggaagtttcaacttcaaaaactgggaagcatggtcatgcaaagtgtcactttgttggtattgacatcttcactggcaaaaaacttgaagatattgttccttcttctcataactgtgatgttcctcatgtcaatcgcactgactaccagcttattgatatctcagaggatggatttgtgagtctgctgactgagagtggtggt

SEQ ID NO: 2317 - DNA, 292 bp, Cicer arietinum
ctcaaatgaactgtatagtattaaggtctatgcacctctatcaagagatctatgtgcaagttgtagaaatgaattatatacccaacgcttccatccttagttcatcatgtgtgaaattaatcattaaagaccaatgcttttcccttgtcgtccaagctcattacgagatatatccatgacatgtagagcagaggttctgagttgcttaaaagagagcaatggcaccgaggacggcgaggacgccggcgggggcaatgcgaccggcagcagcggtgacaacggcagggttggt

SEQ ID NO: 2318 - DNA, 276 bp, Cicer arietinum
tttggtcaccttctcggtcaacgaccaatttcgctgactatggtagcaaagaggaagcattttttgattccgaaccttggatagactcagattgggaagatgatttctatagagacaatggtgactttacaccatctagaggtaacactccaattcaccacaattttgggaccccaaatgtgaataaaatcttttctcagaatagaacttctgattctccatctgaatcatcatcaccagataagaaaaagaaactgttagagcttttcaaagaaa

SEQ ID NO: 2319 - DNA, 204 bp, Cicer arietinum
gactctcttaaggtagccaaatgcctcgtcatctaattagtgacgcgcatgaatggattaacgagattcccactgtccctgcctactatccagcgaaaccacagccaagggaacgggcttggcggaatcagcggggaaagaagaccctgttgagcttgactctagtccgactttgtgaaatgacttgagaggtgtaggataagt

SEQ ID NO: 2320 - DNA, 393 bp, Cicer arietinum
acaagagatcaaggctatctagaaacaggaggactgtgaaccgtgcttatggtggagttttatctggaggtgctgtcagagaaagaatcattcgagctttcttggttgaagagcagaagattgtgaaaaaggtcttgaagatccaaaagacaaaggagaaacaagcttcaaaggcttaagtttcaagaaaagagataaagatctttttggagggattttaggtttgagtcattatagtaaaaaacaaatttattagaactgttgttcccttgttaattttgtgctcatttggtttctttgaactcattttagtgcaactgttagcctattatgatacagctttgttcgggttattgatattttcatgttttcttatgaatatatgaattttca

SEQ ID NO: 2321 - DNA, 174 bp, Cicer arietinum
acattgccttagaaggcctagacattgtgaacacagaaacaatgcaacctgttcctgctgatggtaaaactgttggcgagatcgtgatgcggggtaatgctgtgatgaaaggctacttaaagaaccctaaagctgatgaagagtcctttgctaatggatggtttcattctggtg

SEQ ID NO: 2322 - DNA, 376 bp, Cicer arietinum
ttatttcattaggaactggaacagcaaaaaatgaggaaaaatttagtgcagatatagcagcaaaatgggggttattaggttggctaacaaatagtggttctaatcctttaatcgatgtttttactcaatcaagtggtgatatggttgattttcatttatcttgtgtcactcaagctcttcattcacaggataattaccttcgaattcaggatgacacattgaccggagatgtttcttccgttgacattgctacggaagagaatttggagaaactgtgtgaaattggcgataagttattgaagaaacctgtttctagggttaatttagaaaatggtcactttgaacctgtgatcgatggagaaaccaatgaacaagc

SEQ ID NO: 2323 - DNA, 428 bp, Cicer arietinum
acatggtcgaaccttctggtgtctcctacaggtattttggtgctgcaattgggaagggcaggcaggctgctaaaacagagattgaaaagttaaagcttgccgatatgacctgccgacaaggagttattgaagtagctaagattatatatggagttcatgacgaggcaaaggataaagatttcgaactcgaaatgagctgggtgtgtgaggaatcaaaccgccaacacgaaaaggtcccagaagagcttctacaagaagctaaggcagccgcaaaagcagctcttgaagaaatggatgcagattaaaaatgtttatcccaaagagatgtatttcataaacttgtaatagagagcattttggaacatctatagaaaatattcataggcttcaaaaattggatttttgcatgtttcttgatgattcaatgc

SEQ ID NO: 2324 - DNA, 404 bp, Cicer arietinum
actttatgtaactccattccaagttgtggcgcttctcaccggaatttatgtgttgcgacatccggggtttcgtcacaagcttccttcagtgccgctaaatttcttccggaggttgcctgcaagaactgattgcatgctttgagaatcgaactcttttgcattttgatggaaggcttgagtggaatgtgcagaaaagaaaaacaaatggagcttggtttgttatttttatatcattgttcaccaccatattttgtggatttgtagtttcacttattattatgtcatagtagaattttctgttttgaacttatggtagtccattgttaaaatttgtaattttgtagggtgagttgaaattaatttgtctttaatcaacttcatgtttaattagatgctgcaaattt

SEQ ID NO: 2325 - DNA, 434 bp, Cicer arietinum
gaggttttgagtcgtcgaagaaaccctttcagcgagtgccgccgccgcagacctcttccctgcagcaccgcattcaacatgtctctcgtggcaaatgaagaatttcaacacattcttcgtgttttgaacacaaacgttgatggcaagcagaggataatgtttgcccttacctcaattaagggtattggaaggagatttgctaatatttgctgtaagaaggctgatgttggcatgaacaaaagagctggtgagcttagtgctgctgagttggacaatctgatgactgtggttgccaatcctaggcaattcaagattcctgattggtttttgaacagaaagaaggattacaaggatggcaagttttctcaggttgtttcagattcattggatatgaagttgagggatgacttggagagactcaggaaaatcaggaa

SEQ ID NO: 2326 - DNA, 207 bp, Cicer arietinum
acgagtcttctcctgccagcaccatcgtcgcttaagcgaacacatgacgaagaatggccgcattgagttggtggtgatggtttcccggggcacggagttaggggacaaacatggaaaaaattgcatttagagccatgatgctttctgccccctctgggaggatcaacagcgacgtcgaccgctcaaatagaaagctcttcgaccgcc

SEQ ID NO: 2327 - DNA, 389 bp, Cicer arietinum
acttggttaatatgactgaaaaagattaccaaagaaaaaagaataagtttctgcccaaaattcatgcatgggtccaggaacatggaggtgggcaaatgattcctttcagctgtgtcttagagaagaatctttcagatatgcctcctgatgaggcagctaaatattgtgaagcgaacaacgttcaaagcgctcttcccaaaataataaagactggattttcagctatcaatctcatttactttttcacagcgggacctgatgaggttaagtgttggcaaattagacgcctaacaaaggctcctcaagctgcaggggctatccatactgattttgaaaagggatttatatgtgctgaggtgatgaagtttgaggatctaaaggaacttggt

SEQ ID NO: 2328 - DNA, 441 bp, Cicer arietinum
acttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctaccttgatagagttgaggttattgctgaaaacaaagataaatgggatatgcatcgttgctgttagctactagtatggtgattatcacagcttctttgagttgtcttgtaactttgttgttgtttatagtggataagaagag

SEQ ID NO: 2329 - DNA, 270 bp, Cicer arietinum
ctcaattccatcctattagattttcacttgttaaattcaaccattttcatctctcttgaattcttcattcatcaactttgttaaccatgtcgaatactgctggtcaggtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaagggtcagactc

SEQ ID NO: 2330 - DNA, 309 bp, Cicer arietinum
tacactcttcactcgcgtagcagcggcatcaactagtctcaggaggagaaaaatgtctcacaggaagttcgagcacccaaggcacggatcattgggatttctcccaaggaagcgtgctgctcgtcacagaggaaaagtgaaggcattccctaaggatgacccaacaaaggcacccaagcttactgccttcttgggttacaaggctggtatgacacacattgtcagagaagtcgagaaaccaggatccaagcttcacaagaaggagacctgtgagccagttacaatcgttgagacccctccgatgattgt

SEQ ID NO: 2331 - DNA, 434 bp, Cicer arietinum
actatctattgagcaaccaaaagacaatggagccaataagaaactatggaagaatattacataagaggaccagttcaatatgtggtagttaaaactcaatgttcaaattgcagcattttaagagcaacaaccaccatcttgtgatgcttgaggttcctgtttttgctttaaaatattccttttcactgatgttgatccttcttccaaaagactaggaacttccattatctttagtgcaagttcttcgaaacacttgtctacattttctcgagttttggcactgcattcaaaaaacaaacatccaaactctttggctagagctaaaccctcttctgtgctcacaaccctttcagagtctctatcaactttatttccaactagcatcttcacacaattctgattagttgaataaagttccacttctttggaccaca

SEQ ID NO: 2332 - DNA, 351 bp, Cicer arietinum; identical to SEQ ID NO: 1179

SEQ ID NO: 2333 - DNA, 427 bp, Cicer arietinum
acaagcaagcttctcggccgctccgccgccgtgcagcaacgccacaagaagcgcccctcaacacagggtgcttccgaggatgctcagaacattccgtccaacatcaaaggacccgaacagttcgtttttgaaggccgccgtgcttcagctaaggacggcacacccaaagatctcaaacttggtaagaagggcaagggtaagggcaggtccagcaggccccaaaaccggggcgcaaggagagctgccgagtggaagaagaagagctgagcgttttatggtgaatagcactcatatcgctagtggttggcatatgggatgtgtgctcttttcatacgtgagatgaggacgaggatggtgttaaaaaagagggccccacgccccggaaagtttgcgagtgatttttcggccttggctgccctggcaagtt

SEQ ID NO: 2334 - DNA, 256 bp, Cicer arietinum
acttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgtggcaac

SEQ ID NO: 2335 - DNA, 242 bp, Cicer arietinum
acattgccttacaaggcctagacattgtgaacacagaaacaatgcaacctgttcctgctgatggtaaaactgttggcgagatcgtgatgcggggtaatgctgtgatgaaaggctacttaaagaaccctaaagctaatgaagagtcctttgctaatggatggtttcattctggtgatcttgctgtaaagcatccagatggatacatagaaattaaagacagatcaaaggacatcatcatctca

SEQ ID NO: 2336 - DNA, 278 bp, Cicer arietinum
gcaaattgtgttgtgagtgattttatctttgtcttttgagaatatgtctggctgcaactgtggaagtagctgcaactgtggtgatagctgcaaatgcaacaagaggtctagtggattgaactatgccgaaggcggcgaaaccacggagacggtggttttgggcgttggtccgacgaagattcagttcgagggagctgaaatgagtgttgcagctgaagatggtggctgcaagtgtggatcaagctgcacatgtgacccttgcaactgcaagtgaggtg

SEQ ID NO: 2337 - DNA, 439 bp, Cicer arietinum
actattttgatgcttacatcaaatattctgttctatcttgtacaaaccattttgcttttgcacgacagaatgctcctctgttagtatatctagaaatttataacgctactcctgaattgctgcagtgaacaaaaaaggagatagagatcaccttgttggagatgatgtcaagggataactctcctaaaaacctacggaattaggttgttaggcccaggaatgaacgtaaaccttttcactgatggatggactttgttaatgaaatcctaatcaatcattagatttttctagatccctttattttattttattttgacttgtttgaaatggatgcattggtgaaatcacgattcaggattgaaacaagttcattatacaacattagtgtctgatttcagagagaaaataagaggacgtgatagaatatgagagaaagtac

SEQ ID NO: 2338 - DNA, 283 bp, Cicer arietinum
gatttcgagcgggccgcccgggcaggtactgttaaaaggactatggcattacatcttcacatatagactttcttggacacaggaggcaaaaaaactgtggcctagaacatttcaatgaagaaagagttcactatgcccttatacagtaagagaactgattcaatagataccgcctgatgctaaaagccgcaaggttttaatttgtaaatttgaggagattgtattgcacacttggctattggagtgaggggcactttcataaacaaacatggggagggatgag

SEQ ID NO: 2339 - DNA, 170 bp, Cicer arietinum
actccacttagacggcttttcttacaacaacagaagccgaggaaaagttttgtagttgtaaatgctgctacagtttcaactggccaggaagccccggttcagactagttcgggtgacccttttaaaccaaagcgagttatggtcattggtggagatggatattgtggttg

SEQ ID NO: 2340 - DNA, 256 bp, Cicer arietinum
atggaatctttattgtttatgatgtgacagatgaagagagcttcaataatgtgaagcaatggctcagtgaaattgaccgctatgccagtgataatgttaacaagctcttggttggcaacaagtgtgatctgacagcaaatagagctgtgccatatgaaacagctaaagcatttgcagatgaaataggcataccttttatggagacaagtgcaaaagattctacaaatgtcaaacaggcctttatggcaatggcttc

SEQ ID NO: 2341 - DNA, 224 bp, Cicer arietinum
gatttcgaggcgggccgcccgggcaggtgtcttttagcatggaaaccagttcataatggagacaatgatatttattggataacagaggaaggagtgattgtgatggatgttgacaaggaaattattataagagaatatccactcccccctcaaccagtgtatacttttccagttgcagtttatttatggacgggagattgtctttctttctttatggatgaaaa

SEQ ID NO: 2342 - DNA, 334 bp, Cicer arietinum
aaaaattctttcttggcacgcactgttagtgccgtgttaggagcgggattttctgcaggccacgcgaccacacaaaactgcggggatgctatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccg

SEQ ID NO: 2343 - DNA, 414 bp, Cicer arietinum; identical to SEQ ID NO: 1906

SEQ ID NO: 2344 - DNA, 331 bp, Cicer arietinum
acggattctgtgtgagcacctgtcgtttcctaagctcctgatccctcatcttcatcttcatgccatccgggggagacccgtagaccaggtgattacgatcaaatggagcctccaacatcaggccctcgagcgtttccacgcgagagacagccacgtagcttaaaccagtctgaaagtcctggcaggagagatccgtaacgatcatatcttctgtgatgctttgtgacttgtgcacggtaatggcgtagcatacgatcaggggaaactgcgtgcgagcgcagaaagtggctccgatgaggaagtccctctcaactgagagaatcgggacaat

SEQ ID NO: 2345 - DNA, 345 bp, Cicer arietinum
caaccgatctcatggctccaaagaaggataaggctcctccaccttcctccaagtcagccaaatctggtggcggcaagcagaagaagaagaagtggagcaagggaaagcaaaaggagaaggtgaataacatggtgctctttgatcaggctacctatgacaagctcatatctgaagcacccaaatacaagctcatcactccttcagttctctctgatcgtttgagggttaatggttctcttgcaaggaaggctattagagatttgatggctagaggtttaatcaggatggtatcttcccattcaagtcagcagatttacaccagggctacaaacacctaagtgtagt

SEQ ID NO: 2346 - DNA, 203 bp, Cicer arietinum
accttcagcggacttgaggatggcggcttggttgtcaacgatgctgatcatcatgacatagttgagaagggcaccaaggatacaaccaatgacctgagtagtgaaggtggccttgggagagagcttgttctgctgagcgagcttcaggtcacggaggaggaggaagccctggctgagagcgttgtaggtgtacgaagtaaagt

SEQ ID NO: 2347 - DNA, 317 bp, Cicer arietinum
actggtgcacatcgtttttcttatgcttgtgtgtttccctgaacttattatgccaacagtgtttctatacgtgtttgttatcgggatgtggaactggagattccgcccgagataccctcctcacatgaacaccagactctcttacacagacggagtgaccctagacgagcttgacgaagaattcgacacatttccttccgcaaagagccctgatatagtgcggtggaggtatgatcggttaagaagtgtggctggaagggttcaaagcgtcgttggagatttagctactcaaggggagaggatccaatcacttgtga

SEQ ID NO: 2348 - DNA, 158 bp, Cicer arietinum
attcgtatcctcagttggaagaaaaaaaagtgtgtggggtgaagattgtatggagtttaaaccagagaggtggttatcggttcagggagaccggttctaaccgcctaaagatgggtataagtttgttgcgtttaatgctggaccgaggacttgtttgg

SEQ ID NO: 2349 - DNA, 395 bp, Cicer arietinum
aaggtacaaaaacataaagcaactactatatagcataaagaaatacacatgactcatgaagaaacaaatgcttatatactactcaagaagatgccaagattttttcaaaaagaggcttcaaaaaagccacgaacttctcttggtgaggggtattttctttgatgacttgaacatccttgaaattattaaaccataaatgcaaatgggggaacctctcagtttgcaaaatttccacttcaaatgtattttccaaaacctcaataaatttgacaaaagatccgagagctatgtctacaatgttaatgttgtctcctccataaaatttattttcgactttcaaacattgatcctcaacaactcctaaccgttcccatagattctctttggccttctct

SEQ ID NO: 2350 - DNA, 320 bp, Cicer arietinum
ctaataaaccttttgaagatggatcttgaagagtgggaatcaatttctgatgatggctattttgatttcaatgaagatggtgagaaaaaaaaattcttagcaaaagggtcagaaaatattttagacatggaggattatttgtatccatcatcaccaccaagaaaacacaaccgacttgtccctttacaaattccattggaaataaaaattggtaacacttcaaatgatgttgttttgttgaaagacatgacgaagaatcaatcttttgaggttgatcaagaagaaagtgtgtcacgagtttttttaagattaaggaaaat

SEQ ID NO: 2351 - DNA, 404 bp, Cicer arietinum
cttaatttcctatttctaagtatagagtgaattaatgactactagtgcattttcatcattgaggggttcaaattcaaaggttagatcattggggaagtatagttcgaagcaagttcgacaacagagggcgaggatttacataatatggagatgcactgttttactattgtgttggaacgattaagtgtgtgtttggttatgcgttagagttatggttctgcgcgatttcaaagaagctacaaaacttactatatctttgaaaataaagaaagagatgtgtgtttgcctaacttttgaatttggagcttcacaaattcacgccaaatcttgccttgagatgcaagatacgcatggttgcggtgaaaccaaacacaatataagcttttacttggatgcggaaaatt

SEQ ID NO: 2352 - DNA, 436 bp, Cicer arietinum
caaatacattattcacaatgggttggttcgataacaacagcgaagtcgagcagcagttcaacgactacaaccaacactcccaaaatcaggaacaccacgccaaactttcccatgaaataatcggtggtgccgctgcctatgaggcagccaaggcatacgaggatcatgttgccaagaatggcaagccagatagccatgcccaggccaaggaattcattgtcggagctgttggtgctttcgttgaacgagagtttgagaccaagggtctggacttctttgacaaggaggaggccaagcgccgaggtgaacatcgagcagaaagggagcttgagcgtcaatactagatctgtatcagggttctttgggagcaaataaatatgatgaataatgaaccatgcgtggaccaatgcttagtgttaccctgtgagatctgaga

SEQ ID NO: 2353 - DNA, 122 bp, Cicer arietinum
acccctgttgagccctactaaagctttgaaattggaacaagcggatatcaaacctgagtttgagcgatgagatttggctgcggggttttggttaataaattatagttagaatactagtcttg

SEQ ID NO: 2354 - DNA, 462 bp, Cicer arietinum
gatttcgagcgggccgcccgggcaggtacatctgttggagaagagctttgaggaagagaacaaattggagccagagagaaagacccaattggccaagaagctagggttgcaacctaggcaggtggcagtttggtttcagaaccgtagggctaggtggaagaccaaacaacttgaaagagactatgatgttcttaagtcttcctatgattccctactttcaacatatgattccattgttaaggagaatgagaaactcaaatctgaggtggtatccttaaatgagaagcttcaagttcaagctaaagagatgctaggagaacctttgttagacaaggaagctaatccactaccgatcgaaatagcacaaattttcagcatcaaggtggatgaccacatgagtgctggaagtgttggaagtgcagtggtggacgagggtagtccccatgtcgttgttgacagtgt

SEQ ID NO: 2355 - DNA, 441 bp, Cicer arietinum
accttgatctggctcaacgtagacacactctcttgcttctctcgcggaaggccttgtaaaatggtgtttcatcaagccgataatactctcccaaaactggttttattgacttggtagcctccattgcatgataatgtggcattgtggagaacaagtgatgagccacaagagtgtcagtaatattatggaagaccttgttcaggataccataatccctgtccactgttgctaaagctcctctcaaccagtcccactcagaggaatcgtaatgtggcaacgcagggtgagtatgctgcaaaaatgtaatcagcaccaagaatccattgactactagcagtggaactccataaacacacacaacccaggcaagtcctttagccatggcgagaagataaagcccatagcatactgcaaggattcctgcatctgatacatatattt

SEQ ID NO: 2356 - DNA, 420 bp, Cicer arietinum
accttgatctggctcaacgtagacacactctcttgcttctctccataatgccttgtaaaatggtgtttcatcaagccgataatactctcccaaaactggttttattgacttggtagcctccattgcatgataatgtggcattgtggagaacaagtgatgagccacaagagtgtcagtaatattatggaagaccttgttcaggataccataatccctgtccactgttgctaaagctcctctcaaccagtcccactcagaggaatcgtaatgtggcaacgcagggtgagtatgctgcaaaaatgtaatcagcaccaagaatccattgactactagcagtggaactccataaacacacacaacccaggcaagtcctttagccatggcgagaagataaagcccatagcatactgcaaggattcc

SEQ ID NO: 2357 - DNA, 293 bp, Cicer arietinum
ttccagcggccgccccgacaggtcgctttgctagggtagagaatttttgcaggctaaaatggcagggggggcgggggtgaagctaacgggaccctaacagctgcctgaagaaagggattcagagagttgacctttcttcgcgaccagtgtctgcaacgacattgagcttcgcgagctcttgacaccgccttcgggcgctacttctcacgtgttatttgcggcttcttcttaccccgacattccggcttcgcgagccttcaacaatccgggctctgcgcccctcgacttcccgt

SEQ ID NO: 2358 - DNA, 126 bp, Cicer arietinum
gattccttcccgaggtttttccctgccgccgcgacagtcgactacgagctacaacttggttactggagattgtggactgcgtcagcagatgtagtgatgcgcgagagaattctggtcggtggaaaa

SEQ ID NO: 2359 - DNA, 284 bp, Cicer arietinum
tagcattaacagcgaaatcgaaaaatgagaaagttcgatccatggcccgttttcttcaagcgagaatggaaacgtaactggccattcctcgttggattcgcagtcaccggagctgttatcaccaagttatctcttggctttaccgaggaagatgctaagaattcgaaattcgttcaggcgcacaagaggtaatttcggaatggggacactgcactggccttgcacctcatgttagttgtgtcaagattacttgtcttgattttttgcattgtaataacagaaga

SEQ ID NO: 2360 - DNA, 276 bp, Cicer arietinum
cgggatcatggacttcctgcctcagggtatggaaagctactcgatctatctgtgcaagagaattctaggctggagaggaatagttcccgctgacgggatgacctcttgaaagtaaagcgcctttgtgccgatgatatgctggatgaactagatagaagcgttgctggagggaagctctgctgagatcaactgtattgatgtccgtgggacgtgcttcaccgacaactactgtagcgctggctacgagtagagaggtgcctcttggaggtaatgagt

SEQ ID NO: 2361 - DNA, 437 bp, Cicer arietinum; identical to SEQ ID NO: 1334

SEQ ID NO: 2362 - DNA, 212 bp, Cicer arietinum
gtaaaaattctttcttggcacgcactgttagtgcactgttaggagcgggattttctacgggctactcggccacacaatactgcggggacgccatcggttccctaacagcagttttcagagaaggaattttggagagttcaccttctctgacaacacctttgtcggatctaatggcggcacctcggaaccggaacgccttatatatcggagga

SEQ ID NO: 2363 - DNA, 188 bp, Cicer arietinum
acagagcttacctggagaccgtgaaatgaggctactacctcgtcgggggagcagcgttctggccgctttggagttttctcctgcaagggttttccccaaggatgcacggttctagggttgcagctactggcgatctttggggatcatggacttcctgcctcagggtatggaaagctacttgatctatc

SEQ ID NO: 2364 - DNA, 224 bp, Cicer arietinum
acattcttcaacccactttcccctggtgtggaccccacaatggacaaaactttagcaaaaaaccttaaatcgacttgtcctaatgcaaattcaggtaatgttgctaatttagacattagaacaccgacagtgtttgataacaaatattatcttgatttgatgaataaacaaggtttgtttacatctgatcaagatttgattaatgataagaggacaaaagggtt

SEQ ID NO: 2365 - DNA, 283 bp, Cicer arietinum
accttgtccctgctgatctcacagttggacagtttgtctacgttatccgtaaaagaattaaactaagtgcagaaaaggcaatctttatttttgtggacaatgttcttccacctacaggagcaataatgtctgccatatatgatgagaagaaggatgaagatgggtttctttatgttacttacagtggggagaacacctttggggacctgatttcctagtatcatagattaacagtatatcatatgtcactccctcattggcttgtttataatttcacaatggt

SEQ ID NO: 2366 - DNA, 348 bp, Cicer arietinum
accacaattcaggccttcaacagtgaatccagcttcacactttccctcggccgacacacagaagagttcaagtggaactaactcgtctactgagaaaagtgtgaacaaagtggtggataatagtaacaaggaagtaaaaggcaaagaagagaataagaagacagaaaatgcggtgtcatcatcatcatcttctgaaaagccaagtggtgttgtaggcgatcctctaggggatgcacgcaacaaggttcaagatgagattattaaagagtttgcttcaataatggcaagtggaacaatgcgtgctagtgaggctgcagcacttgctactagaagagttatggaaagata

SEQ ID NO: 2367 - DNA, 123 bp, Cicer arietinum
gatttcgagcgggccgcccgggcaggtcaacgacgccgattgcgatgggtttttctcctttgaaggcaagccgcaccgtcggcctctgattccttcccgaggtttttccctgccgccgcgaca

SEQ ID NO: 2368 - DNA, 219 bp, Cicer arietinum
cactcactggagtccttggcaccgtgaaaaacccatgggtgtatatttctggacctacaatcaatccaactggcttagtttatagcaacaatgagatagaaaacattttgagcacttgtgctagatttggtgccagagttataattgatacttcgtcctctggtttggaatttgactgtaacggctggggtggctgggacttggaggggtgtttgtctc

SEQ ID NO: 2369 - DNA, 404 bp, Cicer arietinum
cttcactggtgccccaggaaaatatgttgaattgaaggagaacatcactagtttccagggtgtgttggatggcaaatatgatgacctttcagagcaggcattctacatggttggtggtattgacgaggtcattgctaaggcagagaagattgcaaatgaatcacatgcctcagcttaatcacaattttattatcctttctctataattgctaaatttaataatttaggaactctttcttggcaatgccaaacaacaaaattttccgttattaaattttttataatttgaatggtcattcctttcatttgagtgttgttgccgacggtgagatgaaccaagttctttggtcaactgcccacttttttccgttgtgttatttaataagtggaagaggcaagaggat

SEQ ID NO: 2370 - DNA, 307 bp, Cicer arietinum
gtgaaaccaagtctcagaaggactttctagaaatgtctggaactggaaagggtaagaagagggaggaacacgacaacgcttccgatggcgactctgaagctcacgcgcctcccaaaaagaccctaaaaaaagattccgacgataactctgacgaaatcgttgtttgtgagatagggaagaacaggaaagttactgtgaggatctggcagggtaagatttgggttgacattcgtgaattttacatcaaagatggcaagcagttgcctggcaaaaaaggtatttcactgtccatggatcagtggaatgt

SEQ ID NO: 2371 - DNA, 119 bp, Cicer arietinum
acgtttgggaagcggagatccacacaagcacttattatgaaaataagaataaatatcaaaactttgcaaatctccaccaaccggaatctgaccacacaacctattgtaactcacgttca

SEQ ID NO: 2372 - DNA, 144 bp, Cicer arietinum
ccaagttggtcgacccattggcaactacggcttcatgaacatcactaccactagtgccccaaacactggtggattgaaaactcaagatgttgaagaaggcagcgtcagcatcagctacgttgcaggctttatgaaggcagggtt

SEQ ID NO: 2373 - DNA, 384 bp, Cicer arietinum
agaaagatacaagttattcaatattcagtagtagtaacttagtagtgaatactaaaaaatttatttaacaaaaaaaaaaaagaataaaagaaaaagtctatgttaatgttaattattaattaacgatcatgatcttcctcatcatcatgttcttgcagatctgtatgagaaaaactccttgacttgaaacttctcaatctaagcctcatttcagcagcataggattgacgaaactccacttgatcatcttcttgtttcttatcctcagccaatgaagaggaagaagaagacgatgaagcagatggtacttttctaaccttttcttcttcatcgttataatcataataatcatcgtcgccgtcatcgtgatcctcattcaatggc

SEQ ID NO: 2374 - DNA, 429 bp, Cicer arietinum
tccagcgtggtccggccgaggtacaaaatctacaagagttcgaaaaaaaattctaagctaacatactaatgtggctaaagcattccactaggaataaatggattcaaaagcaagaaaacaacatttcatattagaaaagcaaaacaattgttttatatgactgacatgtccggtatttcggctgatagaagcatgctcttttagaagtgtatgctgttcagattcggcaccctcttccaagtctaatctcgtccaatcaaattctttaaaatcatctaaaagtgaagcatgttctttcttagctcgaagacttgagcgaagacgataaaacccctgcgtgatatcttgaagaacttcttggtgtctagtcaaagtatgagaaaccatatctgaaccaccagaggatacccaagcttgcatctgtgagtt

SEQ ID NO: 2375 - DNA, 372 bp, Cicer arietinum; identical to SEQ ID NO: 1107

SEQ ID NO: 2376 - DNA, 405 bp, Cicer arietinum
acatttcccattggcgttcttgtgtcgaatgtctaacaacttcggccgagaaaatgaatactcccaatgcttttaaggccaatgtaacatcatagaaaactcgaggccttcccgttccggatagttctacgggattggcaaccagtagttcgatatctggaccgcggttcactataatcacccgcaaaggatgaagcatctcttcttttaagcacgaacacagagttttctgacgttcgggatctatgatctttttcccgtcttctttttgctgaacaaataagtcaatgttttgaaagcctttcacacttgaagtgaatctaccataagcaaccttaatatcagaatccttagaaatcctcataatgtcataacacaagcctttctgatcaacacactgtatct

SEQ ID NO: 2377 - DNA, 184 bp, Cicer arietinum; identical to SEQ ID NO: 595

SEQ ID NO: 2378 - DNA, 387 bp, Cicer arietinum
actccttaactttctttttcgctaattttggtccaaatgctaccacatttgttgttccggctgagattttcccagctaggctgagatcgacttgtcatgggatctcagctgctgcgggaaaggccggagcaattgttggtgcatttggattcttatatgctgcacaaagtaagcataaaaatgagactgatgaaggttatccaactggtattggtgtgaagaattctcttattatgctcggtgttgttaacttcctgggaattgtattcacctttttagtgcctgaagcaaagggaaaatcattggaagagatgagtggggagaatgaagaagatggtgatgaggctatagaaatggcagggtctgctaggacagtacctgcccggg

SEQ ID NO: 2379 - DNA, 392 bp, Cicer arietinum
actacaaacgtgaagacctcacgaaagaggttctgattgatggatggttccatacaggggatattggagagtggcaacctaatggaagcatgaagattattgaccggaagaaaaacatattcaagctttcacaaggagaatatgttgccgttgaaaacctggagaatattttcggccaagttccttctattgaatctatatgggtttacggaaacagttttgaggccttccttgttgctgttgttaaccccagaaagcaggcacttgaacattgggcagagcaaaatggtatatcaatggacttcaattctctgtgtgaagattctagggcaaaaggttacatacttgaagagctctcgaagattggaaaggaaaagaagttgaaaggcttc

SEQ ID NO: 2380 - DNA, 346 bp, Cicer arietinum
acaaaaaaagaacaacaaacacccaaaagctgccgcgaaacaagggtgattcagcgtctatcagaagccactgattcagcagagaagagatacttcactcgtgaaagaactgaatcatgcgcgggatcataagggtggtctttggatgggatttcaagtattgcaggaacaggcttgttataactatcaaccaaaaaccttatcatatttgcaacaaattggctaatcagcacaatagcaatatcctcccttgttgtgaattctttgaatgcatcctcgatttgtttgacagttgtttttgaatccacaatgaggtaatttgtcttcctacgtatgtcaacgtttc

SEQ ID NO: 2381 - DNA, 429 bp, Cicer arietinum
aaaaaagaatgccagagaagaagctttcaagagcatcccaagaagatcttattcaaaaaaaatgggaaagaagagactacttaggtgttcatccacaaaaacaagagggtttaagctatgttggtattcacattccagttggtagaatccaagcagatgagatggacgagctagctcgtttggccgacgaatatggcacaggggaactccggctaaccgtggaacaaaacataataatcacaaatgtagaaaactcaaaacttaatgcattgcttcaagagcctcccttgaaagacaaattctcaccttcaccttccatactaatgaaaacccttgtggcatgcactggtaaccaattttgtggacaagctataattgagacaaaagcaagggctttgaaagtgactgaagaagttgagagacaagtgg

SEQ ID NO: 2382 - DNA, 310 bp, Cicer arietinum
tcaaaatttactagacaatcagctttctattcttggtctaatcctaaatgcgtgcctcttttgccattgaatgaggatcacgatgacggcgacgatgattattatgattataacgatgaagaagaaaaggttagaaaagtaccatctgcttcatcgtcttcttcttcctcttcattggctgaggataagaaacaagaagatgatcaagtggagtttcgtcaatcctatgctgctgaaatgaggcttagattgagaagtttcaggtcaaggagtttttctcttgcagatctgcaagaacatgatgatgagg

SEQ ID NO: 2383 - DNA, 206 bp, Cicer arietinum
accacctatcacgggtcagtacagtttaccgaggtgtcacctatcacgggtcaacacgatttactaaaagaaaaggcgtgaatcgtaaacgtaccgcctatcacagaccaatactatttaccaatgtgccacctataacagatcgacgtgatttactaaaaagcgtaatcgtaagtgtatcgcctatgacagaccagtaatattta

SEQ ID NO: 2384 - DNA, 404 bp, Cicer arietinum
acaaaaacgagaaccacagtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacgtgagtagcgagaaccaccatcaccaccaccatatccacgatctctgctaccaccataaccaccaccacctcctccgccatatccacctccaccaccatatcctccaccgccacctctgttatatccaccttcacgacgtccaccaccatatccaccgcctccaccatatccaccgccaccacggccgcctccaccaccgctaccacgagactgagcttcgttcacggtaa

SEQ ID NO: 2385 - DNA, 164 bp, Cicer arietinum
cttgcctcttatccagatccatcactcgatctccatcagtcatccaagatgcccgccgccatggaacccactcagcaagcccccatgacctctgacaacggatacatcgtcacacagcagcctagcgctgaacctcagcctgatatgaccatgcgtggtggtga

SEQ ID NO: 2386 - DNA, 405 bp, Cicer arietinum
acaaaaacgagaaccacagtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacgtgagtagcgagaaccaccatcaccaccaccatatccacgatctctgctaccaccataaccaccaccacctcctccgccatatccacctccaccaccatatcctccaccgccacctctgttatatccaccttcacgacgtccaccaccatatccaccgcctccaccatatccaccgccaccacggccgcctccaccaccgctaccacgagactgagcttcgttcacggtaat

SEQ ID NO: 2387 - DNA, 460 bp, Cicer arietinum
accacagattttggaatgagctttccaatcagattgaacagcatatttcttagaacacttatcacatttccacttcttctcaccgtgctttctacaaaagtgctttttaatgccagtaagatcaccaagggctcttgctggattgtgatgaacacatgaaggttcagggcaaacataaaccctctttcgtatttctgttgtagttctctgtttaagcttccaaggcaaattgtgacctcttcgatgcagttgaaggttttgatctctttgaaaccctttgttgcatatttcacatacgaacctgtttgttgccattagtgttgttggtgatagagctatcacttcagtacttggatctggatttcctggtaggttccttttcttcttaagaggtggttgtaaaattgtgttggaaccgttgctattattatttgtagttgttgttgaagtatgagaatgt

SEQ ID NO: 2388 - DNA, 298 bp, Cicer arietinum
accgacgaaatggtgtatgggctgtcccttgatagagaatcttgactggttatcattgatcatgacacccctatctgtgttgatcctaagaagatcacacaagttgctttcctcagacttacaatgtggacattccccacactccccagtgaatacaggcagagcatgatcccctggttccagatgagtcacaccctcccctacgctccccacaatccctccagcttcatgaccaaatatacgaggaaacagtggagtctgacccttagcttcccagaagtaaacatcagtgtgacaa

SEQ ID NO: 2389 - DNA, 403 bp, Cicer arietinum
accgagtcagagaagaagttggatgggaagtattttgttcggttacaagaccgcgattggtattggagagcttttcttcccgaaggcgaagatagagaccatccagcttgtaatccattcggccctaaaggtaaaagcctcgcaggactcaaattcgccaaaagccttgtttgtgtggctggtttggatcttctccaagattggcaattggaatatgtggaaagtctaaaaaattcaggacaagatgtcaaacttctttacctaaaggaagccactattggtttctacttcttgcctaacaacgatcatttctattgcctcatgaatgagataaacaccttcgtccatgcatcctaattgttgatatatatatatatatactaccactacttaacctttgcct

SEQ ID NO: 2390 - DNA, 173 bp, Cicer arietinum
aaatctgtgtttttagttttcaaccaagtaaaaatttggacactaggattttgtgtaagctttctttccggcaacatgattttgtgtatgctttctttctgctctctatgacagaggtctgaactaagagcaggagtcgaaatagcagttgccacccctggaagattcattga

SEQ ID NO: 2391 - DNA, 441 bp, Cicer arietinum
caggtacatacttcatggcattcacttcgaaaacaggcgagaaaactctaagctcaattggatgagcagatgaatgcttatcgtaaattagtttcttctaatatttcgacaaaagctgatgccgcagagagtgatctagagtcttggattgagcggttaataaaataactccatcaagtaaactcacagatgcaagcttgggtatcctctggtggttcagatatggtttctcatactttgactagacaccaagaagttcttcaagatatcacgcaggggttttatcgtcttcgctcaagtcttcgagctaagaaagaacatgcttcacttttagatgattttaaagaatttgattggacgagattagacttggaagagggtgccgaatctgaacagcatacacttctaaaagagcatgcttctatcagccgaaataccgga

SEQ ID NO: 2392 - DNA, 417 bp, Cicer arietinum
actccaaaaaggcctaaactacatggtgggtggtgataacaactctctgacacacaatggaaatcatttatcagcaacaagggcttcaattttgtttacaatgtgagcttcatgatcctcaaggcgacctttgatcgaatcattctcccaacggatcaacgttggcacacctgtgagcttgaacctaggatccaccctccatggatgttttgagttcctccatgttggtctatctccaacataagctttcaaaagtgcaatttcatttgatgatgtttccagcttcttgtagatcacaggctcagctctcacacaatcagggcaccagctgagagaggtagaagggtcgttgtcagccaagaagagaatgaggttggctttgttttggggactctctgatcggaacttctcaaagac

SEQ ID NO: 2393 - DNA, 375 bp, Cicer arietinum
caattaattatatgtgttacttatagtttattgaaataataatttaatataaagagtataaattgttataagacaacttttagatattgaatagcaacatcctgttacataattacaacgtggtatctcattctccttgatgaatgaatttggaaataaagattggaaaatttaatcaataatactaattgattatagttcttctttgactactactgatgtattcactggaaagttgtttctaacccactccacataacctccttccatgttcttcacattcttaaaaccatcagctagaagatcaatagaagcattcagagatctcaccccaatttggcatcccacgataagaggatcttctttgttgcaagc

SEQ ID NO: 2394 - DNA, 438 bp, Cicer arietinum
gcagtactaacaatcctgatccaactctcaacacaacctacttacaaacactacatgcaatatgtccaaacggtggacctggtaccactcttaccaatttggacctaaccactcctgatacatttgactctgcctactattccaatcttaaaattcaaaagggattgtttcagagtgaccaagagttgttttcaaccagtggtgcagacactattgacattgtcaatagtttcaatgacaaccaaactcttttctttgcaaactttaaggcctctatgattaaaatgggtaatattaatgtgttaactggatctcaaggagaaattagacaacaatgtaactttattaatggaaactctgttgaccttgctactactgtgactagagagtcgtcagaagatggcatcgttagttcatactaagtaatttaattagcaa

SEQ ID NO: 2395 - DNA, 293 bp, Cicer arietinum
acttgggttctacgttggactatgtattttgtattgaatactttgcggatggggggatgatatactaatttgtgcttgccttttattttcaggtgttgtgaccattgtttgttggttcagtatggaagcaggggagtggattgtggtgatgtggtaactgctcgagtagatgctgtggcgtagatgtaaaaatgaaagccaaacagaatctttagaccagaaagtagactgaaaggattaggaatagaatggagaattagtgttttttttattatttctagtttataacatgt

SEQ ID NO: 2396 - DNA, 333 bp, Cicer arietinum
acctctttctcccccctgtggaggagcttgatgccgccttgggcacaaagaagtggatggtcaagaagggcgaggccggtgaggcgcctcttgctaagcttgacagcaagatcaagtttgttgggttgaggggaaagaagccatatgtcaagccgactggtggtgcgaagatgaccactaagccacttgaccttatgatggcagcgaatggttgtggcggcggtgcgccggaatggtagagaaaagaaacatagaggatagacgtgcttaagatatcatggttcggcgttggggatataccggaatggtttgggtcattatgagttatgttat

SEQ ID NO: 2397 - DNA, 204 bp, Cicer arietinum
ccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcaccttttgtgccttggtatgctggatggtgaaggaagcggggtatcctgt

SEQ ID NO: 2398 - DNA, 143 bp, Cicer arietinum
actcataaagtaaaagattggaaccttggtgataacaaaaaccatacagcttcactatattccgatgccttatccttcctagagtcgatatttcggctctgaaactattctcaatgttgttcccttccctgttagatgctaac

SEQ ID NO: 2399 - DNA, 405 bp, Cicer arietinum
acacactctccgttgtggcttctgaatgcggcgaaattcccatgactggaacactcattaaaccaacagttccggcaacatagtaacaatagagatataattcgtcgaagtttttgtatcttgacttctttagatccatcctcattccttctatcatatctttaaatggcaggatatcaacaggaaatttggcaaccgtatccgataaagcagcgtcaagcatatcaaacggacgcccttggaaaagttcttccaatctcgattcccacctatccatggcagttggtgtaatatgcgaagcatttgggccatcgacaagttcatctgttctcctacaccacacatatatcgcccatatagctcttcgcctttccggagtcattagaagagttcccaggtaaaatg

SEQ ID NO: 2400 - DNA, 438 bp, Cicer arietinum
acttagtcggataagggcggttcttcctatcgccgctctctcttccgtgaaacattatcatggcatctcaacaagttgttcgtgagtggtctggaatcaatacattcgctcctgctacgcagaccaagttgctagaacttttgggaaaacttaaacaagaggatgtgaactccttgaccatacttgtgatggggaaagggggtgttggaaagtcttcaactgtgaactctatcatcggggaaagagtggtttcaattagtccttttcagtcggaagggccgagacctgttatggtgtcacgttcaagggcaggttttacattgaacattatcgatactcctggtcttattgaagggggatacatcaatgatatggcgcttggaataataaaaagtttccttctggacaagaccatagatgttctactttacgtggatc

SEQ ID NO: 2401 - DNA, 419 bp, Cicer arietinum
aaaaaaaataatgtcagcaatgagaattcacaacgttattttctttgttcttctcttcctttccgtgtcggttttaaccgatgctttgaagaaggaagttcttgttggtgggtggaccccaatcaagaacatcacagacccacacgtggcggagatcgcggaattcgcggtaacagaatacgataaacaatctggtaagaatttgaagctggtgaaagtgatcaaaggtgagactcaggttgtgtctggaacaaactaccgtctattgttgactgttaagaatgaatccgttacaaagaattatactgcccaagtgttggagaaatcttggatccatttcaagaacctcacttcctttaaacctcttcttcttcattgattatgggattgggatgttgtttcttatattaaattatagt

SEQ ID NO: 2402 - DNA, 350 bp, Cicer arietinum
gggttttctcctgcaagggttttccccaaggatgcacggtcctaggttgcagctactggcgatcttaggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctacgagtagagaggtgcctcttgggggtaatgagtacct

SEQ ID NO: 2403 - DNA, 368 bp, Cicer arietinum
actcagggtatgtagcttccatgtttattcaaaaatcaactcatgagacccttctcagaaaaccctgattttctgattgaccaaatataacctggtcaatttggttccttttgtaaagaaccgagaccgtcattcgcgcgaagttttgttcaccttaatcaaggcatgggcgtcactgtatatagccacaatgtttgagaagactgcgaggactatcatgatgacacatagaactttgtctgatttagtagcgatgttgtagcgatccctacatggttgaaaagatggtggaagacatgttaatttagttatcagcaaaaacataaacacaaaggattagacagcaaaactacatcactggacctgcc

SEQ ID NO: 2404 - DNA, 167 bp, Cicer arietinum
acaggataccccgcttccttcaccatccagcatccaaggcacaaaaggcgctgtattttctcgagcccgtcacccgtcagcgggttcgggggcatactgtcgactttttccaccgaccagaattctctcacgcatcgctacatctgctgacgcagtccacaatctcc

SEQ ID NO: 2405 - DNA, 152 bp, Cicer arietinum
caacaaaggaaacaacagaaaaatggttcaaacgctgtcaatgcccgtggcaccttcactctctatcatctgcaatggccatttctccaacagagtttccttccctgttctcaacgctcccaaaccaaaggttcaaagattaagcattgtgt

SEQ ID NO: 2406 - DNA, 102 bp, Cicer arietinum
acagagcttacctggagaccgtggaatgaggcgactacctcgtccacagagcagcgttctagccgctttggggttttctcctgcaagggttttccccaagga

SEQ ID NO: 2407 - DNA, 408 bp, Cicer arietinum
gtatgagcaatgtatagaaagcattatgcctgccaatagattggaagattttgattataaagaactgtctgtggcacttgagcaactctcaaaattcgagaactcggcaaataatagggttgtcgagtcaggggttctcaagggtataaatatagaagatataaagcgtgctggagagcgtttgatccttcaagatggttgcaccgacttttttcggagagttgttaagaatgaaaatttaaatgccaatgtgcatgttctttcatactgctggtgtggtgacctcattaggtctgctttttcttcagctgatttaaatgagatgaatgttcatgccaatgagttcacttatgagggatctgtttccaccggtgacattgtgaagagggtggagtctcctattgacaa

SEQ ID NO: 2408 - DNA, 118 bp, Cicer arietinum
ctttcttggcacgcactgttagtgcactgttaggggcgggattttctacgggctactcggccacacaatactgcggggacgccatcggctccctaacagcagttttcatagaaggaat

SEQ ID NO: 2409 - DNA, 177 bp, Cicer arietinum
acacctatcggcgactgcaatagcatttcagcttctcggtctgttcctccggggaaaggcattgagtctcctcgtgccaaaattgttatgatcattgcggctactgttggtggtgtttctctcattttgattttggttctttggtgttttatgaaacaacctcgggaggccgttggt

SEQ ID NO: 2410 - DNA, 417 bp, Cicer arietinum
actacggccgcttccagccctggtgcgccatcattggtctggtcttccagttctgcgtcgtcatgtgctacggttacaagtcattcaagccctgggatgtcgagagcttcttcaagaactacaccatgcaaatcgtcgccccttgtcttttcatcttctggaagctctacaagaagactcgctggctccgtccccatgaggtcgaccttacctgggagcgtcctatcattgacgcttacgagaactccatcacaacaccccctactggcttctggcaggagatgggaatgctcgttggcatcaagcgcaaggtgcattcggatgagtagaggatgtcactgtttactttatgcgaaatgaataagagacgactgccggtgcaatctacgagttcatagaacatgagatttttctgta

SEQ ID NO: 2411 - DNA, 217 bp, Cicer arietinum; identical to SEQ ID NO: 28

SEQ ID NO: 2412 - DNA, 165 bp, Cicer arietinum
gcactgttagtgccgtgttaggagcgggattttctgcaggccacgcggccacacaaaactgcggggatgctatcggctccctaacagcagttttcagagaaggaattttggagagttcgccttctctgacaacacctttgtcggatctaatggcggcacctcaga

SEQ ID NO: 2413 - DNA, 166 bp, Cicer arietinum
acaatggtataaactgcagagctcaaagtgcttcattgacagattttggtggtgttggagatggaaaaacatctaatacaaaggcttttgagtctgcaattagtcacttgagtcagtatggtaatgaaggtggttctcagctgtatgttcctgcaggaaaatggct

SEQ ID NO: 2414 - DNA, 190 bp, Cicer arietinum
ctacgagctacaacttggttactggagattgtggactgcgtcagcagatgtaacgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 2415 - DNA, 256 bp, Cicer arietinum
cacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcttattcaagggtgatggtcttttcaaggcacttgagggttattgtttggcca

SEQ ID NO: 2416 - DNA, 398 bp, Cicer arietinum
gatttggctagtttagagaaatctaaggctatcattagtaatttgacaatggttccaagtgttggtgatgtatataggaactgtgaaatcaaatcaatagctacgtatggagtttttgtagagatagctcctggacgggagggactttgccatattagtgaactgagttcaggttggctacctaaggcagaagatgttttcaaggtgggagatcggattgatgttaaacttattgagataaatgataagggacagctgcgtcttagtcaccgagcactgcttcctgatgcagatccagacaattcaaattcaaatgctacagcagctttgccagactcagctaataatggtttgtcggatgaagctacaagcctgacaaatgctggtttagttgaagg

SEQ ID NO: 2417 - DNA, 214 bp, Cicer arietinum
gatttggctagtttagagaaatctaaggctatcattagtaatttgacaatggttccaagtgttggtgatgtatataggaactgtgaaatcaaatcaatagctacgtatggagtttttgtagagatagctcctggacgggagggactttgccatattagtgaactgagttcaggttggctacctaaggcagaagatgttttcaaggtgggagatc

SEQ ID NO: 2418 - DNA, 439 bp, Cicer arietinum
actgagacattgtcacaacaacaacccacaagagcttaaggggccccagggctggtatgatcttctaccggaagggacctaagccacccaagaagggtcagcccgagaatgcagtttatgattttgaagacaaaatcaactttgctgttttcccctcccttcagggtggtcctcacgaccaccagattggtgcccttgctattgctttgaaacaggccacgacgcccggattcaaggcatatgccaagcaagttaaggccaatgcagttgcacttggaaattacttgatcagcaagggatacagccttgtcactggaggaactgaaaatcatcttgtcttgtgggatcttcgccctcttggcttgaccggcaataaggtggaaaaactttgtgatctatgtaacatcactgtgaacaagaatgctgtttttggtgatag

SEQ ID NO: 2419 - DNA, 382 bp, Cicer arietinum
actcaatcgaagctacgtgtcacgcgcctaatctcgaagaagtttacgccgagatttttagggttttgaaacccggcgcactttacgtttcttacgagtgggtcacgactgagaaattcaaagccgataacgatgaacatgttgagattattcaagggattgaaagaggtgatgctttgcctgggcttagaagctatagtgatatagctgaagcggctaaaaaagttgggtttgaggttgttaaagaaagggatctggctaagccgccgtctgagccgtggtggagccgattgaaaatgggtaggattgcgtattagcgtaaccacgttgttgtaacggttttgtctgctttgggaatagcacctaagggtacctgcccggg

SEQ ID NO: 2420 - DNA, 295 bp, Cicer arietinum
actcgtgctgcgcatgctcggccttttgcgaggcagtaatcgctcgctggtgggtgaaaccgtaaaagatacccaggccaagggcggaccaccgcaaaacgttcactccggtcgaagccattgggaattagagtcgcaaaaaagggcgaacgggacgaagagcgaaaggatcggtattgacgatagtcggcggtcgacaatggcttgtcaatggacccagtcggagtggctcgaggggattagatgcgtcggcttgaggtgaagaattgaaaagtcgtcgggaaaagtcgaacct

SEQ ID NO: 2421 - DNA, 204 bp, Cicer arietinum; identical to SEQ ID NO: 2397

SEQ ID NO: 2422 - DNA, 203 bp, Cicer arietinum
aaagaaagcgctttcagtgactgagagagtgataaaacgctattccaacatgccgatcagaaatattgccatcggaaatccacaagaggcaactcacccagacaccttgaaagctggtctcgctgagtttatctcaaccttcatcttcgtcttcgccggctccggttcttgtatcgcttacaacaagctaaccaacgacggtg

SEQ ID NO: 2423 - DNA, 413 bp, Cicer arietinum
gttcaccttctctgacaacacctttgtcggatctaatggcggcacctcagaaccagaacgccttagatatcggaggacggtgcccgtggcatcggtagcgacatccttccgatcaacgacgccgattgcgatgggtttttctcctttgaaggcaagccgcaccgccggcctctgatcccttcccgaggtttttccctgccgccacgacagtcgactacgagctacaacttggttactggagattgtggactgcgtcagcagatgtagcgatgcgtgagagaattctggtcggtggaaaaattcgacaaattgcctccgaactcgctgacgggtgacgggcttgacaaaaacagcgccctttgtgccttggtatgctggatggtgaaggaagaggggtatcctgtacctcggcc

SEQ ID NO: 2424 - DNA, 434 bp, Cicer arietinum
agagtattagcatagtcaaaaagccattaattaattagcatcttaattattccaaatggcttcaaaatttgctattattcttctttccctcaacatcctatttttcactatggttacctccaattatgttccatgtcctccaccaccccccaagggtcacaaaccccaccacccaccttcctcaaaatctccaacttgtcctagagacacaattaagtttggtgtgtgtgctgatttattgggtttgattaatgttcaacttggtaagccaccaaagacaccatgttgttcactcattgatggtcttgctaatcttgaagctgctgtgtgcctttgcactgcccttaaagctaatgtgttgggaatcaaccttgatcttcctattaacttgagcttgatacttaactattgtggaaagggtgttccaaagggat

SEQ ID NO: 2425 - DNA, 439 bp, Cicer arietinum
agagtattagcatagtcaaaaagccattaattaattagcatcttaattattccaaatggcttcaaaatttgctattattcttctttccctcaacatcctatttttcactatggttacctccaattatgttccatgtcctccaccaccccccaagggtcacaaaccccaccacccaccttcctcaaaatctccaacttgtcctagagacacaattaagtttggtgtgtgtgctgatttattgggtttgattaatgttcaacttggtaagccaccaaagacaccatgttgttcactcattgatggtcttgctaatcttgaagctgctgtgtgcctttgcactgcccttaaagctaatgtgttgggaatcaaccttgatcttcctattaacttgagcttgatacttaactattgtggaaagggtgttccaaagggattcgta

SEQ ID NO: 2426 - DNA, 441 bp, Cicer arietinum
cttaatttcctatttctaagtatagagtgaattaatgactactagtgcattttcatcattgaggggttcaaattcaaaggttagatcattggggaagtatagttcgaagcaagttcgacaacagagggcgaggatttacataatatggagatgcactgttttactattgtgttggaacgattaagtgtgtgtttggttatgcgttagagttatggttctgcgcgatttcaaagaagctacaaaacttactatatctttgaaaataaagaaagagatgtgtgtttgcctaacttttgaatttggagcttcacaaattcacgccaaatcttgccttgagatgcaagatacgcatggttgcggtgaaaccaaacacaatataagcttttacttggatgcggaaaatttgacatgattttgagtaaagttgtgcaaccaaagaaa

SEQ ID NO: 2427 - DNA, 357 bp, Cicer arietinum
ctttgattggttctatggaattttggcttcacttggtctttggcaaaaggaggcgaaaattttatttttagggttagataatgctggaaaaaccactttgcttcacgtgctcaaagacgagagattagttcagcatcaaccaactcaacatccaacgtcagaggaattgagtattggaaagataaagtttaaagcttttgatttgggtggtcaccagattgcacgcagggtttggtctgattattattctcaggtggatgctgtagtttacctggttgacgcatacgacaaggaaaggtttacggaatcaaagaatgaactgaatgctcttctttctgatgggtcgttagcaaatgt

SEQ ID NO: 2428 - DNA, 431 bp, Cicer arietinum
tggtgaaggagaagatcgccatttgattctggagagatgtctagatacagctataccttcaatccttgtcagtgatatcctatggaagtatgatgatgaacctcaatctttgattgcatcacgccaaatattaaggagaaaagaagcctctcctgtttcgcagacaaataccgcatccattcagcagacactagaggaaagaaaagcagcttatttagctgctcgtgagcggattttttctatgagtttggaagatgccaaagagccggacgaacaaaagccacgaagcgtgccagtagttgcccgccgaatgattgcgcatgcactaggtcaaagaatcaatacaaagaatccaaatgagccagttagtgatagtatcaaggaaagagggctcgccgatgaatcaaatgctaaagataagaacagcggaa

SEQ ID NO: 2429 - DNA, 198 bp, Cicer arietinum
gttcaccttctctgacaacacctttgtcggatctaatggcggcacctcagaaccagaacgccttagatatcggaggacggtgcccgtggcatcggtagcgacatccttccgatcaacgacgccgattgcgatgggtttttctcctttgaaggcaagccgcaccgccggcctctgatcccttcccgaggtttttccctg

SEQ ID NO: 2430 - DNA, 359 bp, Cicer arietinum
gatttcaggcccatttgaaaagttaattcgagggtctaagattcgggaactgagtggtcctgagtactcaaggaaggtaatggagaattgtgtggcacacttgaaatctattggaacttatggcgatgaagaagttgaagctatgcaaaaatttgctgaagccttcaagaatgtgaattttccacctggtgcctctgttttttataggcaatcacctgatggagtattagggcttagtttctctaaagatgcaagtatcccataaaaggaggatgcagttattgagaacaaggcagtttcatcggcagtgttggagactatgattggtgaacatgctgtttctcctgatttaaagcgct

SEQ ID NO: 2431 - DNA, 246 bp, Cicer arietinum
acgggcctttgcacaactattacgagctccacaagatgatgcccaagcggttattagagatcggttccctgttcctagattggtagtgtgtgatcaacatggttcccaggctagatttttattagcaaagctgaatccctcagcagcatataataatgcgcacgagatggctgctggttctgatgtaatctttactgatgatgttagtcttcaagttttctttgagcatctgcaaaggctggctgt

SEQ ID NO: 2432 - DNA, 436 bp, Cicer arietinum
accaggatgcatccaccaccttaatatcaggctccttcaggttatcataaagccaatccacagacacaactggctcatttgtgggtgcagatcgtgttgaatatgcagctcttctaccaactattgaagaagccatacaaggagcccaaccagtcaatttggtgttttgggctgtagaggttggaacagtttgtatagagaacagccgtttagagaagaaagaagagagaattggtgggtggtgagtgataatcgagcgaggacctaaaagaatctttgtcaaaaaggaagaagccattatcagcaatgaccatataaaaggagtggcctcgaattactcgaagagtcgtaggttgttccaaaatcgaaattaagttaaaaaaaaataaaatcaaaaacaattagcattaatcaatcgagtagtgagtgtgatgca

SEQ ID NO: 2433 - DNA, 331 bp, Cicer arietinum
gttggaactgtaaatcttcctcatgcttattcagatttcaacagctctgaagctattattatggtagagttggccactgcttgtttgatttgaaccgttggattctgatacctggaacattacctaggaaagtatttagaaagagccacggagcacacaactttctggagtgtttgacatcaagccaaattgaggctctcacaatcaaacatgaaacatagcttcatagtttagaagaactgggcaaacattctaaactatgctaggaagcggtatgaccttttcctatgatcatgaggttggggatattgctagtagttttattgaatgt

SEQ ID NO: 2434 - DNA, 385 bp, Cicer arietinum
tggtcgcggccaggtctgataccacggcggttgaaaggtctggaattgccaaagatgttacggattggtggcaaaaccccattagtatatctaaatagacttgcggatggttgtgtggctcggattgctgccaaactggaattgatggagccatgctctagtgtaaaagacaggattgggtatagtatgattgctgatgcagaagagaaggggcttatctttcctggacagagtgtcctcattgaaccaacaagtggtaatactgggattggattagcctttatggcagcggccaagggttacaagctcataattacgatgcctgcttcaatgagtcttgaaagaagaatcattctattggcttttggagctgaattggttctga

SEQ ID NO: 2435 - DNA, 350 bp, Cicer arietinum; identical to SEQ ID NO: 803

SEQ ID NO: 2436 - DNA, 175 bp, Cicer arietinum
acgggaagtcgaggggcgcagagcccggattgtcgaaggctcgcgaagccggaatgtcggggtaagaagaagccgcaaataacacgtgagaagtagcgcccgaaggcgatgtcaagagctcgcgaagctcaatgtcgttgcagacactcgtcgcgaagaaaggtcaactctctga

SEQ ID NO: 2437 - DNA, 293 bp, Cicer arietinum
acttgggttctacgttggactatgtattttgtattgaatactttgcggatggagggatgatatactaatttgtgcttgccttttattttcaggtgttgtgaccattgtttgttggttcagtatggaagcaggggagtggattgtggtgatgtggtaactgctcgagtagatgctgtggcgtagatgtaaaaatgaaagccaaacagaaacagtagaccagaaagtagactgaaaggattaggaatagaatggagaattagtgttttttttattatttctagtttataacatgt

SEQ ID NO: 2438 - DNA, 183 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtg

SEQ ID NO: 2439 - DNA, 268 bp, Cicer arietinum
ggttctcctgcctttgggcgtggaaagccacctgatctatctgtgcaagagaattctaggctggagaggaatagttcccgctgacgggatgacctcttgaaagtaaagcgcctttgtgccgatgatatgctggatgaactagatgggagacgctgctggagggaatctctgctgagatcaactgtattgatgtccatgggacgtgcttcaccgacaactactgtagagcgggctacgagtagagaggtgcctcttggaggtaatgagt

SEQ ID NO: 2440 - DNA, 358 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtctt

SEQ ID NO: 2441 - DNA, 146 bp, Cicer arietinum
acccgtatcttgatttggatctgttctaccctgtgcagtgattgcgttgaattgtccactcattggaagacgaggataaagattgcaattttggaaaacaaccttggcgtttccaaatatgaaatcaactgtgccgtagatgtcac

SEQ ID NO: 2442 - DNA, 430 bp, Cicer arietinum
cttttggtgcctaattttgctgattttctttcacttgttggaagcagtgtgtgtgttgttcttggatttgtgttgcctgctatgtttcattgtatggttttcaaggaggagttaggttggagatgcattctttctgatggggtagttatggtttttggattttttgttgctgttgttggaacttttacttctgtcacagagattctttctcctaaggcctaactgaattttggctcaaaaagtttgtgacagatgaaagcctctttggtcttgatggttaattgagcaacttgggtcatcaattggatttgatactggtatcaagtgttttttgttgattgaatcatgattatctatcatgaacctacaaatgtatgtttttcttttatgtaaaaagttgtagctctatttgttggaattgaagaattaa

SEQ ID NO: 2443 - DNA, 238 bp, Cicer arietinum
acgggaagtctaggggcgcacagcccggattgtcgaaggctcgcgaagccggaatgtcggggtaagaagaagccgcaaataacacgtgagaagtagcgcccgaaggcgatgtcaagagctcgcgaagctcaatgtcgttgcagacactcgtcgcgaagaaaggtcaactctctgaatccctttcttcaggcagctgtgagggtcccgttagccccacagctgcttttgctgccattta

SEQ ID NO: 2444 - DNA, 416 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgag

SEQ ID NO: 2445 - DNA, 288 bp, Cicer arietinum
actctctcttctcacgcttgctgtcagcctcacgattattgatcactcagaaacgaagttgatgtgggccgttggattgagtatagcaaccgttttatcttatgttgcaactttctcaataggtgcgggacccatcacgtgggtgtatagttccgaaatatttcctttgaggttgagagcgcagggtgcggctatgggagttgtggtgaatagggtaacaagtggggttatttcaatgacttttttatccttatctaaagcgattacctattggtggagcttttttcc

SEQ ID NO: 2446 - DNA, 190 bp, Cicer arietinum; identical to SEQ ID NO: 1999

SEQ ID NO: 2447 - DNA, 156 bp, Cicer arietinum
cgtctctcgtctccaaacattacctacttcattcgcaagcacaagattcttcaaatttcattgttgtttccattccatttccacccatacctgattcagatttacatatggcaactgaaacaaaggctgtcactgaggatgtcaagatcgatctct

SEQ ID NO: 2448 - DNA, 147 bp, Cicer arietinum
ctctgacagcacagctatatcactgatcatcttcttaagccacaagagtgctggcagttgttgattcatatttccaaacaggtggaagcttctttgtcttcttatagtagcgcgcaagacggtggatcctgctctcaaccaaaatta

SEQ ID NO: 2449 - DNA, 374 bp, Cicer arietinum
aacacctttgtccgatctaatggccgcacctcacaaccagaacgggggagagggtggtatgacggtgcccttggcatcggtagcgacatccttccgatcaacgacgccgattgcgatgggtttttcccctttgaaggcaagccgcaccgccggcctctgattccttcccaaggtttttccctgccgccacgacatacgactacgatctactacttggttactgcagattgtggactgcttcagcatatgtaggggggcgggagacaattctggtctgcggaaaaagtcgacagtatgcccccgaacccgctgacgggccgacgggctcgagaaaatacagcgccttttgtgccttggaatgctggatggtgaat

SEQ ID NO: 2450 - DNA, 431 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaa

SEQ ID NO: 2451 - DNA, 417 bp, Cicer arietinum; identical to SEQ ID NO: 1860

SEQ ID NO: 2452 - DNA, 423 bp, Cicer arietinum
gtctcaattccatcctattagattttcacttgttaaattcaaccattttcatctctcttgaattcttcattcatcaactttgttaaccatgtcgaatactgctggtcaggtcatcaaatgcaaagctgcgattgcatgggaggcggggaagccgctggtgatagaagaagtggaggtggcgccaccacaagccggtgaagcccgtcttaagatactcttcacctccctttgtcacactgatgtttacttctgggaagctaagggtcagactccactgtttcctcgtatatttggtcatgaagctggagggattgtggagagcgtaggggagggtgtgactcatctggaaccaggggatcatgctctgcctgtattcactggggagtgtggggaatgtccacattgtaagtctgaggaaagcaa

SEQ ID NO: 2453 - DNA, 281 bp, Cicer arietinum
accgtcccttgagccccaaagaaaggcatgacggcctgtcttttgtgccgccccataatcacgctactgtaaactccaggactttcgccctgtatctcataaatggtcgtttcggctgcctatgtgccatcctcaaatactgcccatgcatcgttccttggatgtttggcagcatcctcctcaacaaaagtattccgtaaccacacgagtcatttacagatcgtcgtcggaaagctcaccaggcagaggcatggcggcggcctcgtccatctccttgcggt

SEQ ID NO: 2454 - DNA, 435 bp, Cicer arietinum
actatccatatcagtcatggctttctttgaatagatactcctgtatgtaaatgaaatgtttgaaatcatagcacttatgaagccgagccaattgaatgagagctcagtcaacgacgccaatgacacaccaataacaacgggagcaagtgagagccaaagagtgataggaattgattgtccaagtatgaattgtgaagcagcagcattaaagaatggctcaagagctttaacggtatgtgtgaaagaaacagcaactgcagcaaatgagacattgctggtcacatggcctaatgcatgacacacagctacaggtatgagcaacttcagcaggttcgcatctataggagcgcgcttaggaaggcccacagtccagctcaccaaacaatacaccacacccacgaataaatggataaccgacacaaagtaaggataggg

SEQ ID NO: 2455 - DNA, 246 bp, Cicer arietinum
ctcaattccatcctattagattttcacttgttaaattcaaccattttcatctctcttgaattcttcattcatcaactttgttaaccatgtcgaatactgctggtcaggtcatcaaatgcaaagctgcgattgcatgggaggcggggaagccgctggtgatagaagaagtggaggtggcgccaccacaagccggtgaagtccgtcttaagatactcttcacctccctttgtcacactgatgtttact

SEQ ID NO: 2456 - DNA, 216 bp, Cicer arietinum
gtgaaaccaagtctcagaaggactttctagaaatgtctggaactggaaagggtaagaagagggaggaacacgacaacgcttccgatggcgactctgaagctcacgcgcctcccaaaaagaccctaaaaaaagattccgacgataactctgacgaaatcgttgtttgtgagatagggaagaacaggaaagttactgtgaggatctggcagggtaaga

SEQ ID NO: 2457 - DNA, 208 bp, Cicer arietinum
ggtttatctactgctaacaccatagagggtgcacgcgctggtgctaggcagctggaagtcacaattaatgggattggtgaaagggctggaaatgcctcgttggaagaggttgtgatggccctgaaatgtggaggacatgtctttgacaatctgttcactggaattaatacaaggcacatttatatggcaagcaggatggttgaagagt

SEQ ID NO: 2458 - DNA, 293 bp, Cicer arietinum; identical to SEQ ID NO: 1098

SEQ ID NO: 2459 - DNA, 166 bp, Cicer arietinum
cggcagcgagtcaagactcggtctcgtgtgaagcgatcgaacttagccaagccgaagttaacaactgataatgaggaaaaaagtagcaataacaaaggaattgaatccggttctgttgaaccggttgaagaagtgatgaaccggtccgcgagtcatgaatcatcgc

SEQ ID NO: 2460 - DNA, 254 bp, Cicer arietinum
gttaggagcgggattttctgcaggccacgcgaccacacaaaactgcggggatgctatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttcctatcaacgacgccgattgcgatgggtttttctcctttgaaggcaag

SEQ ID NO: 2461 - DNA, 413 bp, Cicer arietinum
accagataaataattatttcactatttatatatagtcatgcattaaatacatacccaacaaatctttgtgacttccaatatattttgctttgtaaataaatcccctttaatgcaattcttcgactacacataggctgcctatatctaaattttatcaatgtctctctaaattgacggtcatttttcatagacgtattttttaagtcagtaactaacaattaaatcatacttagaatgcaatggctatatgtcaatatgttggatatcccgatctatttttaacattcagatgcaacccaaaatggccagaaatacgatttttccttgaaaccattgaaggacaaaaaagtgacgacagacccgacattattagtcgtgttttctctattaaattatggaagctgatcaatgat

SEQ ID NO: 2462 - DNA, 349 bp, Cicer arietinum
acatgtgggcaatttctggaaccaaaggatcatcaggatttgggtccgtcaacagggaacaaatcgggagcaacaccttggaaatggtcagagcagggctccactgctcctttaatatatcaaggcaaatgcttccattgctattgatgtttgggtgaaatacctttgtcctgaatgcaaccttgggtggcttaaagggataatctggagggaaatgaatagtgactaggaaaacacctccagtataaagactgtctggaggacccataattgtcgcttgccaatgaaacatatcttcagcaacaggaccagcgctgcatgaagttggaggatccttctgcaaatcctt

SEQ ID NO: 2463 - DNA, 249 bp, Cicer arietinum
acacaacgccttctgacattttggagagtcgctttcaacgggttgaatccggcagctatcatatcatcaatcactgctagagcagatttgacatctcggttaatcaggtgggcatcaacaagcagggaatacgactttgcattaggcttgacgcccaaacttactaggtgtgcaaacgccgttgaagcttcgtgtgtcttcttgagcttcccaaaggggtacatcagcccattgtatgaacctgcccgg

SEQ ID NO: 2464 - DNA, 229 bp, Cicer arietinum
aacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgatttacaacttggttactggagattg

SEQ ID NO: 2465 - DNA, 227 bp, Cicer arietinum
actgatcatggttgagaacggagagtgcatcagggacagttctatttgaggttattaggtcatgtgttaataaaacttcttttgccatgtcagccggaagaaattactacagttgttacttgccctaatttaagtgtcattattgggccatgaatgtcagcaagatttgctaaggaatggtggggtttgttgccaagttttaaaagatttcctattatgggaagtgg

SEQ ID NO: 2466 - DNA, 433 bp, Cicer arietinum
gcttcttcgagaagtggattttctgaatttgcatcaaatgctaatgggcagtctgcacttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccggag

SEQ ID NO: 2467 - DNA, 275 bp, Cicer arietinum
accacgggcggcggtgtgcgaaggcttgacggagggaggaggagatgcgggagatgaagttacggaaggctggcgttgcgatgggaggttgagattgggaggaaactcctccggtgatgtttgtgttggattgggaagtggaaacgggaagtgtcggtggagaagacatggtggcgcgtgaatctccgattgccgcacgtgactattggatgaaaccgatagagagagaggcaatggagactcgtgcgtggtttgggctttttggtttgggtttg

SEQ ID NO: 2468 - DNA, 365 bp, Cicer arietinum
acaccttgtttactctaaatggaatagctcgcaagggttgatcaatgtctctatctccactttccaatttccaatcaaaggaattaatcaatgatcctaacatagtatgcaacattctaattgcaagtggcatgccaggacatattcttctcccactaccaaatggtgtcaattgaaaattttgtcccttgaaattaatttcggaccccaaaaatctttcaggtgaaaacaaagttggattgacccaaatttttgggttccttcccatggcccattgattgactagaatttgtgcaccttgtggaatagtgtatccatgaattgtaacatttgttttggcttttcttggtagcaaaagtggagct

SEQ ID NO: 2469 - DNA, 432 bp, Cicer arietinum
gcactgttagtgccgtgttaggagcgggattttctgcaggccacgcggccacacaaaactgcggggatgctatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgacaatagattgcc

SEQ ID NO: 2470 - DNA, 418 bp, Cicer arietinum
acttctccggaatggaaagaaggattcacatgggcatttgatatacctcccaagggccaaaagctccatatcgtatgcaaaagcaagaatacttttgggaagtcaagtcttggaagagtcaccatccagattgataaagttgtaacagaaggggtttatagtggattattcagtcttaatcatgacggcaacaaagatggttcttcccgaacacttgaaattgagattatatggtctaacagaatttctaatgatgacatttgaaaggggcggtgagctacttttccggctggaagcatagaaagtaatctgcagtatgcatgatatgttcaatatggttttcttgtaattatcaacatgtttggaagatccaattttgtagcctggcagataaggttgcctcatttgtaagtgtaaa

SEQ ID NO: 2471 - DNA, 190 bp, Cicer arietinum; identical to SEQ ID NO: 2414

SEQ ID NO: 2472 - DNA, 417 bp, Cicer arietinum
acaatggtataaactgcagagctcagagtgcttcattgacagattttggtggtgttggagatggaaaaacatctaatacaaaggcttttgagtctgcaattagtcacttgagtcagtatggtaatgaaggtggttctcagctgtatgttcctgcaggaaaatggcttactggtagtttcagccttactagtcatttcactctctatttggataaagatgctattctccttgcttctcaggatataactgagtggcctgtgattgaacctttaccatcatacggtagagggagagacgcaccagcaggaagatacaccagcctcatatttggaactaacctcaccgatgttattgtcacaggggaaaatgggaccatagatggtcaaggtgcattttggtggcaacaatttcacagaa

SEQ ID NO: 2473 - DNA, 465 bp, Cicer arietinum
  misc_feature (22)..(22): n is a, c, g, or t
gatttcgagctggccgcccggngcaggtgatttggctattcctagagaaatctaaggctatcattagtaatttgacaatgggtccaagtgttggtgatgtatataggaactgtgaaatcaaatcaatagctacgtatggagtttttgtagagatagctcctggacgggagggactttgccatattagtgaactgagttcaggttggctacctaaggcagaagatgttttcaaggtgggagatcggattgatgttaaacttattgagataaatgataagggacagctgcgtcttagtcaccgagcactgcttcctgatgcagatccagacaattcaaattcaaatgctacagcagctttgccagactcagctaataatggtttgtcggatgaagctacaagcctgacaaatgctggtttagttgaagggaaaactgaacagactaatgataattttaacactccca

SEQ ID NO: 2474 - DNA, 439 bp, Cicer arietinum
ccgggcaggtgatttggtttccccagagaaatctaaagctatcattagtaatttgagaatggggccaagtgttggtgatgtatataggaactgtgaaatcaaatcaatagctacgtatggagtttttgtagagatagctcctggacgggagggactttgccatattagtgaactgagttcaggttggctacctaaggcagaagatgttttcaaggtgggagatctgattgatgttaaacttattgagataaatgataagggacaggtgcgtcttagtcaccgagcactgcttcctgatgcagatccagacaattcaaattcaaatgctacagcagctttgccagactcagctaataatggtttgtcggatgaagctacaagcctgacaaatgctggtttagttgaagggaaaactgaacagactaatgataattttaac

SEQ ID NO: 2475 - DNA, 341 bp, Cicer arietinum; identical to SEQ ID NO: 202

SEQ ID NO: 2476 - DNA, 424 bp, Cicer arietinum
acagaagactgtgagattaatgggtatgtaatcccagaaggaggacttgtacttttcaatgtttgggcagttggaagagatccaaaatactgggatagaccattggaattccgtccagagaggttcttggaaaatgcaggtgaaggtgatgcaggttcaattgatcttaggggtcaacattttcaacttctaccatttgggtctggaaggagaatgtgtcctggagtcaatttggctactgctggaatggctacactcctttcatctgtacttcagtgctttgaattacaggtagcaggaccaaatggacaaatattgaaaggtgctgatgctaaggttagcatggatgaaagacctggtctcactgttccaagagcacataatctcgtttgtgttccacttgcaagacctggtgctgctgcta

SEQ ID NO: 2477 - DNA, 251 bp, Cicer arietinum
accatcttatcaacatacagtgttccatccaggtgatcacactcatgctgtaaaatccgggcctgccaaccagaagcatttattttgataggttcaccgtaacgaccaaaacctgcaacctcaacatcaaggtaacgctctaccatagcttgatatcgatcaacactctatcacccttcaaaaaagaaggcagtcttgttgctcttcttctttagcctaggattgagaatcgccaaaagatcaaaaggttt

SEQ ID NO: 2478 - DNA, 421 bp, Cicer arietinum
aggtacagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 2479 - DNA, 404 bp, Cicer arietinum
gttcaccttctctgacaacacctttgtcggatctaatggcggcacctcagaaccagaacgccttagatatcggaggacggtgcccgtggcatcggtagcgacatccttccgatcaacgacgccgattgcgatgggtttttctcctttgaaggcaagccgcaccgccggcctctgatcccttcccgaggtttttccctgccgccacgacagtcgactacgagctacaacttggttactggagattgtggactgcgtcagcagatgtagcgatgcgtgagagaattctggtcggtggaaaaattcgacaaattgcctccgaactcgctgacgggtgacgggcttgacaaaaacagcgccctttgtgccttggtatgctggatggtgaaggaagaggggtatcctgt

SEQ ID NO: 2480 - DNA, 390 bp, Cicer arietinum
caaaacgttactttatagcgtcgccgttgatcaacaagtgacaccttcagctgcatcacactcactactcgattgattaatgctaattgtttttgattttatttttttttaacttaatttcgattttggaacaacctacgactcttcgagtaattcgaggccactccttttatatggtcattgctgataatggcttcttcctttttgacaaagattcttttaggtcctcgctcgattatcactcaccacccaccaattctctcttctttcttctctaaacggctgttctctatacaaactgttccaacctctacagcccaaaacaccaaattgactggttgggctccttgtatggcttcttcaatagttggtagaagagctgcatattca

SEQ ID NO: 2481 - DNA, 264 bp, Cicer arietinum
acacttgtatatgttcacttttctctttaattcttcaattccaacaaatagagctacaactttttacataaaagaaaaacatacatttgtaggttcatgatagataatcatgattcaatcaacaaaaaacacttgataccagtatcaaatccaattgatgacccaagttgctcaattaaccatcaagaccaaagaggctttcatctgtcacaaactttttgagccaaaattcagttaggccttaggagaaagaatctctgtgac

SEQ ID NO: 2482 - DNA, 132 bp, Cicer arietinum
ctgcagatgtggatatctcagttaattcaatggaacccaataccatatctgcacaaccgctagttgcttctggctcagaggagattgtggagatgaagcccaaggatggtcctaaacggtgcagcaactgca

SEQ ID NO: 2483 - DNA, 259 bp, Cicer arietinum
acatgtagaaaagtatagtcatattttctacagggctaagaaagagaagatgacacagtccaactcaaagctccattatgccatgcctccactcgttgctgtcctgattatctgaaagagagatgatccaataacaacaaagacgaagaaaccaagcagcacggggccaacaggatagtcttttcctttcttaacagtggtttctgttacacttcctctttttgtgatgtttttctcaaacttctccaccttcctaact

SEQ ID NO: 2484 - DNA, 405 bp, Cicer arietinum
gttcaccttctctgacaacacctttgtcggatctaatggcgggggcgtcagagccagaacgccttagatatcggaggacggtgcccgtggcatcggtagcgacatccttccgatcaacgacgccgattgcgatgggtttttctcctttgaaggcaagccgcaccgccggcctctgatcccttcccgaggtttttccctgccgccacgacagtcgactacgagctacaacttggttactggagattgtggactgcgtcagcagatgtagcgatgcgtgagagaattctggtcggtggaaaaattcgacaaattgcctccgaactcgctgacgggtgacgggcttgacaaaaacagcgccctttgtgccttggtatgctggatggtgaaggaagaggggtatcctgt

SEQ ID NO: 2485 - DNA, 378 bp, Cicer arietinum
gaaaagttaattcgagggtttacgattcgggaactgaatggtcctgagtactcagggaagggaatggagaattgtgtggcacacttgaaatctattggaacttatggcgatgaagaagttgaagctatgcaaaaatttgctgaagccttcaagaatgtgaattttccacctggtgcctctgttttttataggcaatcacctgatggagtattagggcttagtttctctaaagatgcaagtatcccagaaaaggaggatgcagttattgagaacaaggcagtttcatcggcagtgttggagactatgattggtgaacatgctgtttctcctgatttaaagcgctgtttggctgcaagattacctgctttgttcgaccaa

SEQ ID NO: 2486 - DNA, 444 bp, Cicer arietinum
ccgggcaggtacaggcctttccccaactattacgagctccacaagatgatgcccgagcggggggtaaagatcggttccctgttcctagattggtagtgtgtgatcaacatggttcccaggctagatttttattagcaaagctgaatccctcagcaacatataataatgcgcacgagatggctgctggttctgatgtaatctttactgatgatgttagtcttcaagttttctttgagcatctgcaaaggctggctgtccaatcttgagggcagataataggagagattgacagtttatggattctagactttggtttgggaattcaccaatgatgtgtgtcctgcattatgctgttgcattcagttatttttcctttctttcctttgttcttaaccaagagaagatctgagcctgcgtgaattgaagaataagggaagcaagacc

SEQ ID NO: 2487 - DNA, 307 bp, Cicer arietinum
acattccactgatccatggacagtgaaataccttttttgccaggcaactgcttgccatctttgatgtaaaattcacgaatgtcaacccaaatcttaccctgccagatcctcacagtaactttcctgttcttccctatctcacaaacaacgatttcgtcagagttatcgtcggaatctttttttagggtctttttgggaggcgcgtgagcttcagagtcgccatcggaagcgttgtcgtgttcctccctcttcttaccctttccagttccagacatttctagaaagtccttctgagacttggtttcac

SEQ ID NO: 2488 - DNA, 443 bp, Cicer arietinum
ccgggcaggtaccaggattcccccaccaccttaatatcaggctccttcaggttagtgtaagggcaatccacagacacaactggctcatttgtgggtgcagatcgtgttgaatatgcagctcttctaccaactattgaagaagccatacaaggagcccaaccagtcaatttggtgttttgggctgtagaggttggaacagtttgtatagagaacagccgtttagagaataaagaagagagaattggtgggtggtgagtgataatcgagcgaggacctaaaagaatctttgtcaaaaaggaagaagccattatcagcaatgaccatataaaaggagtggcctcgaattactcgaagagtcgtaggttgttccaaaatcgaaattaagttaaaaaaaaataaaatcaaaaacaattagcattaatcaatcgagtagtgagtgtgat

SEQ ID NO: 2489 - DNA, 417 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagc

SEQ ID NO: 2490 - DNA, 216 bp, Cicer arietinum
actaatatatgactattacgatgacacttgctttattgagagtaagcaacaactaacatccaatatttcaaatttaagtgattgttcattcttcatcccatagatcatcaagaagaggcttggttggtcctttgatgagtctctcctggtgaatttcacttattttcttgtaatcatctttggtcaatgaccaatcaaatatttgcaagttttgat

SEQ ID NO: 2491 - DNA, 434 bp, Cicer arietinum; identical to SEQ ID NO: 2170

SEQ ID NO: 2492 - DNA, 331 bp, Cicer arietinum
  misc_feature (297)..(297): n is a, c, g, or t
gcttcttcgataccggatttctgaatttgcatcaaatgctaatggggagggtggagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagctttttgntataaaatcatacagcgaggatgatgtgcacaaa

SEQ ID NO: 2493 - DNA, 130 bp, Cicer arietinum
ggttctcctgcctttgggcgtggaaagccacctgatctatctgtgcaagagaattctaggctggagaggaatagttcccgctgacgggatgacctcttgaaagtaaagcgcctttgtgccgatgatatgc

SEQ ID NO: 2494 - DNA, 438 bp, Cicer arietinum
gcttcttcgagtagcggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccggagtctgt

SEQ ID NO: 2495 - DNA, 146 bp, Cicer arietinum
acccgtattttgctttggatctgttctaccctgtgcagtgattgcggtgaagggtccactcattggaagacgaggataaagattgcaattttggaaaacaaccttggcgtttccaaatatgaaatcaactgtgccgtagatgtcac

SEQ ID NO: 2496 - DNA, 170 bp, Cicer arietinum
ctcgtcacatacaactctataactttacgtctgtcatcatggcttgcgattgtggatctacttgtaactgcggcggtcctagctcttgctcctgtggccagagctgctcttgcaagaactgcggcaaataaactgcgccaaggtataggaggctggaggtacctcggccg

SEQ ID NO: 2497 - DNA, 417 bp, Cicer arietinum
acagagcttacctggagaccgtggaatgaggcgactacctcgtccacggagcggcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagc

SEQ ID NO: 2498 - DNA, 193 bp, Cicer arietinum
  misc_feature (177)..(177): n is a, c, g, or t
acaaggagcttacgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcncgtttactcgacgttg

SEQ ID NO: 2499 - DNA, 401 bp, Cicer arietinum
acattacctgttgtgactttactaaatatttgttgacgtttaatatcattgatcagcttccataatttaatagagaaaacacgactaataatgtcgggtctgtcgtcacttttttgtccttcaatggtttcaaggaaaaatcgtatttctggccattttgggttgcatctgaatgttaaaaatagatcgggatatccaacatattgacatatagccattgcattctaagtatgatttaattgttagttactgacttaaaaaatacgtctatgaaaaatgaccgtcaatttagagagacattgataaaatttagatataggcagcctatgtgtagtcgaagaattgcattaaaggggatttatttacaaagcaaaatatattggaagtcacaaagatttgtt

SEQ ID NO: 2500 - DNA, 190 bp, Cicer arietinum
ctacgagctttcccttggttactggagattgtggactgcgtcagcggatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 2501 - DNA, 304 bp, Cicer arietinum
cgtctcttgtccccaaacattacctacttcattcgcaagcacaagaggctgggaatttcattgttgtttccattccatttccacccatacctgattcagatttacatatggcaactgaaacaaaggctgtcactgaggatgtcaagatcgatctctttgaagacgatgatgaatttgaagagtttgaaattaatgaagagtgggatgataaggatgaagggaaagaagtaactcaacagtgggaggatgattgggatgatgacgatgttagtgatgatttctctcgtcaggtgagaagggagtt

SEQ ID NO: 2502 - DNA, 379 bp, Cicer arietinum
attcgatatattcagttggaagaatgaaaagtgtgtggggtgaagattgtatggagtttaaaccagagaggtggttatcggttcagggagaccggttcgaaccgcctaaagatgggtataagtttgttgcgtttaatgctggaccgaggacttgtttggggaaggatttggcttaccttcagatgaagtctgttgctgcggctgtgttgattcgttaccggatttcaccggttcccggtcaccgggttcagcagaagatgtctctcacacttttcatgaagtatggtctacgtgtgttcttgcatccacgtcagcttcagcaacccaagtaggatgtgtttgggtggttgtgtatgtcactgattcggtcatatgctgt

SEQ ID NO: 2503 - DNA, 425 bp, Cicer arietinum
  misc_feature (1)..(1): n is a, c, g, or t
  misc_feature (9)..(9): n is a, c, g, or t
nagcacagngctccagcaccatcaccaacattgagtagtcctccgggaccgggacaggagctcctggacccagtgaagatgcgttatcacctggacccggttctgctaacgatgagagtggagcagaaaccatcaggggcatgaacctgctaggaggcctagctttgagctggattgcagttgttttgatattctagatatactccgttcctcgtatcacatactcttgtagcacttctttctccttcctttttcttcttatttttggccctgttatgggtacctcggccgcgaccacgcggccgcccgggcaggttggtgaaggagaaggtcgccatttgattctggagagatgtctagatacagctataccttcaatccttgtcagtgatatcctatggaagtatgatgatgaacctcaatct

SEQ ID NO: 2504 - DNA, 281 bp, Cicer arietinum
accgtcttttcagccccaaagaaaggcatgacggcctgtcttttgtgccgccccataatcacgctactgtaaactccaggactttcgccctgtatctcataaatggtcgtttcggctgcctatgtgccatcctcaaatactgcccatgcatcgttccttggatgtttggcagcatcctcctcaacaaaagtattccgtaaccacacgagtcatttacagatcgtcgtcggaaagctcaccaggcagaggcatggcggcggcctcgtccatctccttgcggt

SEQ ID NO: 2505 - DNA, 445 bp, Cicer arietinum
ccgggcaggtactatccatttccgtcatggctttctttgaatagatactcctggggggaaaggaaatgtttgaaatcatagcacttatgaagccgagccaattgaatgagagctcagtcaacgacgccaatgacacaccaataacaacgggagcaagtgagagccaaagagtgataggaattgattgtccaagtatgaattgtgaagcagcagcattaaagaatggctcaagagctttaacggtatgtgtgaaagaaacagcaactgcagcaaatgagacattgctggtcacatggcctaatgcatgacacacagctacaggtatgagcaacttcagcaggttcgcatctataggagcgcgcttaggaaggcccacagtccagctcaccaaacaatacaccacacccacgaataaatggataaccgacacaaagtaaggataggg

SEQ ID NO: 2506 - DNA, 436 bp, Cicer arietinum
ctcaattctatcctattagattttcacttgttaaattcaaccattttgatcgctcttgaattcttcattcatcaactttgttaaccatgtcgaatactgctggtcaggtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaagggtcagactccactgtttcctcgtatatttggtcatgaagctggagggattgtggagagcgtaggggagggtgtgactcatctggaaccaggggatcatgctctgcctgtattcactggggagtgtggggaatgtccacattgtaagtctgaggaaagcaacttgtgtgatcttct

SEQ ID NO: 2507 - DNA, 316 bp, Cicer arietinum
ctcacatgcgcaactctgactacacccccgttccctaaatgcatcgcgcatcaattgacgacagccacgcgacacacaacaacatgacaaatgaacgaatggggctggggaatgacgtactcctttgataatgcttcgatctccacaggcatagttgcactaaacagcagtgtttgatgcttctctggaagatttctcattatctctcttatctgtggttcaaaacccatatcaagcattctatctgcctcgtctagaacaacataagaaattctagatagggaagtgttgccttgttgtaagtgatcaatgaatc

SEQ ID NO: 2508 - DNA, 403 bp, Cicer arietinum
acaaaaacgagaaccacagtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacgtgagtagcgagaaccaccatcaccaccaccatatccacgatctctgctaccaccataaccaccaccacctcctccgccatatccacctccaccaccatatcctccaccgccacctctgttatatccaccttcacgacgtccaccaccatatccaccgcctccaccatatccaccgccaccacggccgcctccaccaccgctaccacgagactgagcttcgttcacggta

SEQ ID NO: 2509 - DNA, 433 bp, Cicer arietinum
gttaggagtggcattttctgcaggccacgcgaccacacaaaactgcggggatgctatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtga

SEQ ID NO: 2510 - DNA, 346 bp, Cicer arietinum
actcattacctccaagaggcacctctctactcgtagcccgctctacagtagttgtcggtgaagcacgtcccatggacatcaatacagttgatctcagcagagattccctccagcagcgtctcccatctagttcatccagcatatcatcggcacaaaggcgctctactttcaagaggtcatctcgtcagcgggaactattcctctccagcctagaattctcttgcacagatagatcaggtggctttccacgcccaaaggctggagaaccatgatccctaagctcgccagtagctgcaaccctaggactatgcatccttggggaaaccccttgcaggggaaaaaccca

SEQ ID NO: 2511 - DNA, 443 bp, Cicer arietinum
cgggcaggtacatgtgggttaacttctggaaccaaaggatcatcaggatttgggggcggcgagggggaacaaatcgggagcaacaccttggaaatggtcagagcagggctccactgctcctttaatatatcaaggcaaatgcttccattgctattgatgtttgggtgaaatacctttgtcctgaatgcaaccttgggtggcttaaagggataatctggagggaaatgaatagtgactaggaaaacacctccagtataaggactggcgggaggacccataattgtcgcttgccaatgaaacatatcttcagcaacaggaccagcgctgcatgaagttggaggatccttctgcaaatccttgaggtctttcaagatccgcttcgaagccatcgcgtaaacctagggaaaacgcaagagagatcctccgttggatttgcaaagaat

SEQ ID NO: 2512 - DNA, 383 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgtcgcggcggcagggaaaaacctcgggaagggatcagaggccggcggtgcggcttgccttcaaaggagaaaaacccatcgcaatcggcgtcgttgatcgggaggatgtcgctaccgatgccataggcatcgtcctccgatatctaaggcgttctggttctgaggtgccgccattagatccgacaaag

SEQ ID NO: 2513 - DNA, 240 bp, Cicer arietinum
acacaacgccttccgacattttgtagagtcgctttcaacggtttgaatccagcagctatcatatcatcaatcactgctagagcagatttgacatctcggttaatcaggtgggcatcaacaagcagggaatacgactttgcattaggcttgacgcccaaacttactaggtgttcaaacacctttgaagcttcatgtgtcttcttgagcttcccaaatttatacatcagcccattgtatgaa

SEQ ID NO: 2514 - DNA, 260 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaattagaggccggcggtgcggcttgccttcaa

SEQ ID NO: 2515 - DNA, 181 bp, Cicer arietinum
actgatcattttccagaacggagagtgcatcagggacagttctatttgaggttattaggtcatgtgttaataaaacttcttttgccatgtcagccgaagaaattactacagttgttacttgccctaatttaagtgtcattattgggccatgaatgtcagcaagatttgctaaggaatggtg

SEQ ID NO: 2516 - DNA, 379 bp, Cicer arietinum
actgatcatggttgagaacggagagtgcatcagggacagttctatttgaggttattaggtcatgtgttaataaaacttcttttgccatgtcagccgaagaaattactacagttgttacttgccctaatttaagtgtcattattgggccatgaatgtcagcaagatttgctaaggaatggtggggtttgttgccaagttttaaaagatttcctattatgggaagtggggtgggtcccggtggaagcttagagtgattttttttattggattttgttgtaggaatgagaaatttgagaaggagaaggagagtgaatgtgagaactacgtaggaaagtgttgaacttagtgataagtccatttttttaatatgggacctgcc

SEQ ID NO: 2517 - DNA, 152 bp, Cicer arietinum
acaggatacccctcttccttcaccatccagcataccaaggcacaaaaggcgctgtttttgtcaagcctgtctacccgtcagcgggttcggaggcaatttgtcgaatttttccaccgaccagaattctctcacgcatcgcttacatctgctga

SEQ ID NO: 2518 - DNA, 277 bp, Cicer arietinum
accacgggctttccgtgtgcgaaggcttgacggagggaggaggagatgcgggagatgaagttacggaaggctggcgttgcgatgggaggttgagattgggaggaaactcctccggtgatgtttgtgttggattgggaagtggaaacgggaagtgtcggtggagaagacatggtggcgcgtgaatctccgattgccgcacgtgactattggatgaaaccttatagagagagaggcaatggagactcgtgcgtggtttggggtttttggtttgggtttg

SEQ ID NO: 2519 - DNA, 426 bp, Cicer arietinum
acaccttgttttttctaaatggaatagctcgcaagggttgatcaatggctctatctccactttccaatttccaatcaaaggaattaatcaatgatcctaacatagtatgcaacattctaattgcaagtggcatgccaggacatattcttctcccactaccaaatggtgtcaattgaaaattttgtcccttgaaattaatttcggaccccaaaaatctttcaggtgaaaacaaagttggattgacccaaatttttgggttccttcccatggcccattgattgactagaatttgtgcaccttgtggaatagtgtatccatgaattgtaacatttgttttggcttttcttggtagcaaaagtggagctgatgggtgcagacgtaacgtttcttttactattgcttgcaaatatgggagtcttattatgt

SEQ ID NO: 2520 - DNA, 149 bp, Cicer arietinum
gtcctcagaaaaaatccaccctttgtttcttttggttgcgtttattgtagcaacgagagacaatggtgaaattcttgaagcctaacaaagctgtgattgtcctgcaaggccgatatgcgggaaaaaaggccgtgattgttcgtacctgc

SEQ ID NO: 2521 - DNA, 288 bp, Cicer arietinum
actcatcatcccaaaagaaatccctaaccagctccgggctcgcattttcaaacactgttctactgcgatattgtggcggtccactctcttggtccctacgccaagcttggtaactcatagttggtgtagaacgatccatcatctgaatccaagcgggcccaccatctttttcctcaaccaacttacttaaataacgcaaatcatgttccgtcactacacacttcaatcccttttcactttccgaagaaccagaactggtggagtatgatgaaccgggttgactttgaa

SEQ ID NO: 2522 - DNA, 368 bp, Cicer arietinum
ggcggcatttcccaaccagaacgccttagatatcggaggacggtggccgtgggatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgt

SEQ ID NO: 2523 - DNA, 390 bp, Cicer arietinum
acacagatagttgaacttactgcagctagcaaccctttattattgataataatatgcttacacccgttcaaaatacagtcaatacagaaagttggcagaaacaggaagttgactgggtcaataatgtcatcccatagcataaacctatgattgatatccaccgccccgagcatcctgatcctcctcaacgataatgttgggataaatcggtggaaaatcggagacgttaaaggtagcttccttcttgagtttctcgatatcggccttcttgtagattgtgcgggcaacggcaggtcggttacggcgttggtcacgtgtgtaatacttaatgtcgtatacggtttcgggaagggaagaagggataataggtttttcctttggggtggcggg

SEQ ID NO: 2524 - DNA, 150 bp, Cicer arietinum
actcaggcactagaaccgagtgaacaaatatgcttttcaaacattcagcagcatttaaagtgcaaaaaattcgagtttattgtatcaaatggatattattttatcatctaagcgatgaaacacattgaagctgacagtatctttctgcct

SEQ ID NO: 2525 - DNA, 420 bp, Cicer arietinum
gaaatcgtggaaattgaattctagggtttgttattgtatcgggaatcaaacaatcagcaatggcgttgaggagattctacaatgagatcaaggggaagaaggtaacagaacttcctcaacacgtgaaaccgatgctttcattcgattacctcaagaaatcaattcagagaggtttagataattacagcgaaaagtatatcgaaacaagttcgattcaacctcttctccatgtctgttatggtggaatgatcttctcttaccttgttgctcttcctaatgagcgtcgtcatctcgctcacaaagagcacgccgaatctcatcactgattcaggatcctgattgttgaattggagatggttggcttgcttgatctttttgttttaaaatttgaaaaatcaaggcagaaagatactgtcagct

SEQ ID NO: 2526 - DNA, 435 bp, Cicer arietinum
taccatgttggtgatattctccgagtaactgggtttcataactctgctcctcagtttcactttgtgcgtcgaaagaacgtgttgcttagtattgactctgataaaacagacgagtcagagctacagagagctatggaaaatgcttcaaagttgcttgtggagttcaacacgagtgtggtcgaatacacgagctatgcagacacaaagacaataccaggtcactatgtgatatattgggagttgttgaccaaggacatttcaaactcaccgagtaacgaggtgcttaatcaatgttgtctggaaatggaggaatcattgaactcggtttataggcagtgtagggtcgctgaccattcgattggaccactagaaataagggttgtgaagaaaggaacttttgaggagcttatggattatgcaatctcaagaggtgca

SEQ ID NO: 2527 - DNA, 428 bp, Cicer arietinum
ctagatagctgtccctaattcataaaccaaaacatgttaccactgggtcttctagcttttgctctcttgctattcttcttcttcaaaaaacacaaaacatctaagaaaccaaatcttccaccaggacctaaaggccttccattcattggaaacttacaccaacttgatagttcagttcttggtgtagacttccatgaactctcatttaaatatggctctttagtcttccttaaacttggttcaagacaaaggcttgttgtttcatcagctaaaatggccaaagaagtaatgaaaacacacgatatcgaattttgtaaccgacccgctttaaccagccatatgaaattctcatataatggattagaccaagtatttgcaccatatagagaatattggagacacaccaaaaaattctcattcatccattt

SEQ ID NO: 2528 - DNA, 188 bp, Cicer arietinum; identical to SEQ ID NO: 24

SEQ ID NO: 2529 - DNA, 435 bp, Cicer arietinum
ctttcttggcacgcactgttagtgcactgttaggagcgggattgtgctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctaattccttcccaaggtttttccctgccgccacgacatacgactacgagctacaacttggttactggagattgtggactgcgtcagcagatgtagcgatgcgtgagagaattctggtcggtggaaaaagtcgacag

SEQ ID NO: 2530 - DNA, 232 bp, Cicer arietinum
actgtaatctcacaaagcgcccccaatagcctcaattttcgtttgtgacagactgaaaccaagcagttgtcgtttctcaatcgtgacctgttcccagtggttgttcgtaagatattgactaaaaaaatatatggttgaaaatcggtggttcaagaagaaaggcgaatccaatggtttgtgactgtatagcgttggcaataatggatggaaagatcggcacacaatgtgtaga

SEQ ID NO: 2531 - DNA, 258 bp, Cicer arietinum
acatcttggcaatgatagggttgcagacactttcaagttccttcatcttgtcctcaaactcatctgcctctgcaagttggttgctgtctagccatcggatagcctgctcaatggagtcctcgattttcttcttgtcagctgaatcaagtttacctgcaatcttgtcatccttaatggtattcctcatgttgtatgcatagttttccaatgcatttttggcctcaaccttcttcttatgctcttcatcttcagatttgt

SEQ ID NO: 2532 - DNA, 194 bp, Cicer arietinum
cgactacgagctacaacttggttactggagattgtggactgcgtcagcagatgtagcgatgcgtgagagaattctggtcggtggaaaaagtcgacagtatgcccccggacccgctgacgggtgacgggctcgagaaaatacagcgccttttgtgccttggtatgctggatggtgaaggaagcggggtatcctgt

SEQ ID NO: 2533 - DNA, 398 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaa

SEQ ID NO: 2534 - DNA, 404 bp, Cicer arietinum
acaaacttctacaattggagcaagtcacatatctttaagtttcctgaaaggagaattaactatattcttcatcagcttcagatgaaacccaaagaatttgattactaatcacagtatttcagaactggccagtctatacttcaccaattgccaaatcccaaggccaaaatacccggaaaactaggaggatgaagttcctaatcctaatgaagagtatccagcagacttcatctccttcagtgttgaggacaaccagtccaaaccctcataaagaccatcgcccttaagtgcacaagtgccttgaatgtgccattttctattcttgagatcaaagagacctaatccttcacatacttctctggccgtcatcgctcctctcaggtcctgtttgttggcaaacacca

SEQ ID NO: 2535 - DNA, 375 bp, Cicer arietinum
aaaattctttcttggcacgcactgttagtgcactgttaggagcgggattttctacgggctactcggccacacaatactgcggggacgccatcggctccctaacagcagttttcagagaaggaattttggagagttcaccttctctgacaacacttttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagat

SEQ ID NO: 2536 - DNA, 168 bp, Cicer arietinum
acagagcttacctggagaccgtggaacgaggcgactgccttgtccacagagcagcgttctagccgccttgggtttttccctgcgaggggtttccccaaggatgtactgtcctaggttgcagctactggcgatcttaggggatcgtggacttcctgcctcagggtatgg

SEQ ID NO: 2537 - DNA, 204 bp, Cicer arietinum
accaagagacaccatagtattgatcaatgcatgggccattcacagggatcctaagtcatggagtgaggccacaaccttcaagccggagaggtttgacaaaaaaggggagattgaaaaggtgattgcatttgggatgggaagaagagtgtgtcctgtagaagctttggctcttcgaacaattagcatgactttggcattattgat

SEQ ID NO: 2538 - DNA, 226 bp, Cicer arietinum; identical to SEQ ID NO: 313

SEQ ID NO: 2539 - DNA, 407 bp, Cicer arietinum
actttctccggcgaagtaatgtcaatcgccgtcgccgtagatccagtctctttgatatcaccaccgacacggtgtctgcaattccgatggaggaagacaaggtcaataatcaagatagtgtttctcaattacagcctctgagccctgcagcacctgaaactgcaaaaatcaatggatttcctatgatgtcagtatttcagttgggtgttaatgagagtccaatggaagaactcactcttggacaaggaaatgtgaaaaataatgtgtcaaccaacctattccatccaattccttttgttgtttcagatccaaaagcttccactgtatctgatattacctctagttctagtgattcatctactgaccctccaacactttcccttggactgtccttctcatctgatcaa

SEQ ID NO: 2540 - DNA, 116 bp, Cicer arietinum
agatgttgcgccaaccttctggcctgttcgcttcaactcatatagaagagtagagacctgtcgggcaccagtgcagcctaggggatggccaaaggcaatagcacctcccttggggt

SEQ ID NO: 2541 - DNA, 258 bp, Cicer arietinum; identical to SEQ ID NO: 2531

SEQ ID NO: 2542 - DNA, 208 bp, Cicer arietinum
ggtttatctactgctaacaccatagagggtgcacgcgctggtgctaggcagctggaagtcacaattaatgggattggtgaaagggctggaaatgcctcgttggaagaggttgtgatggccctgaaatgtggaggacatgtctttgacaatctgttcactggaattaatacaaggcacatttatatgacaagcaggatggttgaagagt

SEQ ID NO: 2543 - DNA, 229 bp, Cicer arietinum
acctaaccgatgataaacataaatgatctagcatatttgtcctaacttttgtcttacaaagtttgttagaattttctatcaggttatcttctaaccagaagcaaagttagtttggttctgatctttcttctgaatcaatagatgcgggcctttgttttagtgctttgatttcgtatatgtgagtctctgatgacgagtcaagcacgctctataccagaggaaaaaatct

SEQ ID NO: 2544 - DNA, 339 bp, Cicer arietinum
accgacgaaatggtgtatgggctgtcccttgatagagaatcttgactggttatcattgatcatgacacccctatctgtgttgatcctgagaagatcacacaagttgctttcctcagacttacaatgtggacattccccacactccccagtgaatacaggcagagcatgatcccctggttccagatgagtcacaccctcccctacgctctccacaatccctccagcttcatgaccaaatatacgaggaaacagtggagtctgacccttagcttcccagaagtaaacatcagtgtgacaaagggaggtgaagagtatcttaagacggacttcaccggcttg

SEQ ID NO: 2545 - DNA, 206 bp, Cicer arietinum
agaaaactgaatctgataaagatgtattagaaaaggaaattgatgaagtgaagaaggagcttcagaaaattaatgaaaactctgtctaatccatcacaaccacaaccattacacaataaaccctacttcgaataaagctttaatcaatttgagatatcgacgtgaagattataggttgggatgcaatgataagaatccaatgcaga

SEQ ID NO: 2546 - DNA, 188 bp, Cicer arietinum; identical to SEQ ID NO: 24

SEQ ID NO: 2547 - DNA, 254 bp, Cicer arietinum
gccgaggtacgtcgtatgtttcctttttttgaaacatttccggttgttttagtggggggagggggaattgttagagcggatgttccttttcgaagggcagaatcgaagtatagtgtcgaacaagtcggtgtaactgttgaattctatggtggcgaactcaatggagtcagttatagtgatcctgctactgtgaaaaaatatgttcgacgtgctcaattgggtgatttttttgaattagatcgtgctactttaaa

SEQ ID NO: 2548 - DNA, 106 bp, Cicer arietinum
tagcgtggtcgcggccgaggtttcatgagatctattgttttcatatattttcttaaatgtaaatataaattggagtcacagctttggctgtgtcgttatttgtaaa

SEQ ID NO: 2549 - DNA, 420 bp, Cicer arietinum
cgcataaatccaaagccgcacccaaaccatttatatagaacaacaacaaacccattcccttcaacaattctcacacacccctttcccctttattcaccgatttattctttgcaaatccaacggaggatctctcttgcgttttccctaggtttacgcgatggcttcgaagcggatcttgaaagaactcaaggatttgcagaaggatcctccaacttcatgcagcgctggtcctgttgctgaagatatgtttcattggcaagcgacaattatgggtcctccagacagtccttatactggaggtgttttcctagtcactattcatttccctccagattatccctttaagccacccaaggttgcattcaggacgaaggtatttcacccaaacatcaatagcaatggaagcatttgccttgatat

SEQ ID NO: 2550 - DNA, 311 bp, Cicer arietinum
acgagaagtcatctcctcaattcctgacgctcatggtctgtcatacaattcaaactagtcccatgccagtatccaaagccatgtccatgctgcgtgttccattcgctatctgtaattcatacattaaaacttcatcggtatcttacttggcacgggccagaccaacggcgttcttgccgaggtcgtagacagagcagtatcgtcggaggaaagcatcaccgagaataacaagaggtcctacaggctcggggaagttcatgccctggaaggtagagatacagctgccctgaacctcgaggatgtagtcggtg

SEQ ID NO: 2551 - DNA, 391 bp, Cicer arietinum
cgagaagaaatggaagaagaggccgtagtggtcgcagaagcactcgaatcactgtccaccgccgaatcatcgaatccaaatccaacagaaacaactcagcagcaattgttgagtgtggaacagagatatcagatcgtcaggagtatcggagaagagtgcattcaagaagatgaacttcttaatctcctcgctaaaaagcctgagcctgtttgttatgatggtttcgaaccttctggaagaatgcacattgctcagggtgtcatgaaaacactcaatgtgaacaagctaacctctgctggttgccgagtcaaaatatggattgctgattggtttgctaagcttaataataaaatgggaggagatttgaagaaaattgagacagttggcaagt

SEQ ID NO: 2552 - DNA, 157 bp, Cicer arietinum
accaagccaatttccccccccttttctcggatcgcgtatttctgcaggccattggggccatggacgttgtcggattcctctgtagaggtttttcctctgttttttcaccggtttctctacttgctcactaactgtgggagtgtaggatcttttgaga

SEQ ID NO: 2553 - DNA, 110 bp, Cicer arietinum
acagattcctgggtaaatatcaagctagaaagtggctcagaatgcgcacggtgagcaacaagaggagagatttttggaacatcccgcatacttggagcaggttgtaaggt

SEQ ID NO: 2554 - DNA, 246 bp, Cicer arietinum
gagaaaaagagttgcggctgctccatccccggcgaccccatcgcaccaccagcagctccactttcagccgccaatatggttatcccaccaccagtcaggcctcccaggattacaaaatttctcaaaccttatgttctaaagatgcatttcaccaataagtatgtgagtgctcaagtgatccacaccccaactgctactgtagcctcttctgcaagctcacaagagaaagcctggagatcaaacttg

SEQ ID NO: 2555 - DNA, 227 bp, Cicer arietinum
acctcttcaagtggcacgcccgttagacgccaaattgctaaatggtttaacatttggtcttgaaggctaacatcaatatttaaatgccggtcttgtagttgcactgtgctcgacatggttgaaaaggaccggacatgttggagacacacacttcgatcaaaccgacgctttgcctgaacagtttgtaaaagggttaacaaatgttagtttgcaaggaagggctcaga

SEQ ID NO: 2556 - DNA, 421 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaataattcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctactagtagagaggtgcctcttgggggtaatgagtacct

SEQ ID NO: 2557 - DNA, 303 bp, Cicer arietinum
accgcaagtttgggccctttggcaagctacacaatattggcattgctcttcgaatgaacagccaacttctcgaggacttttatgaagctcaacggcaaaccgccccaaccgaacctgtccttgcgtgggttcaaaacgtttgcacacgctggcaatccgatgaggcaatggcctcgcgcgctctgctcaaacgttcggccgtaaacaggatgctttccatcatcgaggaacgatgggttagccaaggcggcaaagaacaagacagaccagcgatattgaaagaaaatctctctcttgaggaat

SEQ ID NO: 2558 - DNA, 371 bp, Cicer arietinum
actgctcgtgaatctccaacattggcaacccataatttctgattatttatgagaattgcagatacagcagttgatcctcctcgcccctaatcaggactgtcagttagaattgcctgatctgtcgacacataagttctagaaatggacatgaatggaccgacgcacaattcctcttccttcaagatattagataagagattcttttgcccatatgatggcgcgctgtctcctaggtgtccatcgtatatagcataaaagacctaattcttgtcctttgaaagcaactaattttgctacatgataatcctccattggatggttgggtttccctttaacatggctaaagccatatttaaccgatgattgactgc

SEQ ID NO: 2559 - DNA, 219 bp, Cicer arietinum
aaaaaatggagacggtgatggaagatgtagaagaatacaactacagagaagtgaatcttccttctctgatcccagtggtgggtgagccagagcttgaaagagaaacaggggagagaagaagaggaagggatatagttatagccatagatcatggtcccaatagcaaacatgcttttgattgggctcttattcatctatgcagacttgctgatactatcc

SEQ ID NO: 2560 - DNA, 324 bp, Cicer arietinum
aaaaaatggagacggtgatggaagatgtagaagaatacaactacagagaagtgaatcttccttctctgatcccagtggtgggtgagccagagcttgaaagagaaacaggggagagaagaagaggaagggatatagttatagccatagatcatggtcccaatagcaaacatgcttttgattgggctcttattcatctatgcagacttgctgatactatccaccttgttcatgccgtttcagatgtgaagaaccaaattgtgtatgacatgacccaggtgctgatggaaaaattagctgttgaggcttttcaagtcgcaatggtga

SEQ ID NO: 2561 - DNA, 321 bp, Cicer arietinum
acaatagaggatttcttgtggttcaaattgtcagctgtgcgggactgccccactggatcttcgtccattgttctaagtgatggtctgattccatacagtttggatgatttgcaaagttacctgaataaatttgaaccatcatactatacaaaaaatggaaaagatcctctggtatatccatatgtcttgcttttaagcattcaattgcttccggctgtattatacttgtctaaggaaacaggagatgaaggatataacattgatgctgcacacctatcaattctactagctgatcatggggtcctttctgaaggtgctggt

SEQ ID NO: 2562 - DNA, 278 bp, Cicer arietinum
ccgggcaggtacgagaggctacttctgacctgcaagccaacctacgacagttgaagtttgaggttcccaccgacggccaggatgtgatctccaagagatacgaggagattcaacagaagatgacagacaagtttgcggctgtcatggacgagtaatgtaatactaatgttgcattactggttgtttctgtgttgaagctatagataggtcatactgggggataggtcagaagatgaccggtattcgattactgtttgcgccgccccatagtctagtgt

SEQ ID NO: 2563 - DNA, 130 bp, Cicer arietinum
actctctcgcgcgctgatcggaagtccgccatttgcacccgcattcgtcgttctcggagagcaagtagaccggcttcggagcagatggccttgatgtcggcacctgaaaggtcgtccttttgggagatga

SEQ ID NO: 2564 - DNA, 421 bp, Cicer arietinum
acaagttacacattggagaagttttatctactgttcctaccattgggttcaatgtagagaaggttcagtataagaatgttattttcacggtttgggatgttggggggcaagagaaattgagggcactctggaggctttattttaacaacacagatggtttgatatacgttgttgatagtctggaccgcgagagacttgggaaagctaaagcaggaatttcagacaatcataaacgacccatttatgctcaacagtgtcatcttggtgtttgccaacaaacaggacctgagaggagcgatgacggccagagaagtatgtgaaggattaggtctctttgatctcaagaatagaaaatggcacattcaaggcacttgtgcacttaagggcgatggtctttatgagggtttggactggttgtcct

SEQ ID NO: 2565 - DNA, 318 bp, Cicer arietinum
acagatggatgttgatgagaccaaggctccaaagaagaaggttaagaaaacaaatgttcctatagcagagttagtttatggagcaatggcacctgtggatgtccagaaagcagtagagaaggagtttgaaatggctttgcaagatcgtgtgatggaagaaactaaggacaggaaaaatgctgttgaggcttatgtttatgaaacaagaaacaagctcaatgacaaataccatgactttgtcactgcttcggagagggaagatctcactgctaagcttcaagaggtggaagattggctatatgaggagggtgaagatga

SEQ ID NO: 2566 - DNA, 376 bp, Cicer arietinum
ttaaatcgtggaaattgaactctagggtttgttattgtatcgggaatcaaacaatcagcaatggcgttgaggagattctacaatgagatcaaggggaagaaggtaacagaacttcctcaacacgtgaaaccgatgctttcattcgattacctcaagaaatcaattcagagaggtttagataattacaacggaaagtatatcgaaacaagttcgattcaacctcttctccatgtctgttatggtggaatgatcttctcttaccttgttgctcttcctaatgagcgtcagcatctcgctcacaaagagcacgccgaatctcatcactgattcaggatcctgattgttgaattggagatggttggcttgcttgatcttt

SEQ ID NO: 2567 - DNA, 111 bp, Cicer arietinum
atgaggatgcggctgcgagggccaatcttccaaagacgggtgtggttcttgtaagcgttctggtagaatcgctggttctggggaacggggttcttggcgttgatgagaggc

SEQ ID NO: 2568 - DNA, 265 bp, Cicer arietinum
caacgccaaccgcaatagtcggctctcaatattgtgctccatatccacttgatcttgcgttggttaaaaaagttgggaccttttcacatggaaacttcgccgtcactgatgttaacggcaacatcgttctcaaagttaaaggttccattctaacccatgattaccgtgtcttctttgatgccgccggtaaccccatcctcaccctacgtaagaagttagtgactatgagtgatcggtgggaagcttttaggggtgaaagcataca

SEQ ID NO: 2569 - DNA, 339 bp, Cicer arietinum
actctctcgcgcgctgatcggaagtccgccatttgcacccgcattcgtcgttctcggagagcaagtagaccggcttcggagcagatggccttgatgtcggcacctgaaaggtcgtccttttgggagatgaattcctcgagatcaacatcctcgttgaggttcatctttgaggtgtgaagtgtgaagatcttgcgcttggtgttctggtcggggttctcgaagagaatctttcgatcgatacgtccaggtcggatcagagcgggatccagggtatcgatcttgttggtggccataatgaccttgacgtctccgcgatcatcgaaaccatccagctggttg

SEQ ID NO: 2570 - DNA, 213 bp, Cicer arietinum
acaagtatcaccttaggccattactgttttttgtagtagtatttgtcaagcagcacctctaaatactctccataagtaagggaagcatttgatggaataatctctttatgaatgtgaatttcctcaggaaaattgagtttttcatcccagtcaggttgcatgaataatgcaaatgtcgagcgttcaacactagcagactcctccccttttgga

SEQ ID NO: 2571 - DNA, 432 bp, Cicer arietinum
gcttcttcgataagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccgga

SEQ ID NO: 2572 - DNA, 281 bp, Cicer arietinum
acgaatatcatataaggggctaccaggatcattcagcgaggaagctgcaggtaaggcttaccctaattgtgaaacagtctcatgcagtgattttgaagaagcttttaaggctgttgagttgtggctgactgacaaagttgtccttcctattgaaaatacatctggtggaagcattcatcggaactatgatttacttcttcgccataggcttcacattgttggtgaggtgcagttggctactaacttctcccttctagctctgcctggtgtccgaaaagagt

SEQ ID NO: 2573 - DNA, 433 bp, Cicer arietinum
gggagtcgttcttctactcaatcattcatcatgggtcgtatgcacagtcgcggtaagggtatttcaagttcagctcttccttataagaggactcctccaagttggctcaagatctctactcaagatgttgaggagaccatctgcaagtttgcaaagaaaggtctaactccatctcaaattggtgttattcttcgtgactctcacggaattgctcaggtcaagagtatcaccggaagcaagattttgcgcatattgaaggctcatggtcttgctcctgaaattcccgaagatctttatcacctgatcaagaaggcagtgtcaattaggaagcatttggagaggaataggaaggacaaggattctaagttcaggttaattttggttgagagcaggatccaccgtcttgcgcgctactataagaagacaaagaagc

SEQ ID NO: 2574 - DNA, 314 bp, Cicer arietinum
cgtctctcttccccaaacattacctacttcattcgcaagcacaagaggctgcggatttcattgttgtttccattccatttccacccatacctgattcagatttacatatggcaactgaaacaaaggctgtcactgaggatgtcaagatcgatctctttgaagacgatgatgaatttgaagagtttgaaattaatgaagagtgggatgataaggattaagggaaagaagtaactcaacagtgggaggatgattgggaggatgacgatgttagtgatgatttctctcttcagttgagaagggagttggagagcagt

SEQ ID NO: 2575 - DNA, 308 bp, Cicer arietinum
gaagaagaaagcgcagtgaaggagcctttggatctcataagactcagtctcgacgaacgtatctacgttaaactccgttctgatcgagaacttcgtggcaagcttcacgcttatgatcagcatcttaatatgattcttggtgatgttgaagaaattgttaccactgttgaaattgatgatgaaacatatgaagaaattgttaggactacaaagaggacagttcctttcctgtttgttaggggagatggggtgatattggtttccccgccactgaggactgcatgacatggactgatgatgaactttgt

SEQ ID NO: 2576 - DNA, 427 bp, Cicer arietinum
caagatcgctgaaagtcagctttattttcttcactataagatctagttgaatcttaacctcaaactttcgattcgaagctcaaatcactgaaatcgaaccttcttcagatctggtggatttgttttcgattttcattttgtcgttcgtgaaatgtcggtttcatcgaaaggagattcggttcaaattagagaggtttggaacgataatctcgatgaagaatttgcattgatccgtgaaatcgttgaccaattcaactttatagctatggatactgagtttcctggagttgttcttcgtcctgtagggaatttcaaaaacatcaacgattataactaccagactttgaaggataacgttgatatgttgaagctgattcagttaggtctcactttctctgatgagaacggaaacctacctaactgtggt

SEQ ID NO: 2577 - DNA, 440 bp, Cicer arietinum
cagacagctgctccggaatcctcccttgctccgtccactccccgccatctcaatctcgtccgaaaccggccttcccgtccgtcatacgaaaatggccaacagagttccaattcctaccagcaattcatcacttattgctatgattgcagatgaggataccatagttgggtttcttttggctggagtgggaaacgttgacatacgtaggaagacaaattacctcattgtggattcaaaaacaactgtcaaacaaatcgaggatgcattcaaagaattcacaacaagggaggatattgctattgtgctgattagccaatttgttgcaaatatgataaggtttttggttgatagttataacaagcctgttcctgcaatacttgaaatcccatccaaagaccacccttatgatcccgcgcatgattcagttctttcacgagtga

SEQ ID NO: 2578 - DNA, 192 bp, Cicer arietinum
cacgaaaccaaccttcgaagcctcccagaactctcattaaccgacatcaaaatggctctcatcaacgccaagaaccccgttccccagaaccagcgattctaccagaacgcttacaagaaccacacccgtctttggaagattggccctcgcagccgcatcctcatgactccctacctcatccttctctggggt

SEQ ID NO: 2579 - DNA, 356 bp, Cicer arietinum
acaactacagatcatagaattattgcgatcagaaaccctagaaacagaataacactgttctcaatcaatgaaaattcgatatccgaaaaccaaaacctaaatcaagagataaaacgacgatcacttaggaggagtgccgaggatgctagcctgctgaagttcgaggtcgttaagctgctgctcgcggtccatctcgatgatgagagggacgacgagaacaaggaaggtggtgccggcaatccaggcagcttttccggtgctcttgagaagcttattaacgacgaaggaggtgtctgatgcggtttgctttccccaagaaacgatttgagagcgtgagatcttggtgatggagaagg

SEQ ID NO: 2580 - DNA, 327 bp, Cicer arietinum
actcttatatttttgaaccaaataagatataagattggtgtctattatggaaatccagaagtgacaagtggtggaattgcattgaagttttttgcttcagttcggttagaagttcgccctatagggaagataaaatctgccaaaggagatgaagaaattggccttaaagttcgggtaagagtgcaaaagagcaaggtgtcaaggccttacaaagtagctgaatttgatatttcatttggggagggtgtcaataagctgggctgtattttagattgtgcagaaatgatgaatatcgtcttaaagaagggctcttggtacctggcccgg

SEQ ID NO: 2581 - DNA, 426 bp, Cicer arietinum
acgatttatgctctttaattgctagctcaaaaaccctggctgcatcatataaagcttgcacaagtccatcataaaagttttcatcttcgagtgaactattcagtttcatcctcattttttcaaggttagcactagtgtcagcttgtggactcccattgacagtcataccatcatcagaggtggcaaatgggaacatgcgtagattccttaagggtagaaagttggcggtggagtgcgatttaactgccatgtaacggatggagaatttggagagaaaataactgagtttgcgataactagagtagagatagagagaagttagaaggagggaaatggaagaggttgggtggtccaaaacagacacggaaagaaagaaagaaataatggaaatgatgatttagctagcataagggagagggtgcttta

SEQ ID NO: 2582 - DNA, 461 bp, Cicer arietinum
cagacagctgctccggaatcctcccttgctccgtccactccccgccatctcaatctcgtccgaaaccggccttcccgtccgtcatacgaaaatggccaacagagttccaattcctaccagcaattcatcacttattgctatgattgcagatgaggataccatagttgggtttcttttggctggagtgggaaacgttgacatacgtaggaagacaaattacctcattgtggattcaaaaacaactgtcaaacaaatcgaggatgcattcaaagaattcacaacaagggaggatattgctattgtgctgattagccaatttgttgcaaatatgataaggtttttggttgatagttataacaagcctgttcctgcaatacttgaaatcccatccaaagaccacccttatgatcccgcgcatgattcagttctttcacgagtgaagtatctcttctctgctgaat

SEQ ID NO: 2583 - DNA, 426 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaa

SEQ ID NO: 2584 - DNA, 435 bp, Cicer arietinum
acggattctgtgtgagcacctgtcgtttcctaagctcctgatccctcatcttcatcttcatgccatccgggggagacccgtagaccaggtgattacgatcaaatggagcctccaacaacaggccctcgagcgtttccacgcgagagacagccacgtagcttaaaccagtctgaaagtcctggcaggagagatccgtaacgatcatatcttctgtgatgctttgtgacttgtgcacggtaatggcgtagcatacgatcaggggaaactgcgtgcgagcgcagaaagtggctccgatgaggaagtccctctcaactgagagaatcgggacaatcttcttgccatcgggggtggtcaggaacaccggtccgttgtatttgtcaaactccatcatgataacacagggagagtcttggatggggtcagccccgggcgccc

SEQ ID NO: 2585 - DNA, 446 bp, Cicer arietinum
ggtaaactcatgcttgctcaattctctgaacttgttaatgatttttacaataatgggttgccttcaaatctttctgctagtaggaatccaagtttggattatggtttcaaaggtgctgaaattgcaatggcttcttattgttctgagttgcaatatcttgctaaccctgtcactacacatgttcaaagtgctgaacaacataaccaagatgttaactctttgggtttgatttcatctagaaaaacaaatgaggctattgagatcttaaagttgatgtcttcaactttcttgattgcactttgtcaagcaattgatttgaggcatttggaggagaatttgaagaacactgtgaagaacactgtgagtcaagttgcgaagaggacgctaacgactggcgtgaatggtgaactacatccatccagattttgtgagaaagatttgctcaa

SEQ ID NO: 2586 - DNA, 116 bp, Cicer arietinum
gcttcttttacccgtggattttctgaatttgcatcaaatgctaatgggcagtctgcagttgctaaacttaggccgaaggctgacattagcaaagtttcgagtgatggaaatggaag

SEQ ID NO: 2587 - DNA, 428 bp, Cicer arietinum
actttctgtacctgagacagaaacattttctcttgttgacaaaaaatccttgaaggttgaaaatataatggatttcagctggtcaccaactgacccaatcatctcactgtttgttcctgagtccggaggtggtaaccaacctgctagagtaagtcttgttcaaatccccagcaaagaagaactcaggcaaaagaacctttttagtgtctagtgactgcaagatgtactggcagagcaatggggatcaccttgctgttaatgtagaccgatataccaaaacaaagaaaagcacttacacaggctttgagcttttccgcataaaagaacgggacatacccattgaagttctagagcttgagaataagaatgataagatcattgcatttgcttgggaaccaaagggacataggtttgctattattcatggt

SEQ ID NO: 2588 - DNA, 231 bp, Cicer arietinum
ttctagcgtccgcccggacaggtactggcttttagaaattacttgtgatttaaagaagaatttcttaaaagatgtggatcctgactgctcttctttaggctgaacaaccttatgggccattggagcatttccaacaaaatatgtatcggaaagatctcctatgactgatttcaatgcagattctgcacacttacgcattgtttcctctgattcatatactttctctggaaa

SEQ ID NO: 2589 - DNA, 292 bp, Cicer arietinum
ccgcccactacgcaacatttgctaaccacttctttcacaatggctcagaaaccctcacacaagcattccaaaagcgtcatggctgctaccgctcaggaccacctcgagttcggaggcaagatctcatggcttgcttccctcgacaccgctttccgacctcagcgcaactaccgccgctcctccatcatctgcaccatcggccccaagaccaactctgttgaggccatcaacaagctccgagattccggtcttaacgttgtccgcatgaacttctcccacggatcatacgagt

SEQ ID NO: 2590 - DNA, 255 bp, Cicer arietinum
gaagaggcataagcagatgacgaccagactcaagaagaacaggaagaagagaggccacgtcagcgccggtcatggtcgtgtcggtaagcacaggaagcatcctggaggtagaggtaacgccggaggtatgcaccaccaccgtatcctcttcgacaaataccatcctggttatttcggtaaggtcggtatgcgttatttccacaaactccgtatttaattctactgccccattgtcaacatagacaagctatcttc

SEQ ID NO: 2591 - DNA, 435 bp, Cicer arietinum
actgttttagccttgctctctgaagcgcaaaccaccgagaagcatgctcatacctaagataagcaataaattcgctaagattgaacctaatagagatgcctggacaatgcgaatttcgtctttcgttaaggcatagatgaagataatgagttccacggcgttgccaaaagtgacattcagcaacgcgccgagagcatcacccatctttcgggcaacagactcggtagcataagctaagagaccagcaagaggaataatggcaactgcattgagaccaaaaacaatacctccattgatgccatctacctgggatactgcaataccaacagggacgaagatgaggaggatgttgagccagctgtggaagatagaaattttgacacttcgcttaacttcagcgaagaatctgttcattttgctggttggattggggtt

SEQ ID NO: 2592 - DNA, 135 bp, Cicer arietinum; identical to SEQ ID NO: 2193

SEQ ID NO: 2593 - DNA, 435 bp, Cicer arietinum
tacactcttcactcgcgtagcagcggcatcaactagtctcaggaggagaaaaatgtctcacaggaagttcgagcacccaaggcacggatcattgggatttctcccaaggaagcgtgctgctcgtcacagaggaaaagtgaaggcattccctaaggatgacccaacaaaggcacccaagcttactgccttcttgggttacaaggctggtatgacacacattgtcagagaagtcgagaaaccaggatccaagcttcacaagaaggagacctgtgagccagttacaatcattgagacccctccaatgattgttgttggtgttgttggttatgtgaaaactccccgcggtcttcggactttgaatactgtttggactcagcatttgagtgaagaaatcaagcgtaggttctacaagaattggtgcaagtccaagaagaa

SEQ ID NO: 2594 - DNA, 222 bp, Cicer arietinum
acatcttttatcatgtgccactttacaggaaagctcccactccatttatcttgctgccaaaaatccatatcctgattaaaatcaactgaaccaatcatctctgcaactccgcagaattgaccactggcattaacagaaaaaaataggaagataggacagactccgggtttttcagctgatactttctttgaatcctcataagcattttccagcttcttgttt

SEQ ID NO: 2595 - DNA, 310 bp, Cicer arietinum
acatcttttatcatgtgccactttacaggaaagctcccactccatttatcttgctgccaaaaatccatatcctgattaaaatcaactgaaccaatcatctctgcaactccgcagaattgaccactggcattaacagaaaaaaataggaagataggacagactccgggtttttcagctgatactttctttgaatcctcataagcattttccagcttcttgtttccatgaggtgtagaagaccacacattgtatttgatgcttttgtgcacatcatcctcgctgtatgattttataacaaaaaactttgcat

SEQ ID NO: 2596 - DNA, 273 bp, Cicer arietinum
gtcgaggcaaggataaaacatattgccttgctttgaggcattgaattcaaaaaagacgtcaaatcccaacccccgaaaaggctctgcacacctgagcaccttcgtcttgatgatataacttcattcccctttcatgaaacggttggcggaactcgatctcgcccagggcagtccactgggaggggcttcagcgatggaatactttttggtggttgggattcgggaccggtgttcggctacggtcgtgaatagggtacaagcgaatcattgatg

SEQ ID NO: 2597 - DNA, 436 bp, Cicer arietinum; identical to SEQ ID NO: 2149

SEQ ID NO: 2598 - DNA, 432 bp, Cicer arietinum
accaccatcaaatggaggttgtggtttcatcattcgaacaagttgcggggattggttccgcaaggacatacactgcccttgcactacaaacaatctccaagcaatttaggtgtttgaaagatgccatagctggacaaattcgtgctacaaataagagtttgggagaagatgattgctttggagttaaaattgaaggttcaaggcttaaatatgtagatcatcaattacgtcaacaacgtgctcttcaacagttgggaatgatccagcataatgcttggagaccccaaagaggattgcctgaaagatctgtttctgttcttcgcgcttggctctttgaacacttccttcacccttatcccaaggattcagataagctcatgcttgcaaaacaaacaggacttactaggagtcaggtttcaaattggtttataa

SEQ ID NO: 2599 - DNA, 430 bp, Cicer arietinum
accaccatcaaatggaggttgtggtttcatcattcgaacaagttggagggattggttccgcaaggacatacactgcccttgcactacaaacaatctccaagcaatttaggtgtttgaaagatgccatagctggacaaattcgtgctacaaataagagtttgggagaagatgattgctttggagttaaaattgaaggttcaaggcttaaatatgtagatcatcaattacgtcaacaacgtgctcttcaacagttgggaatgatccagcataatgcttggagaccccaaagaggattgcctgaaagatctgtttctgttcttcgcgcttggctctttgaacacttccttcacccttatcccaaggattcagataagctcatgcttgcaaaacaaacaggacttactaggagtcaggtttcaaattggtttat

SEQ ID NO: 2600 - DNA, 228 bp, Cicer arietinum
acatcttttatcatgtgccactttacaggaaagctcccactccatttatcttgctgccaaaaatccatatcctgattaaaatcaactgaaccaatcatctctgcaactccgcagaattgaccactggcattaacagaaaaaaataggaagataggacagactccgggtttttcagctgatactttctttgaatcctcataagcattttccagcttcttgtttccatga

SEQ ID NO: 2601 - DNA, 435 bp, Cicer arietinum
actgattcttccctttcagataaaacctgcagcaggtgccatccaaattgtgtcttgcaccttacaattttgtttaaaggtgcaccaaatgcagcctcctcaaattcgggaaccatttgtccctttctcacccacccaagcattcctccttcttctttagatgggcaaattgaatactccacagcaagatcactcaaatcttcacctgaagtgattctcttctgaatatccaacaataatttctggtcatcttctttcaccaacaaatgctgcaccaataattccctttcttcaccaacttcaacaccagtacctgcccgggcggccgctcgatgtatgagaaagagatggttgtagtgtgcaaagagagttataaggttgtggttatcgttgttgtagagtgtcttgcttgtgtttgtttgcacctcggccgcg

SEQ ID NO: 2602 - DNA, 251 bp, Cicer arietinum
agacaaccttgctatggaggggaagtatagggaagcactgggtaaatgggaaactgctattacattggcacctgatgttgcagttttgcatgaacaaaaggcccaagttttactagaaattggagatgcttggaattccttaaaggctgcaactcgagctactgaattgaaaccatcgtgggctgaggtatgggtcacacttggccgagcacagctgaattatggtgagccagataatgctattgaaagtt

SEQ ID NO: 2603 - DNA, 118 bp, Cicer arietinum
ggaatactctgtatttctttgtcttagaactgccaatcaagttctcgttgcatcgtcttttgcgagcatgactgatggtctttgatcctaacaccgcctggttcccgaccgtccaatt

SEQ ID NO: 2604 - DNA, 341 bp, Cicer arietinum
actggctcaccgagcgcaccttcggcgagttctctcgcagcttcaacttccccactcgtgtcgaccaggacaacgtttctgccaagtttaaggacggtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgtaggcctggcttggtcattcgctccttgt

SEQ ID NO: 2605 - DNA, 165 bp, Cicer arietinum
aaaaattctttcttggcacccactgttagtgcggtgctaggagcgggattttctacgggctatgcgactacacaaaactgcggggatgctatcggctccctaacagcagctttcggagaaggaattttggagagttcgccttctctgacaacaactttgtcggat

SEQ ID NO: 2606 - DNA, 368 bp, Cicer arietinum
acaataaagcgacctgcaggtgaccaaaacaaagcgtttgcctgcttgcctttcagagtagtgagctttgaaacccggccagtgttttgagcagtcttcatagagtagatactgacatcaggcttagggtcatcaccatgaataatagcaaacctatgtccctttggttctccaagcaaatgcaatgatcttatcattcttattctcaagctctagaacttcaatgggtatgtcccgttcttttatgcggaaaagctcaaagcctgtgtaagtgcttttctttgttttggtatatcggtctacattaacagcaaggtgatccccattgctctgccagtacatcttgcagtcactgacactaaaaaggt

SEQ ID NO: 2607 - DNA, 434 bp, Cicer arietinum
acccttgctgatccaacatccaaaaagaatccacccttcatttagtgcttcggttgagaggtggcatgcagatattcgttaagaccttgaccggaaaaaccatcacccttgaggttgaatcgtctgatacgattgataatgtcaaggccaagatccaggacaaagagggtatccctcctgatcagcagaggcttatctttgcagggaaacaacttgaggatggtagaaccctagctgattacaacatccagaaagagtctacccttcatttggtgcttcgattgagaggtggcatgcaaatttttgttaagactttgacagggaagaccattaccctcgaggttgaatcttctgatacgattgataatgtcaaagccaagatccaggacaaagagggtatccctcctgatcagcagaggcttatcttcgccggt

SEQ ID NO: 2608 - DNA, 281 bp, Cicer arietinum
actcttttcggacaccaggcagagctagaagggagaagttagtagccaactgcacctcaccaacaatgtgaagcctatggcgaagtagtaaatcatagttccgatgaatgcttccaccagatgtattttcaataggaaggacaactttgtcagtcagccacaactcaacagccttaaaagcttcttcaaaatcactgcatgagactgtttcacaattagggtaagctttaactgcagcttcctcgctgaatgatcctggtagccccttatatgatattcgt

SEQ ID NO: 2609 - DNA, 202 bp, Cicer arietinum
acgaatatcatataaggggctaccaggatcattcagcgaggaagctgcagttaaggcttaccctagttgggaaacagtctcaggcggtgattttgaagaagcttttaaggctgttgagttgtggctgactgacaaagttgtccttcctattgaaaatacatctggtggaagcattcatcggaactatgatttacttcttcgc

SEQ ID NO: 2610 - DNA, 281 bp, Cicer arietinum; identical to SEQ ID NO: 2144

SEQ ID NO: 2611 - DNA, 99 bp, Cicer arietinum
gattagcgtggtcgcggccgaggtaccgcgtcagcgtcacgcactattgcgaagaaccctgaagcaaaagagcggatagagaaggcgtggaagaactat

SEQ ID NO: 2612 - DNA, 434 bp, Cicer arietinum
acaaagatgataatttatggagaacaacatcagaggagaagagagagctggagcgccttcagaaaccattatataattcagttcgtcgagcagcagaagttcatcgtcaggttcggaaatatatgaaaggcattataaagcctggaatgatgatggctgacttatgtgaaacattggagaacaccgttcgtaagctcatatcagaggatggcctaaatgcaggcattgctttccccactggatgctctttgaattgggttgctgctcactggacccccaattcgggcgataagactatactgcagtatgatgatgtgatgaagttggattttggcacccatgtagatggatatattgttgactgtgcttttaccgtggcgttcaatccagtgtttgatccattgcttgaagcttctagagaagcaacctatacg

SEQ ID NO: 2613 - DNA, 254 bp, Cicer arietinum
gcaagtcgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccctttgtgccttggtatgctggatggtgaaggaagaggggtatccctgt

SEQ ID NO: 2614 - DNA, 427 bp, Cicer arietinum
accaaaggaggtcatttgagaattactccaaccctgcattccagtatcctatgatgccagcatgtagagctacaacggcttcccctatctttgttgcagctcccgccgagaaaggaaactttgttgtcgactttctcatgggtggagtttcagctgctgtgtctaaaactgctgctgctccaattgaacgaattaagcttttgatccagaaccaagatgagatgattaaagccggtagactttctgagccctacaagggaatcggtgactgttttaagcgaacaatggctgatgaaggtgttgttgccctatggagaggtaacaccgcaaatgtcatccgttatttcccgactcaggcttcgaactttgcattcaaggactacttcgagaggctcttcaatttcaagaaggacaaggatggttactg

SEQ ID NO: 2615 - DNA, 130 bp, Cicer arietinum
acaaagctttcacatttacaatagttaaaaattaaactcttcacaacatttttttttacttttcaagtaaattatgttctctgctgaaggaattattgaggtaatccttcgacctccccatctcttgtgc

SEQ ID NO: 2616 - DNA, 375 bp, Cicer arietinum
tggactaataataatctaggtctcgagtggctaaagcactttgatcgggctacagctaagcgaacgaacagtcgctatcgcctcttgatccttgatggtcacaaaagtcaccactccgtcgaattcgaggaatattgcaaagagaacaagattatcacgctctgtatgcctgctcatgcctctcatctacttcagcctcttgacgtagggtgctttgggccgctgaaaaaggcatatggttgacaaatagagcatctgattagatgctctataacctacatttccaagactgagttctttcctgcctttcacgccgcccaccaagctgctattacagaaagcaatatcaagggaggtttccgaggagctgggctt

SEQ ID NO: 2617 - DNA, 283 bp, Cicer arietinum
accataccattcacacaattacacatatctgcttcaagctttcatttgggataagcacctcacttgcagttgcaagggtcacatgtgcagcttgatccacacttgcagccaccatcttcagctgcaacactcatttcagctccctcgaaatggatctttgtcggaccaacgcccaaaaccaccgtctctgtggtttcgccggcttcgacatagctcaatcctgatctcttgttgcatttgcagctatcgccacagttgcagctacttccacagttgcagccag

SEQ ID NO: 2618 - DNA, 351 bp, Cicer arietinum
actttatacttccctgccattgctgccaatctatccacctcaggaccgggcacgtcaatggcagctgaatgatacttcctgaaatcttctctacccttggcagtgcggttaccaagagaaactccaaaaacagaaccacgcgggtagccaccaatatatgcttctggaaacaccacaatttgggatccatagctagcagcttctgccagtaatctctcagctttatctaaagtggcgggagtgtcgtagaagattgtggaagcttgaacaacagtggcgcggacagtttgtgcgttgaaatcggagcccatatcgacctcggcgatgagtgggccgtcattgatgattgga

SEQ ID NO: 2619 - DNA, 353 bp, Cicer arietinum
actcatccatgagggctctagcttgcatgaatgggttaagatacgatacacgcagccacacaagcttgaaaacattgttcaacaagcacttcaaaggtgctctctttcttgtgttccaaggtatgatactaaaattttggaagatgttatgttggaactcattgaactagggctactttgcacacagaacaacccttcaacaagaccaaccatgctggatgtagcacaagagatggggaggttgaaggattacctgagtaattccttcagcagagaacataatttacttgaaaagtaaaaaaaaatgttgtgaagagtttaatttttaactattgtaaatgtgaaagctttgt

SEQ ID NO: 2620 - DNA, 432 bp, Cicer arietinum
tttcttggcacgcactgttagtgcagtgctaggagcgggattttctgcaggccacgcgaccacacaaaaactgcggggacgctatcggctccttaacagcagttttcagagaaggaattttggagagttcgccttctctgacaacacctttgtcggatctaatggcggcacctcagaaccagaacgccttagatatcggaggacgatgcctatggcatcggtagcgacatcctcccgatcaacgacgccgattgcgatgggtttttctcctttgaaagcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgac

SEQ ID NO: 2621 - DNA, 435 bp, Cicer arietinum
gcttcttcgagaaccggattttctgaatttgcatcaaatgctaatgggcagtctgcagttgctaaacttaggccgaaggctgacattagcaaagtttccagtgatggaaatggaagctctgaagtattgggagagcaaaatcgaggccctaggagtagtacatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccggagtc

SEQ ID NO: 2622 - DNA, 359 bp, Cicer arietinum
ctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtgttctgcggcagcagatgtagcgatgcgtgagagaattctggtcggtggaaaaattctacaaattgcctccgaacccgctgacgggtgacgggcttgacaaaaacagcgccttttgtgccttggtatgctggatggcgaaggaagaggggtatcctgt

SEQ ID NO: 2623 - DNA, 292 bp, Cicer arietinum; identical to SEQ ID NO: 2589

SEQ ID NO: 2624 - DNA, 347 bp, Cicer arietinum
gggaaatatcccgccacagctctgtggagcatattgatatttgtgagatagataagatggttattgatgtttctaagaagttttttccagatttagctgttgggtttgaagatccccgtgtacatttgcatgttggtgatgctattgaatttcttagatgtgctcctgaagggaagtatgatgctgtaattgttgattcctcagatcctgtgggtcctgcccaggaacttgtagagaaaccgttttttgagacaataggtaaagcattaaggcctggtggagttctttgtaatatggcagaaagtatgtggcttcatacacaccttattcaagacatgatctccatt

SEQ ID NO: 2625 - DNA, 320 bp, Cicer arietinum
actcgtgagatgggatatctttttggacagtatagacgtctagctggtaattttcagggaacttttacagggccaagaatattttggtctggctccagtcttcgacctgaagctactggctatgggctggttttctttgcccagctcatgctatctgacatgaataaagaactcaaaggattaagatgtgtagtgagtggttctggaaagattgcattgcatgttttagagaagctaattgcatatggtgctcttccgatttcagtatcagattctaggggctatttggttgatgaagatggatttgactacatgaaagt

SEQ ID NO: 2626 - DNA, 320 bp, Cicer arietinum; identical to SEQ ID NO: 2625

SEQ ID NO: 2627 - DNA, 288 bp, Cicer arietinum
actcatcatcccaaaagaaatccctaaccagctccgggctcgcattttcaaacactgttctactgcgatattgtggcggcccactctcttggtccctacgccaagcttggtaactcatagatggtgtagaacgatccatcatctgaatccaggcgggcccaccatctttttcctcaaccaacttacttaaataacgcaaatcatgttccgtcactacacacttcaatcccttttcactttccgaagaaccagaactggtggagtatgatgaaccgggttgactttgaa

SEQ ID NO: 2628 - DNA, 330 bp, Cicer arietinum
gtcaggtgagtctccgtcatcatcagcctctgatgttgacaatgttaacaactctacagcagctgacaaagttgccctaaccaagactgtcaattcaccccaagttgctggaaaccatgttattgctgcacgaagtcgccccaattttgcgaggatactcaattttgctcaggatgtgaattttgccatggaagcctcaaggaaatcaaggaatgctttcgcagctgctaatgcaaacttgagtgtgggcaagaatgcagagggtatttcctctatcaagaaggcccttgattttagctttcaagatgttgaggggttactacgtttggt

SEQ ID NO: 2629 - DNA, 412 bp, Cicer arietinum
  misc_feature (349)..(349): n is a, c, g, or t
  misc_feature (403)..(403): n is a, c, g, or t
gcgggattttctacgggctactcggccacacaatactgcggggacgccatcgggtccctaacagcagttttcagagaaggaattttggagagttcaccttctctgacaacacctttgtcggatctaatggtggcacctcagaaccagaacgccttagatatcggaggacggtgcccgtggcatcggtagcgacatccttccgatcaacgacgccgattgcgatgggtttttcccctttgaaggcaagccgcaccgccgggctctgattccttcccaaggtttttccctgccgccacgacatacgactacgagctacaacttggttactggagattgtggactgcgtcancagatgtagcgatgcgtgagagaattctggtcggtggaaaaagtcgacagtatncccccgaac

SEQ ID NO: 2630 - DNA, 237 bp, Cicer arietinum
acacggcccaaggtcgagaagacccaggtcagaacacaggaacttcaattcaacaatgtgacttaacaccaactgcagaccttaaacctgtggtgggctccatcaaaactttcctcggccgcccatggaagaaatactccaggactgttgtgatgcaatcctttctggatagccacattgatccaacaggatgggctgaatgggacgccgcgagtaaggactttctacaaacattgt

SEQ ID NO: 2631 - DNA, 276 bp, Cicer arietinum
gcttcttcttagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtatcgaggaagggaacatcatcatttataccgatcaatacaacaaagaggatttccctcttga

SEQ ID NO: 2632 - DNA, 432 bp, Cicer arietinum
cgcgagcgaagacgctgagatccaaatcaacttttcagaatgaaggtcaacggtgcaaatccaaccactggatgccagaagaagctggaaatcgatgatgatctgaaactccgtgcattttgggacaagaggatctcgcaagaggttaatggcgatgctttgggcgaggaattcaaaggttatgtcttcaaaatcaccggaggatgtgacaaacaaggttttccaatgaagcagggagtgttaactcctggtcgtgttcgcctcttgctccaccgaggaactccttgtttccgaggatatggaaggcgtaatggagagcgaaggaggaagtctgttcgtggttgcattgttagtccagacctctctgtcttgaacttggttattgtgaagaagggtgaaaatgatttgccaggcttgacagatgttgaaaag

SEQ ID NO: 2633 - DNA, 429 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgggaggtgtaggataagtgggagctggaaacagcgaaagtgaaataccactacttttaacgttattttacttattccgtgaatcggaggcggggcg

SEQ ID NO: 2634 - DNA, 420 bp, Cicer arietinum
accagaatgatcctactggcacacctcagttgagagactatgagcatatgctgcaggtgctcaatcacatttttagcacggcgccagagtggacggatgcggcggagagtgtgggcatggtaggtgtgccgctttgtgccatctttgactatcctatgggaacgcctagtggttatgcggcgtttttggaccctgatgtgaatcggatgctgaagaaggttctcaaccactggggcaagtttctcatgacacctaaatcggctgaagttctgggagatcacaagcagggctggttcggacccgtgggtctgaatgacctcgtcgaggtcgccaacaagcccaacaaaacgaacttcaagtttgaggaggtctttgagtgtgatccatcagccaaatactacggcttcaagtcctgggacg

SEQ ID NO: 2635 - DNA, 433 bp, Cicer arietinum
acatgtaacgttaaatgtaacatattgttattgttaaggaaagaatcatcttccaatattctttgtctgcaaggattaattgataataactagccaaaagaattgcttgccagcaaacaagactgagtctgaaaaacccgaaaaaaggtcccgggtgcacacattattaccaggaagactttgtgttgtaatacgttgcaaacctcagtgtgacgcttcagccaatttctcttctttcttgcctcctgcaaataacttgtatcctccatagatgagtagtccccagccagttaaagaaacaatcacaaagtgctcttccttccatttagaaggactcattgggtctttccagcaggcaactttagggggaccatggtgatctgcagctccggcgagaccgcgacgttggatgagttgaatcggagatttggaa

SEQ ID NO: 2636 - DNA, 270 bp, Cicer arietinum
cttcgaagttacccaagatgtcgtcgggcaaggtcaaggctggtgcgctctggggcaagaacaaggatgatttgacaaagcagctcgctgagctcaagaccgagcttggtcaactccgcatccagaaggtcgcctcttctggctccaagctgaacaggatccatgacatccgcaagtcgatcgcccgtgtcctgaccgttatcaacgccaagctaagggctcagcttcgcctgttctacaagaacaagaagtatgcccctctcgacctcc

SEQ ID NO: 2637 - DNA, 435 bp, Cicer arietinum
caaaattggaaaagagattttggaatcaaacgcagcgtttcggtgtcttcgaattcgcataaacaaacggcacactccaaaatctcttttccaattttgtggatcttaacttcagagtattcgagaatcggaaaagtattgatgaccgatgaatcgagtccacgcgccgccctacgcgatctaccgtcggtgatggggagaacgaagttagaagttggtgaatcggcgcagcgacggatgtagatggagaaaaagcccatgaggaaaagagcagcgactaaaattactatgattatagcgaaggaagggttgaattcgttaggatttgtatctgtgaaatcattggacttgttttgggcttgggcttttgtggcggagagaagaattattcccggtaagattaggaggaggaataattgggaattattgattgtg

SEQ ID NO: 2638 - DNA, 434 bp, Cicer arietinum; identical to SEQ ID NO: 2170

SEQ ID NO: 2639 - DNA, 250 bp, Cicer arietinum
actgccgcccccgatcagaaggtgctcggcgccatggagcgagtgctcaatgtcaagttgcgaggcagcgacattggcgctcccaagttccccaacaagaagaaatgagcaattgcgtccaatgcttagacaaaagaaattgtaagagggcttcagagccgagtcgagcgttagcgaatgatgatgacatcttggttgggaaattctgtagtttcgtgtgggccgtcatgatgctttatgacatgggtac

SEQ ID NO: 2640 - DNA, 248 bp, Cicer arietinum
actgccgccctcgatcagaaggtgctcggcgccatggagcgagtgctcaatgtcaagttgcgaggcagcgacattggcgctcccaagttccccaacaagaagaaatgagcaattgcgtccaatgcttagacaaaagaaattgtaagagggcttcagagccgagtcgagcgttagcgaatgatgatgacatcttggttgggaaattcgggagtttcgtgtgggccgtcatgatgctttatgacatgggt

SEQ ID NO: 2641 - DNA, 290 bp, Cicer arietinum
acaagggcagtcggtgatggtcaaggtggtctcagaggtgacggtgtaggtcttgtcaccgtaggtgagagtggtagcaccagggcagtaggttgtgatggcggtgacaacctcggtggtgtagtgagtgccgttggagggaggggcgtagtagggagaagcggtggcagctccgatgaggaggccagcagtagcaaccttgatagcaaccattttgaaggatttgggcgtgttgattaagttctgacttttaaaacgagtgaagtgcagaaaagcaagattgagctttg

SEQ ID NO: 2642 - DNA, 317 bp, Cicer arietinum
gattctcaaggttcagggcagtgagagaggttttttttgttgttgtgaatttgggtggaaaaaaaatagattgtgtgcaaaggatgaggtttataagaaaaaaaatgggttttttgttgttgtatattttggagaaattcaatagaaaaaaaaggatttgggtttgttttgccttccttattgttccttctccacaggactcaagtctacagatacaggtggaattgcatggccatatagctttgttgctttggtttggcccttaaaactatattgttttaattcagaggtgtgttgattattttttgttcttcttt

SEQ ID NO: 2643 - DNA, 309 bp, Cicer arietinum
accaagaatgcgccctccccggcgattgggttgttgcattgagcgaaaatggatggactaataataatctaggtctcgagtggctaaagcactttgatcgggctacagctaagcgaacgaacagtcgctatcgcctcttgatccttgatggtcacgaaagtcaccactccgtcgaattcgaggaatattgcgaagagaacaagattatcactctctgtatgcctgctcatgcctctcatctacttcagcctcttgacgtatggtgctttgggccgctgaaaaaggcatatggttgacaaatagagcatc

SEQ ID NO: 2644 - DNA, 436 bp, Cicer arietinum
atgcctttgccttcaaggcaccatccagcaccacatcaagccatttcgtgatatgttggttcacggcctcagaagcctgccataacgcccagtgagacgctttgacttcctcccgagttaagttggtaaaggctgagtccattcccttggacatagacggtgggagagccgaatcgtcagttgcagtgatgaacaaagctggcatctcgaacttgtggccacccttcttgactacctctgcatcgtcgcggtggttgagctcctgcatgcggtaatagtttagagggccacgcagctcagggggttctttcgaggcatattctttggcgtagtagtccacctcttccttgctaacaagtggcgagggaccgagttccggtagcttgtcgaagtagataccgtccttggcagagaacccaagatcaccgataggggt

SEQ ID NO: 2645 - DNA, 406 bp, Cicer arietinum
actcttctccatatcctcgccgctccataagcttaaataggttgacttccaaatcagtttgggagacatcaagaaggctattgtctatgagcagcttcttcagttcgagagcaattttgatagctacatggtttggaatcttggttacagttagcattctactgagcaaaaatctggaaagaacatagtaatgatccgcattatcacccaaccacacctttaccttgacgaaatcgtatttggaagaagcgttacgggaagagaatctgacggaggaaaaggaagggtgttgttgtttatcatcactgtcttcttcgccactgatggggcttgacacagcaattcctttctctttctctttcttcatcaatcaatctcttctgtttcctctgtttgcaaatctcat

SEQ ID NO: 2646 - DNA, 401 bp, Cicer arietinum
acatccattgccaattttctaatgtcacctcaccaccaagagaacgaataacagacccaccactgcatgttcctactttgcagcattcttcaagtgataagcctttgatcactccatacaaaaatccacttgcaaaaaggtcccctgcacctgtagcatcaattgcctttgcttcacctatcgctggaacgcatacaatctcatttttatgtttagctatgcatccattagaacccaatgttactacagtccattgacagtatttggccagacattctacagcagctactggatcagcattctgttcacctcttagaagctctgttgcctcatcctcattagcaaagcaaaggtctatgtttccagactccaatagcttcagaagtggctgtttgaaattt

SEQ ID NO: 2647 - DNA, 292 bp, Cicer arietinum
actcgtatgatccgtgggagaagttcatgcggacaacgttaagaccggaatctcggagcttgttgatggcctcaacagagttggtcttggggccgatggtgcagatgatggaggagcggcggtagttgcgctgaggtcggaaagcggtgtcgagggaagcaagccatgagatcttgcctccgaactcgaggtggtcctgagcggtagcagccatgacgcttttggaatgcttgtgtgagggtttctgagccattgtgaaagaagtggttagcaaatgttgcgtagtgggcgg

SEQ ID NO: 2648 - DNA, 382 bp, Cicer arietinum
caattccatcctattagattttcacttgttaaattcaaccattttcatctctcttgaattcttcattcatcaactttgttaaccatgtcgaatactgctggtcaggtcatcaaatgcaaagctgcgattgcatgggaggcggggaagccgctggtgatagaagaagtggaggtggcgccaccacaagccggcgaagtccgtcttaagatactcttcacctccctttgtcacactgatgtttacttctgggaagctaagggtcagactccactgtttcctcgtatatttggtcatgaagctggagggattgtggagagcgtaggggagggtgtgactcatctggaaccaggggatcatgctctgcctgtattcactggggagt

SEQ ID NO: 2649 - DNA, 298 bp, Cicer arietinum; identical to SEQ ID NO: 659

SEQ ID NO: 2650 - DNA, 176 bp, Cicer arietinum
cgaccaaatatgtcaccggaaatggcaggggtttcgctccagtgcggcgattgtggtgctctgttgaaatcggtagaagaagctcaggaacacgctgagctcacctcacactccaacttctccgaatccaccgaacccgttctcaacctcgtctgcaccacttgctccaaaccatg

SEQ ID NO: 2651 - DNA, 409 bp, Cicer arietinum
acgagaagagaggccaaaacagatcaaacccttcttctcctttggaggagggagaaatgagccacattttctcgactttggaagctgaggatgttaccttttggcctttgctgtaatattttttgtttagttatttgtgtgcatgtatctttatatgagttgagttgaagttttgtgctgcagttcacgttaggcatgaggctctgtttggttaagcttcttttaagtttgaattaggtaagcagtgttaatggttttaagttgtaagtaaagaagtgcaaagggtagggtagcagtgtatctatcttgtaatatgtatgtgtatatagagcctttaatttactgtgttcttgttttaattaccttgtaagttttctcttgctgaataacaacctacttagttcttgac

SEQ ID NO: 2652 - DNA, 215 bp, Cicer arietinum
cggccgaggtttacagtcgactacgagctacaacttggttactggagggtggggactgcgtcagcagatgtagtgatgcgcgagagaattctggtcggtggaaaaagttcgacaatagattgcccccgaacccgctgacgggtgacgggcttgagaaatacagcaccttttgtgccattggtatgctggatggtgaaggaagcggggtttcctgt

SEQ ID NO: 2653 - DNA, 320 bp, Cicer arietinum
actcgtgttacgggatatctttttggacagtatagacgtctaggtgggggggttcagggaacttttacagggccaagaatattttggtctggctccagtcttcgacctgaagctactggctatgggctggttttctttgcccagctcatgctatctgacatgaataaagaactcaaaggattaagatgtgtagtgagtggttctggaaagattgtattgcatgttttagagaagctaattgcatatggtgctcttccgatttcagtatcagattctaggggctatttggttgatgaagatggatttgactacatgaaagt

SEQ ID NO: 2654 - DNA, 422 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctga

SEQ ID NO: 2655 - DNA, 357 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagttcgtagtcgactgtcgcggcggcagggaaaaacctcgggaagggatcagaggccggcggtgcggcttgccttcaaaggagaaaaacccatcgcaatcggcgtcgttgatcgggaggatgtcgctaccgatgccataggcatcgtcctccgatatctaaggcgttctggttctg

SEQ ID NO: 2656 - DNA, 154 bp, Cicer arietinum
accgatacacacaattacacatattggttccaatatctctgcctcaagctttcatttgctatatgcacctcacttgcagttgcaagggtcacatgcgcagcttgatccacacttgcagccaccatcttcagctgcaacactcatttcagctccc

SEQ ID NO: 2657 - DNA, 202 bp, Cicer arietinum
accttaagaacaacatctcctgtaagagttgggacctgaatggttccacccaaaattgcctgagtgatacttaaaacagtatctacatgaatatcagatccttccctacggaagacaggatcttccctgaccttgatagtaacatagagatcaccaggatgatctccatcaggatctgcaccaccacttctgtaaaccttaa

SEQ ID NO: 2658 - DNA, 427 bp, Cicer arietinum
gcttcttctagaagtggattttctgaatttgcatcaaatgctaatgggcaggctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggttacgaggaagggaacatcatcatttataccgatcaatacaacggagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaac

SEQ ID NO: 2659 - DNA, 243 bp, Cicer arietinum
ctcacattgacagttttgtggtgtgttgtggttgtgctaggagggttacccttctcctcggatgcacaacttgacccatccttttatagaaatacttgtcctaatgtccattccattgttcgtgaagtcataaggaacgtttctaagacagatcctcgtatgcttgctagtctcgttagacttcactttcatgattgttttgttcaaggttgtgatgcgtcagttttgctaaataatagtggt

SEQ ID NO: 2660 - DNA, 391 bp, Cicer arietinum
cgagaagaaatggaagaagaagccgtagtggtcgcagaagcactcgaatcactgtccaccgccgaatcatcgaatccaaatccaacagaagcaactcagcagcaattgttgagtgtggaacagagatatcagatcgtcaggagtatcggagaagagtgcattcaagaagatgaacttcttaatctcctcgctaaaaagcctgagcctgtttgttatgatggtttcgaaccttctggaagaatgcacattgctcagggtgtcatgaaaacactcaatgtgaacaagctaacctctgctggttgccgagtcaaaatatggattgctgattggtttgctaagcttaataataaaatgggaggagatttgaagaaaattgagacagttggcaagt

SEQ ID NO: 2661 - DNA, 434 bp, Cicer arietinum
agctcccgttcgccatggcggaaacgggaattcgattagcgtggtcgcggccgaggtacttcgaagattacgctggtgttattgtcaatccaaagggtgaaatggagggggctgctattactggtcctattggtaaggaatgtgctgatctatggccaaggattgcaagtgcagccaatgcaattgtatgagtggggcgtttcttgttccatgagcttatgtttctgcatgtaggatttatgtttatcttagattttgtttttgcttaactttgttaccaattatctttttgaagagatgttattgttttcttaaggagagagatgacaagttgtttggtgattttttccggtttctgaaaccattttagctattatgatataatttttacattagttaatgcgaattattggttttgcgataattcattattg

SEQ ID NO: 2662 - DNA, 382 bp, Cicer arietinum
acttcgaagattatgctggtgttattgtcaatccaaagggtgaaatggggggttctgctattactggtcctattggtaaggaatgtgctgatctatggccaaggattgcaagtgcagccaatgcaattgtatgagtggggcgtttcttgttccatgagcttatgtttctgcatgtaggatttatgtttatcttagattttgtttttgcttaactttgttaccaattatctttttgaagagatgttattgttttcttaacgatagagatgacaagttgtttggtgattttttccggtttctgaaaccattttagctattatgatataatttttacattagttaatgcgaattattggttttgcgataattcattattgacctg

SEQ ID NO: 2663 - DNA, 332 bp, Cicer arietinum
ctttttgcatattgtgttgtgagtgattttatctttgtcttttgagaatatggctggctgcaactgtggaagtagctgcaactgtggtgatagctgccaatgcaacaagaggtctagtggattgaactatgccgaaggcggcgaaaccacagagacggtggttttgggcgttggtccgacgaagattcagttcgagggagctgaaatgagtgttgcagctgaagatggtggctgcaagtgtggatcaagctgcgcatgggacccttgcaactgcaagtgaggtgcatatagcaaatgaaagcttgaggcagagatattggaaccaatatgtg

SEQ ID NO: 2664 - DNA, 135 bp, Cicer arietinum
acaaggagcgaatgaccaacccaggcctacaatgctatttcatgctaagaaacttcccaacaccgatccatgcaatgctaaagtcgtaaagatgagtcattactgatcttgacttgtcgtgaaatctgagagctg

SEQ ID NO: 2665 - DNA, 237 bp, Cicer arietinum
acaatgtttgtagaaagtccttactcgcggcgtcccattcagcccatcctgttggatcaatgtggctatccagaaaggattgcatcacaacagtcctggagtatttcttccatgggcggccgaggaaagttttgatggagcccaccacaggtttaaggtctgcagttggtgttaagtcacattgttgaattgaagttcctgtgttctgacctgggtcttctcgaccttgggccgtgt

SEQ ID NO: 2666 - DNA, 353 bp, Cicer arietinum
ttcgatttggtggattcttgaattacgcgattttaccgtagacataataatagatgagaatgtaataccaacaggggtacaagcaggacaagtttttgaacttcaatctttggatgaaagttcaagcaaaaaatttgtatttactgttcaaaagagaaatctacggtcagcaactaatgataccgattacacagaggcactgaaaccaaaactacaaatctctttaatggccaatccatttcagagacttcttgatttagcaccacgtatccaggttcaattgaaaagattagtcaagttagagtcagttacagttgattccgttgaaatattcatcaaagatgtaagcttat

SEQ ID NO: 2667 - DNA, 436 bp, Cicer arietinum; identical to SEQ ID NO: 2149

SEQ ID NO: 2668 - DNA, 428 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacc

SEQ ID NO: 2669 - DNA, 416 bp, Cicer arietinum
acagagcttacctggagaccgtggaacgaggcgactgccttgtccggggaggagcgttctagccgccttgggtttttccctgcgaggggtttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggcgcctcttgggggtaatgagt

SEQ ID NO: 2670 - DNA, 437 bp, Cicer arietinum; identical to SEQ ID NO: 2238

SEQ ID NO: 2671 - DNA, 107 bp, Cicer arietinum
gattcattgtgtttgtgttgatgtgttgaagagtgtgtatgagaaagagatggttgtagtgtgcaaagagagttataaggttgtggacctcggccgcgaccacgcta

SEQ ID NO: 2672 - DNA, 281 bp, Cicer arietinum
acccataacagggccaaaaataagaagaaaaaggaaggagaaagaagtggtacaagagtatatgatacgaggaacggagtatatctagaatatcaaaacaaccgcaatccagctcaaagctaggcctcctagcaggttcatgcccctgatggtttctgctccactctcatcgttagcagaaccgggtccaggtgataacgcatcttcactgggtccaggagctcctgttggtggtgcaggaggactactcaatgttggtgatggtgctggagcactgtgct

SEQ ID NO: 2673 - DNA, 330 bp, Cicer arietinum
accaaacgtagtaacccctcaacatcttgaaagctaaaatcaagggccttcttgatagaggaaataccctctgcattcttgcccacactcaagtttgcattagcagctgcgaaagcattccttgatttccttgaggcttccatggcaaaattcacatcctgagcaaaattgagtatcctcgcaaaattggggcgacttcgtgcagcaataacatggtttccagcaacttggggtgaattgacagtcttggttagggcaactttgtcagctgctgtagagttgttaacattgtcaacatcagaggctgatgatgacggagactcacctgac

SEQ ID NO: 2674 - DNA, 290 bp, Cicer arietinum
caaagctcaatcttgcttttctgcacttcactcgttttaaaagtcagaacttaatcaacacgcccaaatccttcaaaatggttgctatcaaggttgctactgctggcctcctcatcggagctgccaccgcttctccctactacgcccctccctccaacggcactcactacaccaccgaggttgtcaccgccatcacaacctactgccctggtgctaccactctcacctacggtgacaagacctacaccgtcacctctgagaccaccttgaccatcaccgactgcccttgt

SEQ ID NO: 2675 - DNA, 349 bp, Cicer arietinum
ctttttgctaattgtgttgtgagtgattttatctttgtcttttgagaatatgtctggctgcaactgtggaagtagctgcaactgtggtgatagctgcaaatgcaacaagaggtctagtggattgaactatgccgaaggcggcgaaaccacagagacggtggttttgggcgttggtccgacgaagattcagttcgagggagctgaaatgagtgttgcatctgaagatggtggctgcaagtgtggatcaagctgcgcatgtgacccttgcaactgcaagtgaggtgcatatagcaaatgaaagcttgaggcagagatattggaaccaatatgtgtaattgtgtgtatcggt

SEQ ID NO: 2676 - DNA, 363 bp, Cicer arietinum
ctcatactgatgccgaactaaggttgcttgaagtcttctatcacaagatttacaaggtgttcccatccaatgaaaagattgaaaacattaatgatcaatactggacattgcgagcagaggagattccagaagaagagaaaaacattggtcaacaggatcgattaattcacgtataccattttactaaagacactgctcaaaatcaaatgcaaattcaaaactttggggatccttttttcttggttatacatgagggtgaagctctatctgaaattaaagttcgaatacagaagaaacttcaagttcctgatgaagagtttagcaagtggaagtttgcttttctatcactcgggcgtcctgagt

SEQ ID NO: 2677 - DNA, 417 bp, Cicer arietinum
acagagcttacctggagaccgtggaacgaggcgactgccttgtccacagagcagcgttctagccgcctcgggtttttccctgcgaggggtttccccaaggatgtacggtcctaggttgcagctactggcgatcttaggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggaggaaagctctgctaagatcagctgtattgatgtccgatgggacgtgcttcaccgacaactactgtagggcgagctacgagtagagaggtgcctcttgggggtaatgagtac

SEQ ID NO: 2678 - DNA, 198 bp, Cicer arietinum
ctttcttcttttgcaacctgtgaatgacaaagtccaaccgaaggatggttcggagaatctttacagcacaatacctacaaagcaagcaggggacaaaaactcttcaaccaaagttgttccaatcacctctgttgatgacattggagaaggtttaactacatcgactggtgggtccaagcactactgtttttctgattt

SEQ ID NO: 2679 - DNA, 149 bp, Cicer arietinum
attttggatagttcaccttctctgacgacacctttgtcggatctaatggcggcacctcagaaccagaacgccttagatatcggaggacgatgcctatggcatcggtagcgacatcctcccgatcaacgacgccgattgcgatgggtttt

SEQ ID NO: 2680 - DNA, 286 bp, Cicer arietinum
accgttgtttcgttggtggtctagcctggaccaccgacagcgacggcctgggcaaagccttctcttcctacggcgaagttactgattccaaggttattaacgaccgtgagactggaaggccaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggagg

SEQ ID NO: 2681 - DNA, 178 bp, Cicer arietinum
gacacagagggtaggcctgcactcgaaaacatggttgcagcagccaaacaaatccgcaacgagcgtgccaagtgaaggggttaaggaaagagagtctcagcggtcatattggctcgtgtttgattacacaaaaggaaaattttatattttggttgttcaataacttgtgtggaatact

SEQ ID NO: 2682 - DNA, 415 bp, Cicer arietinum
actcattacccccaagaggcacctctctactcgtagctcgccctacgggagtggtcggtgaagcacgtcccatcggacatcaatacagctgatcttagcagagctttcctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatcccctaagatcgccagtagctgcaacctaggaccgtacatccttggggaaacccctcgcagggaaaaacccgaggcggctagaacgctgctctgtggacaaggcagtcgcctcgttccacggtctccaggtaagctctgt

SEQ ID NO: 2683 - DNA, 303 bp, Cicer arietinum
tagaattgttggagagttgctacaacctggcggctatctcaaattagttgaactgggccttgaagattgtgtgaacaatattgatgcgcagcaagtgtttggttatgcacttttcaaagatgggaaacatactcgtctctcttatcccttggataagtttcactcagatgtatctggcagaagctttcacaatggccgttttattcagagaatgcgagagaaggctgcttcccttcccaatgtaaatttggagcaaggaacagtcacttccctacatgaagagaaggggacaatcaaaggtgt

SEQ ID NO: 2684 - DNA, 379 bp, Cicer arietinum
ccctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgtcttcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatga

SEQ ID NO: 2685 - DNA, 388 bp, Cicer arietinum
accttagagatggtcagcgcagggctccactgttccttcaggatatcaagacaaatgctaccattgctattgatgttggggtgaaagaccttagtcctgaatgcaaccttaggaggcttgaaaggataatctggaggaaaatgaatagtgaccagaaatacacctccagcatatggactatcagccggacccataattgttgcttgccaatggaacatgtcttcagcaaccggaccagcgctgcaagaagtaggtgggtctttctgcaaatccttcagctccttgagaatacgcttggaagccatggatggaacttcggagtttcagatcttagggtgaggctatgggaggattaggaatgagagatccaaacacgaacacacgcacc

SEQ ID NO: 2686 - DNA, 349 bp, Cicer arietinum
ctttttgcaaactgtgttgtgagtgattttatctttgtcttttgagaatatgtctggctgcaactgtggaagtagctgcaactgtggtgatagctgcaaatgcaacaagaggtctagtggattgaactatgccgaaggcggcgaaaccacagagacggtggttttgggcgttggtccgactaagattcagttcgagggagctgaaatgagtgttgcagctgaagatcgaggctgcaagtgtggatcaagctgcgcatgtgacccttgcaactgcaagtgaggtgcatatagcaaatgaaagcttgaggcagagatattggaaccaatatgtgtaattgtgtgtatcggt

SEQ ID NO: 2687 - DNA, 111 bp, Cicer arietinum
gaagtacaggataccccgcttccttcaccatccagcataccaaggcacaaaaggcgctgtattttctcgagcccgtcacccgtcagcgggttcgggggcatactgtcgact

SEQ ID NO: 2688 - DNA, 389 bp, Cicer arietinum
  misc_feature (1)..(1): n is a, c, g, or t
nattttggagagttcaccttctctgacaacacctttgtcggatctaggggcggggcctcagaaccagaacgccttagatatcggaggacgatgcctatggcatcggtagcgacatcctcccgatcaacgacgccgattgcgatgggtttttcccctttgaaggcaagccgcaccgccggcctctgattccttcccaaggtttttccctgccgccacgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctgg

SEQ ID NO: 2689 - DNA, 397 bp, Cicer arietinum
acaggataccccgcttccttcaccatccagcataccaaggcacaaaaggcgctgtattttctcgagcccgtcacccgccagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagaga

SEQ ID NO: 2690 - DNA, 470 bp, Cicer arietinum
  misc_feature (1)..(1): n is a, c, g, or t
  misc_feature (34)..(34): n is a, c, g, or t
  misc_feature (37)..(37): n is a, c, g, or t
  misc_feature (40)..(40): n is a, c, g, or t
  misc_feature (52)..(52): n is a, c, g, or t
  misc_feature (56)..(56): n is a, c, g, or t
nttcccgccatgggggaaacgggaattcaattancgnggncgcggccgaggnattngttcttctctaaactcaaaattcaactcaatctctcttcattcgcaaagatgggaaaagatagaataattggtgtggctttggatttctccaacagcagcaagaacgctctaaaatgggcacttgagaatttagctgaaaaaggtgacaacatttacatcattcacataagccatgattctcttgatgagtctcgtaatcttatatgggccaaatctggttctcctcttattccgttgaaagagttcagagaacctgagataatgaagaagtatggtgttcaaattgatattgaggttcttgatttgcttgacactgtttcaagacaaaaagaggtgaatattgttgcaaaagtatattggggggatgcaagagagaaacttttggatgctattgatgatctgaaactggattc

SEQ ID NO: 2691 - DNA, 334 bp, Cicer arietinum
ggtgaggtactcctttttgaatgagtaattcaattgcttggttggctgagttacctgtagcgaggacagggtcgagaagcaagacatgacgttctgagatatccttgggaagcttctcatatataagctgttttccattgtctccatcccggtgaatcagaatttttccaattttaatgccttttcaacatgcacgaagtgcactttccatgctctcaccacttcgaataattgaaacaccacataatttcttgcagaaatcaacaccagtatagacagatcctgttggagtaacaacttgtttttcagtaaaaggcagatgacctaaaccatg

SEQ ID NO: 2692 - DNA, 350 bp, Cicer arietinum
acagttggttccccaaagaccacttgatggtgatggttctgccttctacacatggattgtgattttttcatcctttggagacttacatgggcatgccaaggctatgaattttggaaccgtatctcctggcatcgacacaggcaagctttgacaatgattctgcttcatcatcaaaacaggaaaccctggtttatgattagatgaagcaaagtttgtttgtatatgattctgaggattgataacaataatcccaaaagattgaagcaaagattgaagtttgttccgatgcaaacaacaactaaagaaggagcaaatgaagaatatcaaggtaacaagaagggctaaaccca

SEQ ID NO: 2693 - DNA, 428 bp, Cicer arietinum
acagttggcatcaccaagaccacttgatggtgatggttctgccttctacacatggattgtgattttttcatcctttggagacttacatgggcatgccaaggctatgaattttggaaccgtatctcctggcatcgacacaggcaagctttgacaatgattctgcttcatcatcaaaacaggaaaccctggtttatgattagatgaagcaaagtttgcttgtatatgattctgaggattgataacaataatcccaaaagattgaagcaaagattgaagtttgttccaatgcaaacaacaacaaaagaaggagcaaatgaagaataacaaggtaacaagaagggctaaacccaatggaaaaccaatgaatatttgaccttgtgtgtgttcttcaatttccatttgttttttcctatgttgttttgactctc

SEQ ID NO: 2694 - DNA, 206 bp, Cicer arietinum
aaaaattcttccctggcacccactgttagtgcggtgctaggagcgggattttctacgggctatgcgactacacaaaactgcggggatgctatcggctccctaacagcagctttcggagaaggaattttggagagttcgccttctctgacaacaactttgtcggatctaatggcggcacctcagaaccagaacgccttagatatcgg

SEQ ID NO: 2695 - DNA, 422 bp, Cicer arietinum
aagacgaccagcgccttaggcaactaaattaaggcctgatcaaattccccatttaccttgtcattagcaggaatcctgcaatatacacctgatattccttcttggaacttttccagatcctcaaccaccatataatgaaagtggatgagacatagactacaatatcacacagaacgtctgtctatattcgccttacgtcgagcaaaacgttgccgcctcatcgatgcaaaagtatcgcgttagaaaaaacactaccgacgataagatagttgagaaatgcaacacagtgaccaaacagtcttgctccccaccaatgtggcattcctataacaacgcggacattccaaatgataattacctcgccctcgtcgtggacatggaccgttcgagtggctcggtgtggtttgtggaacgaacgacta

SEQ ID NO: 2696 - DNA, 419 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctccaggtaagctctgtac

SEQ ID NO: 2697 - DNA, 287 bp, Cicer arietinum
agtcgcatgctcttcgccgccatgggagccgcgggaattcgattagcgtggtcgcggccgaggtacgttgcgggacatcccataggcgccagagtagcgttcgcagcttcggccagagtatcgttgtgcgtgtgaagtcgtaacatcatgaaagatgagtcaagtcaggttgaggtgcgaggtgtttatttggatcgagccctcatctttcttctcttgcgcttgaggcggcgaacccgcttcttcctccatttggctctcatcttgattgacgatgtctttcgtgg

SEQ ID NO: 2698 - DNA, 371 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccatt

SEQ ID NO: 2699 - DNA, 223 bp, Cicer arietinum
acttggactggacgatatcgaactcggatttctcttcggtcagggtgatctggcagactcgcaggtttgttccgcccatatccagggccaggtaagtcccggtttcatagccatcggggtatgacatgacccaggtaggattcatagggatgctacccccctcaacactgaggcctttggccgaattcggagacaaagtggtcggtaatctccttgagcttag

SEQ ID NO: 2700 - DNA, 158 bp, Cicer arietinum
ggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 2701 - DNA, 154 bp, Cicer arietinum
acctttgtatactgtgattccagagacttaaatcttccaattctaataagaattccacgcaaatcttgagcagcgtcaaccttgcgattggataatgcatcggtaagacgaggctgcaccattgtgtctagcctatcctccaagacttcaagct

SEQ ID NO: 2702 - DNA, 319 bp, Cicer arietinum
actggcagcctccagtgccgttagacaggtggaggctggaaatgtgggagtcgccccagttgatctcaatattctcccatgtgatccatatacacgcactattgtagatagtgcaccactttcatcatcagctcctgtaagtgatgacgagggtaaaacgtctattgttgattatcttgctggtcagggtgaaatatgtggaaaatcaatcaattttgtcgctcccaattacaccccaacctaagagtcctgctacaagttacagtgcccctattgactgtccattttctgggacacatactctttattcaatgccacc

SEQ ID NO: 2703 - DNA, 362 bp, Cicer arietinum
actgcgtttaaccgcatgctaaacggggctgttgattttctcattaaacctgttcggaggaatgagcttaggaacttgtggcagcatgtgtggagaaggcatactattagcaggccttctcaaaatataacatctccacagactaaacttgacgttgctccagaaagcaatgctccaagcaataattctagtggttctgtggcttccacgcaaaaaaataatgaatgcagcgaaaaaactagtgagactcaagatatgtcccagctaaagagttctttaagtttgagcaataccgacaaggtgaagcaggaaagttctatcaaatttgaaagggagtctgctgagtataacaatgaaacggg

SEQ ID NO: 2704 - DNA, 372 bp, Cicer arietinum
acaggaaaccccgcttccttcaccatccagcataccaatggcacaaaaggtgctgtatttctcaagcccgtcacccgtcagcgggttcgggggcaatctattgtcgaactttttccaccgaccagaattctctcgcgcatcactacatctgctgacgcagtccacaatctccagtaaccaagttgtagctcgtagtcgactgtcgcggcggcagggaaaaacctcgggaaggaatcagaggccgacggtgcggcttgccttcaaaggagaaaaacccatcgcaattggcgtcgttgatcggaaggatgtcgctacgaatgcccggggcatcgtcctccgatatctaagacgttctggttctgaggtgccgcc

SEQ ID NO: 2705 - DNA, 187 bp, Cicer arietinum
acgacgttttccgcctccggaaaggagaacctgcgtcacaggcgactgtggatccggaaaaatagcatgcggcggccgtagtggatcgccgcctgtgacgctagcggagttctcaataaacagtttcaacaatcaagacttttatgatgtaagcttagttgacggttataacgtcccgatggatgtg

SEQ ID NO: 2706 - DNA, 272 bp, Cicer arietinum
cgaggtactgcccagagaaccttttcttctttgcagcctcggctgccgcccggaacacgaccgggcttcgacaatttgtctcactggctgagaccactagacaaaaccgctgggtcgaaatggtacaaaaatcagaatagatcacactaaaagttctcctaatcaaacaagctgaatcccatgtcttcgtcactctcttccttgggttcttccttcttctcttctgcaggtgcagcaactgcagttgcggcagcagcagcaactggggctga

SEQ ID NO: 2707 - DNA, 440 bp, Cicer arietinum
accgctaccatgttggtgatattctccgagtaactgggtttcataactctgctcctcagtttcactttgtgcgtcgaaagaacgtgttgcttagtattgactctgataaaacagacgagtcagagctacagagagctatggaaaatgcttcaaagttgcttgtggagttcaacacgagtgtggtcgaatacacgagctatgcagacacaaagacaataccaggtcactatgtgatatattgggagttgttgaccaaggacatttcaaactcaccgagtaacgaggtgcttaatcaatgttgtctggaaatggaggaatcattgaactcggtttataggcagtgtagggtcgctgaccattcgattggaccactagaaataagggttgtgaagaaaggaacttttgaggagcttatggattatgcaatctcaagaggtgca

SEQ ID NO: 2708 - DNA, 305 bp, Cicer arietinum
accttgccactttagatactaatgcagttgatttctctccagtttcattgatatactcaccagactccctttcaaatttgatagaactttcctgcttcaccttgtcggtattgctcaaacttaaagaactctttagctgggacatatcttgagtctcactagatttttcgctgcattcattatttttttgcgtggaacccacagaaccactagaattattgcttggagcattgctttctggagcaacgtcaagtttagtctgtggagatgttatattttgagaaggcctgctaatagtatgcctt

SEQ ID NO: 2709 - DNA, 268 bp, Cicer arietinum
  misc_feature (60)..(60): n is a, c, g, or t
  misc_feature (252)..(252): n is a, c, g, or t
gaataatataatgcaacacgttggtggagttcgcgatgtgccaggaaaccagaacagccnttgagatcgatagtctcgcccgcgttgcgtgttgaggaacacaacaaaaaacagaattctcttctggaatttgaaagggtgataagtgcaaaacagcaagtggtttctggaaccttgcatcacatcacgtcgttgaggcaaaagatggggtgaataaaaaggtttatgaagtcaagggtttgggaaaagtcnttggatgaacttcaag

SEQ ID NO: 2710 - DNA, 191 bp, Cicer arietinum
acctattctgttgctcgtattctcacaatgttgctccaaagggaaaatttattgcatttgtatcaactgaggcagagacagatcagcctgcaattgaacttaaacctgggattgaccttctaggacctgttgatgagatcttttttgatatgtatgatagatttgaaccagtcaatgaacccaccctggac

SEQ ID NO: 2711 - DNA, 384 bp, Cicer arietinum
acacctttgattgtccccttctcttcatgtagggaagtgactgttccttgctccaaatttacattgggaagggaagcagccttctctcgcattctctgaataaaacggccattgtgaaagcttctgccagatacatctgagtgaaacttatccaagggataagagagacgagtatgtttcccatctttgaaaagtgcataaccaaacacttgctgcgcatcaatattgttcacacaatcttcaaggcccagttcaactaatttgagatagccgccaggttgtagcaactctccaacaattctatcaggctcactcagatctctttcaatgacaagtactcggcgtccatccttgccgagagtgtgagcgagtgcagcgccagcg

SEQ ID NO: 2712 - DNA, 334 bp, Cicer arietinum
ttcggagatagtcttgaggaggatagaagaagcaagtggcttgactttggggacaggctgaacaagcttcttaccttggaaaaaccttggactttaattcttgacgatccagaaggaaattcttttatagcacctgcaactgatgatcttaaagacgacaaacaattaatatacgaggaatatgagaggacatgggagcaagatgaagaattaggtctacatcaaatggacacctcttctgcagatgctgcttatgaatcagcaaatccgagtaaccttgagtgaatatggttcaagcaccagatattttcatcaactttaagaatttttttaa

SEQ ID NO: 2713 - DNA, 334 bp, Cicer arietinum; identical to SEQ ID NO: 2712

SEQ ID NO: 2714 - DNA, 187 bp, Cicer arietinum
cgagctacttctcggttactggagattgtggactgcgtcagcagatggagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 2715 - DNA, 101 bp, Cicer arietinum
gacaaattgcctccgaacccgctgacgggtgacgggcttgacaaaaacagcgccttttgtgccttggtatgctggatggtgaaggaagaggggtatcctgt

SEQ ID NO: 2716 - DNA, 382 bp, Cicer arietinum
acagctcgcaacgaaacgcgaggcgcagtgtatgcgattttctttttgggctctgtctcaattcttgttcagacaggcaaggacataactgtaaagagacgagtaaaaaatctaagatgcggtgacgaaattaaacacaatatggtagcgccatgcatggtatcccctgttccgttccccattcagtgccccagacaagataggcctgctccatcatgatgagatgggtgacatgttggtatgtatgcgtatgtgaagtgtctcccatcaaaatagcagaatatcccccagccggctcggggcaaccattcaactctaagcagaaaaataccattggcaataataaagagctccaatgctgggtatgggtagtaaggaaaac

SEQ ID NO: 2717 - DNA, 238 bp, Cicer arietinum
acgtgtacatgcctgccactttctcttctctctcactaaatccatttcccattcattccccataagctagtgtcatcatgccgtttaattaatgcttaacgcttcgacttgattcctttattaatcaattcgatttcaacgagccatggaaatttcagagttagttgtaagttttgatttcactgtggcgaagtggccagagatgatgacattattgtgtaaggggacagctaacgtg

SEQ ID NO: 2718 - DNA, 107 bp, Cicer arietinum
atttcgagcgggccgcccgggcaggtaccaacagaagacggctttaatgaaaatagtgcctccaaaattgataaaattctgtgagtatggcggactgctgaatctat

SEQ ID NO: 2719 - DNA, 332 bp, Cicer arietinum
acccgtttggcaaatgactcaaaggctgcaaagaagggtggtgggaggcagtttgatggtttgattgatgtttacaagaaaaccctcaaatctgatggcattgctggcctttatcgtggattcaacatctcgtgcgttggaattatagtgtatcgtggtctttactttggaatgtatgattctctgaaaccagttgttttggttggtgggatgcaggatagtttctttgctagtttccttttgggatgggcaatcacaattggtgctggtttggcttcttatcccattgatactgtgcgtagaaggatgatgatgacttctggagaagctgt

SEQ ID NO: 2720 - DNA, 364 bp, Cicer arietinum
cgcgatttccattgttttccctttcaaacccaatctcaaatttccgtctaccttcaacccgattctcttttcaatccctcagattcaaagggtttagcgctaaacccagtaacacatttgtttgccaagtgaaatcttcaatgggggttgaattagaaatcttcgaaaaagaagaacttgctgtttctctcgccaaatacgttgccgatctctccaataaattcactcatcaaagaggtgctttcaccgtttgtttgtctggtggctctttgatcaactatcttcagaaacttttggagcctccttatgttgattctattgaatgggctaaatggcatgtgctttgggtggatgagagagttgt

SEQ ID NO: 2721 - DNA, 384 bp, Cicer arietinum
tccaactttggagaacaatatgcaacagcctctgcaactgtgaggaagatcttgtcctcaccaactacgtttgcaaaatttgaagtgtaaagtttgtctgtcactgcagaaccaggatttgccagaactagctgctcaaaccaaaaacacatcttggatcaatctcattactaagcaaagtccccaacaagagagaaaccacttgtacaggtcctattgcaatatcgcgggaactacccatgaatgcataaatcagtggtggaacaaagctggagtctgtaaaagggtagatcaaaatgtaacaagatttcagttcaacatccaaaaagctaaaaaagaaaaacatcttggggttggtgataaaagtcttacatagtccatact

SEQ ID NO: 2722 - DNA, 200 bp, Cicer arietinum
aagacgaccagccccttaggcaactaaattaaggcctgatcaaattccccatttaccttgtcattagcaggaatcctgcaatatacacctgatattccttcttggaacttttccagatcctcaaccaccatataatgaaagtggatgagacatagactacaatatcacacagaacgtctgtctatattcgccttacgtcg

SEQ ID NO: 2723 - DNA, 435 bp, Cicer arietinum
aagacgaccagcgccttaggcaactaaattaaggcctgatcaaattccccatttaccttgtcattagcaggaatcctgcaatatacacctgatattccttcttggaacttttccagatcctcaaccaccatataatgaaagtggatgagacatagactacaatatcacacagaacgtctgtctatattcgccttacgtcgagcaaaacgttgccgcctcatcgatgcaaaagtatcgcgttagaaaaaacactaccgacgataagatagttgagaaatgcaacacagtgaccaaacagtcttgctccccaccaatgtggcattcctataacaacgcggacattccaaatgataattacctcgccctcgtcgtggacatggaccgttcgagtggctcggtgtggtttgtggaacgaacgactagagaatatctgga

SEQ ID NO: 2724 - DNA, 439 bp, Cicer arietinum; identical to SEQ ID NO: 1588

SEQ ID NO: 2725 - DNA, 446 bp, Cicer arietinum
acttgaattgtgtaacacaggcaatttccgtcaactaaaattgactacctaaaaggttgggatcaaaccaagttgacgatgtttcgttggatatgtgatagatttacaacaggggaaaattgtgggagtaaagcgaaactagctttaaacaaacttaaggggataaaagagttctttaggctaaatgaattaatgaacctttatgatttgcagagccagtcttggatggcaagtctaagtgagtgattgggagtgaggagcatgtgactcaattttaaattagtcattggagaagtatcgtgcccattttctaaccattcacgtatggcatccccttcatatgtaaatccatcagctgcaatttgaggatcatgcattatttcctgaaggattggacataagaaaaatgatggcacaggtctctcttctgaaacatgtaactgttc

SEQ ID NO: 2726 - DNA, 422 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcataggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccaaaattccttct

SEQ ID NO: 2727 - DNA, 430 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagtgaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgaacaaggtgttgtcagagaaggtgaactctccaaaattccttctctgaaaac

SEQ ID NO: 2728 - DNA, 419 bp, Cicer arietinum; identical to SEQ ID NO: 329

SEQ ID NO: 2729 - DNA, 327 bp, Cicer arietinum
acatggccagtggcgacctgaaagattgcctctcagataaaaattcacattgtttgagttgggaaaggagacttcaaatagcaattgatgctgcagagggattggactacctacaccatggatgcaagccacctataatacacagagatgtaaagtcagctaacattcttctaagtgaagacttagaagctaagatagcagattttggactctctaaggtgtttaagaatagtgataacagaaatgcagaatctgcaatgattcatgttgatgatagaaatgaaacatctacaatcatgggaacaatgggttatcttgatccagagt

SEQ ID NO: 2730 - DNA, 327 bp, Cicer arietinum; identical to SEQ ID NO: 2729

SEQ ID NO: 2731 - DNA, 327 bp, Cicer arietinum; identical to SEQ ID NO: 2729

SEQ ID NO: 2732 - DNA, 422 bp, Cicer arietinum
actcgacctcacggaaggactcgtgactacacatgggtgcaggcactcgctgtcatgttcgacgtgcacactcttgttattgcagccaatagagtaaatcaatggaatgaaagtgttgactctcttacagtgaaatgggatggtgaatcagtaaccattcctattgatggtgaggctgaatggaagactaataccgacgaaagagaagttgttgttgaaagaacagatgataccaacagtgttagagtcacaatttctggtttacttgaaatggatataagggtgaggcctattggagaaaaggaaaacaaagctcacaattatcagttaccatcagatgatgcctttgctcatttggaaacacagttcaagtttaagaaacctacagattttattgaaggagttttgggtcaaacttatag

SEQ ID NO: 2733 - DNA, 457 bp, Cicer arietinum
aagacgaccagcgccttaggcaactaaattaaggcctgatcaaattccccatttaccttgtcattagcaggaatcctgcaatatacacctgatattccttcttggaacttttccagatcctcaaccaccatataatgaaagtggatgagacatagactacaatatcacacagaacgtctgtctatattcgccttacgtcgagcaaaacgttgccgcctcatcgatgcaaaagtatcgcgttagaaaaaacactaccgacgataagatagttgagaaatgcaacacagtgaccaaacagtcttgctccccaccaatgtggcattcctataacaacgcggacattccaaatgataattacctcgccctcgtcgtggacatggaccgttcgagtggctcggtgtggtttgtggaacgaacgactagagaatatctggatatggtcggacaggataacaag

SEQ ID NO: 2734 - DNA, 348 bp, Cicer arietinum
tgttgatgggccatcagccaaagactggagaggtggaagagctgcctcatttaacatcattcctagcagtaccggagctgctaaggctgttggcaaagtgcttcctgttttgaatggaaaattgaccggaatggcattccgtgtcccaactgttgatgtctcagttgttgaccttacagtggagcttgagaaggccgctacctacgactaaatcaaggctgctatcaaggaggagtctgagggcaagttgaaaggcattctcggatacgctgaagatgatgtggtctccaccgacttcattggtgatactaggtcaagtatctttgatgccaaggctggaattgcctt

SEQ ID NO: 2735 - DNA, 403 bp, Cicer arietinum
tgttgatgggccatcagccaaagactggagaggtggaagagctgcctcatttaacatcattcctagcagtaccggagctgctaaggctgttggcaaagtgcttcctgttttgaatggaaaattgaccggaatggcattccgtgtcccaactgttgatgtctcagttgttgaccttacagtggagcttgagaaggccgctacctacgacgaaatcaaggctgctatcaaggaggagtctgagggcaagttgaaaggcattctcggatacactgaagatgatgtggtctccaccgacttcattggtgatactaggtcaagtatctttgatgccaaggctggaattgccttaaatgaccggtttgttaagcttgtctcatggtatgacaacgagttgggctactgt

SEQ ID NO: 2736 - DNA, 403 bp, Cicer arietinum; identical to SEQ ID NO: 2735

SEQ ID NO: 2737 - DNA, 306 bp, Cicer arietinum
gattctgcaatatttttaaatttgagtggagctttttcaccctcagtctcagagtcagagcttgagaaaagagtatgcggaggtggtgccacttgaccaattattgattgtggtaattcacacgcaagcgtaggccaaaagggacttaattcctggcgaaccgcttggatcacacgccatgtagactcaaatggataggcttctgaagaagattcaataagaggtttgtcttcaagcaaaacctctaaacaagcatgcattgactttgcaatcgagtcaagattataccctccttctaaaaccagt

SEQ ID NO: 2738 - DNA, 436 bp, Cicer arietinum
acaacggcgtcaattatcaacaacttctcaattccatgctcactactggatttcaagcttcaaaccttgctgatgccattaacgtcgttaatcaaatgctagattggaggctggttgatgaacctgtgactgaggattgtgctgacgaagagagagatttggattacagaaaatctgttaagtgtaaagtgtttttgggtttcacttctaatctcatttcatctggtgttagagatgttgttcgttacctttgtcagcatcacatggttgatgtgattgttacaactacaggtggtatcgaagaagatctcataaagtgccttgcacctacatataaaggagatttctctttgcctggagctcatcttcgctcaaaaggattgaatcgaattggtaatttattggtccctaatgacaattattgcaaattcgagga

SEQ ID NO: 2739 - DNA, 433 bp, Cicer arietinum; identical to SEQ ID NO: 1993

SEQ ID NO: 2740 - DNA, 189 bp, Cicer arietinum
cgagctacatttcggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgtac

SEQ ID NO: 2741 - DNA, 228 bp, Cicer arietinum
acttcgattgaggggcggaatgcaaatttttgtcaagactttgacaggaaagaccatcaccctggaggttgaatcatcggatacaattgataatgtcaaagccaagattcaggataaggagggtatccctcctgatcagcagaggcttatttttgcagggaagcagcttgaggatggaagaaccctagccgattacaacacacagaaggaatccacccttcatttggt

SEQ ID NO: 2742 - DNA, 258 bp, Cicer arietinum; identical to SEQ ID NO: 1597

SEQ ID NO: 2743 - DNA, 246 bp, Cicer arietinum
cagcgccttaggcaactaaattaaggcctgatcaaattccccatttaccttgtcattaacaggaatcctgcaatatacacctgatattccttcttggaacttttccagatcctcaaccaccatataatgaaagtggatgagacatagactacaatatcacacagaacgtctgtctatattcgccttacgtcgagcaaaacgttgccgcctcatcgatgcaaaagtatcgcgttagaaaaaacacta

SEQ ID NO: 2744 - DNA, 129 bp, Cicer arietinum
  misc_feature (99)..(100): n is a, c, g, or t
cccgatcaacgacgccgattgcgatgggtttttctcctttgaaggcaagccgcaccgccggcctctgatcccttcccgaggtttttccctgccgccgcnngacagtcgactacgagctacaacttggtt

SEQ ID NO: 2745 - DNA, 297 bp, Cicer arietinum
cccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 2746 - DNA, 298 bp, Cicer arietinum
cccgatcaacgacgccgattgcgatgggtttttctcctttgaaggcaagccgcaccgccggcctctggatcccttccggaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 2747 - DNA, 431 bp, Cicer arietinum
acaagattttatagagtctgatcattcaccatcacctactactttaatcaattcttctaatcaccaccctccaacccaatattttattttgcaggacattctaaggagtgatactgttgaagaagctaaggttatgaagtatgtgatgaagcatatgagaggaagacatggttctgagaaaacaacaagtcttagtagatttcttgttaagggaatgagaaaggatggttttcatgcttctttgtgtcaaacctcttggtcaacttcctttcgatgtcctgctggtgaatacgaatatattgaagtgataatcgaagatgagaagaatataaaggatccaacgagggttatagtagatatagacttcaaatcccaatttgaacttgcaaggccaacagaacattacaaagaattaacagagtcactaccaa

SEQ ID NO: 2748 - DNA, 341 bp, Cicer arietinum
accgcaatcactaacaaccgacgagcagatcatgctgaaggatgtaagtaacagaattcgtgttagagggatcagtaaaagcttggacttcgacaatgtgaagatggggttgacagataacaaaagaatgatcaaaagtagcagttactcatcagctagtagaaacaaggaattatcttttaacagaatttgctctaagcttcctgtgattgattttggtatcgacaaaaatagagcactggatgtgattgacagagtggctgtggccagataatttgcgcagactattcttaagcgcctttgatgaaacgatggtaggaataagtgaacagaagaatggt

SEQ ID NO: 2749 - DNA, 436 bp, Cicer arietinum
ctcaacaggctgaagatgctctctcccaaggaatggatgcattgcagcaatcactctctgagacattagctaatggttcacccaatccatcaaattcttctggaaatgtggcaaattacatggggcaaatggctatggctatgggaaagcttggtactctcgaggggtttcttcgccaggctgataatctgcggcagcaaacgttgcaacaaatgcttcgaatattaacaactaggcaatcagctcgagctcttctcgcaataagcgattatttctcccggctgcgagccctgagttctctatggcttgcgcggccaagagagtgaaatgtttctaagctctatttatgttctttcaacgttctgcatgaagcgggacgtctttttgggaatgaatccctgttgtgaagaagaagcctagttgtggtgcttgtaaa

SEQ ID NO: 2750 - DNA, 459 bp, Cicer arietinum
acttgactggagagttcccaggtgactatggttgggacactgctgggctttctgctgacccagagacatttgcgaaaaaccgtgaactggaggtaatccacagcaggtgggctatgttgggagcattgggatgtgtgttcccagagcttttgtcccgaaatggtgttaaattcggtgaagctgtatggttcaaggctggatcacaaatctttagtgagggtggacttgactacttgggtaacccaagtttggtccatgctcaaagtatcctcgctatatgggctacccaagttgttttgatgggtgctgttgaaggttaccgtattgctggtgggcctcttggtgaggtcactgacccactctaccctggtggtagctttgacccattgggcttagctgacgaccctgaagcctttgcagaattgaaggtcaaagaacttaagaacggtagattagcca

SEQ ID NO: 2751 - DNA, 279 bp, Cicer arietinum
ccgggctggtcacgagaggctacttctgacctgcaagccaacctacgacagttgaagtttgaggttcccaccgacggccaggatgtgatctccaagagatacgaggagattcaacagaagatgacagacaagtttgcggctgtcatggacgagtaatgtaatactaatgttgcattactggttgtttctgtgttgaagctatagattggtcatactgggggataggtcagaagatgaccggtattcgattactgtttgcgccgccccatagtctagtgt

SEQ ID NO: 2752 - DNA, 418 bp, Cicer arietinum
accctgttccttttcctctaatcatatcccaaagtgcagatccaaaatccttaggcctaaaggtaattggaatatcaatgtaactaatcccacttttttcaatttttgccgacttcgcaagatcagcacctccaattctaacctcaccaagccacacctcataatcgagcgcattgagtcccaaatcaaaatcattcttgttatccaattttaaatgaagaatagcaatggtctcctcaaaagagaaactctcaaactgaattttctcaatatctatatccggcttatacggaatagggatttctccggttttctccaaaggtatagtgatccttccaaacacaggaacatcaactatgaggtcaactttcaccttataaggaatcacacttcctggttgaatatcagcatatgtagt

SEQ ID NO: 2753 - DNA, 270 bp, Cicer arietinum
actggctcatcgagcgcaccttcggcgagttctctcgcagcttcaacttccccactcgtgtcgaccaggacaacgtctctgccaagtttaaggacggtatcctgagcattgttgttcccaaggccaagaagcacgagtctcgccgcatcaacgtcgagtaaacgcgacaacacaccacaacccggaatcttgaggaccttattatccagctctcagatttcacgacgagtcgagatcagtaatgactcatctttacgactttagcattgc

SEQ ID NO: 2754 - DNA, 110 bp, Cicer arietinum
gattatttggagaacaccgacacgttagctggagctgccactacgttgccgcaatgtgtgcgtaacctagtcaagtggtcgcaaatcagcttgccccaagcggtgatgac

SEQ ID NO: 2755 - DNA, 249 bp, Cicer arietinum
cctcaaatctgatggcattgctggcctttatcgtggattcaacatctcgatcgttggaattatagtgtatcgtggtctttactttggaatgtatgattctctgaaaccagttgttttggttggtgggatgctggatagtttctttgctagtttccttttgggatgggcaatcacaattggtgctggtttggcttcttatcccattgatactgtgcgtagaaggatgatgatgacttctggagaagctgt

SEQ ID NO: 2756 - DNA, 372 bp, Cicer arietinum
gaaaaaaagaaaaacaaaattaacattcatttttctcagcgccttcaaaatggcgcggatacccttttcttcactttccttcaccttcattttcgttatatcaattttcaatcttgcacactgcaagacccttaagcgtgatgttaaggctttgaatgagattaaagcttctcttggttggagagtagtatatgcttgggttggagatgatccttgtggtgatggtgatcttcctccttggtctggtgttacttgttctactgtcggtgattatcgtgttgtgactaagcttgaggtgtatgcggtttcaattgttgggccttttcctactgctgttactagcttgttggatcttacacggctggatctcca

SEQ ID NO: 2757 - DNA, 285 bp, Cicer arietinum
cccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcatcagcagatgtagcgatgcgtgagagaattctggtcggtggaaaaattcgacaaattgcctccgaattcgctgacgggtgacgggcttgacaaaaacagcgccttttgtgccttggtatgctggatggtgaaggaaga

SEQ ID NO: 2758 - DNA, 303 bp, Cicer arietinum
cggccgatgtactaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggtcacgctttcacggttcgtattcgc

SEQ ID NO: 2759 - DNA, 287 bp, Cicer arietinum
acagtctattcccaccccgactcctaaaaaagtttccctaattgcgcctggttggatggacaattgtctttaaccataccaaagacgccaagcttcccaatgaatgagagtgtccgtcccgtaccagccagtgacgatgagtgagtgtgaaacgaccagcacaaggtgttatgttgctttggtgtgattaggcggtcatgctatagtgctggtgatgctgcagggcagggtttctttgttcttgttcgtatgtgctcgtacagctgacacttcaatccttgcccaac

SEQ ID NO: 2760 - DNA, 334 bp, Cicer arietinum
gggctttgtaacgagggcttgtttgatgaagcacttgccttgttatcaagaatggaagacagtggttgcattcctaatgttgtaagttatgaaacaattgtcaattatctttttcaaaaaggtgagacaaataaggcagagaaccttctacgtgaaatgattgctaaaggtctactactatatgagtaaaacttggtaacatactttctagttatacattttttttttcagcatataatcactcttgttaattttagagtggacggaaaatggtgcatcttcctctgtgaagatagaggggagagtaacttctctagttaagtgaattgtggac

SEQ ID NO: 2761 - DNA, 415 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccaaaat

SEQ ID NO: 2762 - DNA, 403 bp, Cicer arietinum; identical to SEQ ID NO: 2735

SEQ ID NO: 2763 - DNA, 360 bp, Cicer arietinum
gggctttgtaagcagggcttgtttgatgaagcacttgccttgttatcaagaatggaagacagtggttgcattcctaatgttgtaagttatgaaacaattgtcaattatctttttcaaaaaggtgagacaaataaggcagagaaccttctacgtgaaatgattgctaaaggtctactactatatgagtaaaacttggtaacatactttctagttatacattttttttttcagcatataatcactcttgttaattttagagtggacggaaaatggtgcatcttcctctgtgaagatagaggggagagtaacttctctagttaagtgaattgtggactttatgctggcagtaataagtacctg

SEQ ID NO: 2764 - DNA, 411 bp, Cicer arietinum
acagtcattcccaccccgactcctaaaaaagtttccctaattgcgcctggttggatggacaattgtctttaaccataccaaagacgccaagcttcccaatgaatgagagtgtccgtcccgtaccagccagtgacgatgagtgagtgtgaaacgaccagcacaaggtgttatgttgctttggtgtgattaggcggtcatgctatagtgctggtgatgctgcagggcagggtttctttgttcttgttcgtatgtgctcgtacagctgacacttcaatccttgcccaacattgcccgggcgagatcagccagagaagggccgccaaagaggaactggcttgaatggcggccacagtaggtaacattgttgactggctgaggagcagccttgaaccaagagcgggaggctttggt

SEQ ID NO: 2765 - DNA, 302 bp, Cicer arietinum
cggccgaggtactaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggtcacgctttcacggttcgtattcc

SEQ ID NO: 2766 - DNA, 376 bp, Cicer arietinum
gattctcaaggttcagggcagtgagagaggttttttttgttgttgtgaatttgggtggaaaaaaaatagattgtgtgcaaaggatgaggtttataagaaaaaaaatgggttttttgttgttgtatattttggagaaattcaatagaaaaaaaggatttgggtttgttttgccttccttattgttccttctccacaggactcaagtctacagatacaggtggaattgcatggccatatagctttgttgctttggtttggcccttaaaactatattgttttaattcagaggtgtgttgattattttttgttcttctttctatagatcaggatgatggagtggtgatcagtttgtttgtgaaaaatgatgatatagtac

SEQ ID NO: 2767 - DNA, 374 bp, Cicer arietinum
gattctcaaggttcagggcagtgagagaggttttttttgttgttgtgaatttgggtggaaaaaaaatagattgtgtgcaaaggatgaggtttataagaaaaaaaatgggttttttgttgttgtatattttggagaaattcaatagaaaaaaaggatttgggtttgttttgccttccttattgttccttctccacaggactcaagtctacagatacaggtggaattgcatggccatatagctttgttgctttggtttggcccttaaaactatattgttttaattcagaggtgtgttgattattttttgttcttctttctatagatcaggatgatggagtggtgatcagtttgtttgtgaaaaatgatgatatagt

SEQ ID NO: 2768 - DNA, 454 bp, Cicer arietinum
acaacactagtagctaacacttcaaacatgccggtggctgctcgtgaagcttcaatttatacaggaatcactttagccgagtattttagagatatgggttacaatgtcagtatgatggcagattcaacatctcgatgggcagaagcattgcgtgaaatctcaggaagactggcggaaatgcctgcagatagtggatatccggcttaccttgctgcacgtttagcctctttctatgaacgtgccgggaaagtaaaatgccttggaggtcctggacggacaggtagtgtaacaattgttggtgctgtttctccacctggaggagatttctcagatcccgtgacatctgcaaccctcagcatagttcaggttttctggggattggacaaaaagcttgctcagaggaagcattttccttctgtgaactggcttatttcttattcaaagtacctcggcc

SEQ ID NO: 2769 - DNA, 276 bp, Cicer arietinum
accaaatgttactcatgtctacactgcaaatgaatgtgttcaatgtaaatgcgactctactagtaacaacaactttatgttacagtgtgagccatctgaactaaaacccataaatcgttggtccgtttgtccgacaatggaatgttcgaagaatgtgttaattggtaacactacaacaacatccacagattcgtgtaatagcacgatttgttattacggtggttataactcccgcaatatctctatggttaatgcaacccaaaacacatgtgctgt

SEQ ID NO: 2770 - DNA, 382 bp, Cicer arietinum
acacaagtgagctgctagctcttcttatccactataaacaacaacaaagttacaagacaactcaaagaagctgtgataatcaccatactagtagctaacagcaacgatgcatatcccatttatctttgttttcagcaataacctcaactctatcaaggcagagtgtaaggtccacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttgtgacacacttgcattttcatcttgtgctgcacttgcacaaggagcta

SEQ ID NO: 2771 - DNA, 461 bp, Cicer arietinum
gattcattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgtgtatatgccttcatcaccatatcaatcaacattagatgcaccatctga

SEQ ID NO: 2772 - DNA, 439 bp, Cicer arietinum
acttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgccttgatagagttgaggttattgctgaaaacaaagataaatgggatatgcatcgttgctgttagctactagtatggtgattatcacagcttctttgagttgtcttgtaactttgttgttgtttatagtggataagaag

SEQ ID NO: 2773 - DNA, 400 bp, Cicer arietinum
gatttcgagcggccccgggcaggtcgagaagaaatggaggaagaagccgtagtggtcgcagaagcactcgaatcactgtccaccgccgaatcatcgaatccaaatccaacagaaacaactcagcagcaattgttgagtgtggaacagagatatcagatcgtcaggagtatcggagaagagtgcattcaagaagatgaacttcttaatctcctcgctaaaaagcctgagcctgtttgttatgatggtttcgaaccttctggaagaatgcacattgctcagggtgtcatgaaaacactcaatgtgaacaagctaacctctgctggttgccgagtcaaaatatggattgctgattggtttgctaagcttaataataaaatgggaggagatttgaagaaaattg

SEQ ID NO: 2774 - DNA, 161 bp, Cicer arietinum
accaaatgctacttatgtctacactgcaaatgaatgtgttcaatgtaaatgcgactctactagtaacaacaactttatgttacagtgtgagccatctgaactaaaacccataaatcgttggtccgtttgtccgacaatggaatgttcgaagaatgtgttaa

SEQ ID NO: 2775 - DNA, 434 bp, Cicer arietinum
ctccgattccgcacacagattcctcgatggcaaccgcaccaacaccacgcgaagagttcgtctacatggcgaaactcgccgaacaagccgaacgttacgaagagatggttgaattcatggaaaaagtaactgccgctgtcgaaagcgaagaactcaccgtcgaagaaaggaaccttctctccgtcgcttacaaaaacgtgatcggagcaagacgtgcttcctggcgcataatctcatccatcgaacaaaaggaggaaagcagaggcaacgatgaacacgtggcagtcatccgtgactacagatctaagatcgaagccgaactttccaacatctgtaacggtattctcaaactacttgattctcgcctcataccttccgctgcttctggtgactctaaggttttctaccttaagatgaaaggtgattatcatagg

SEQ ID NO: 2776 - DNA, 310 bp, Cicer arietinum
acatggaagcaagaccgttggaagatgggcttgcagaggccattgatgaaggcacaattggaccaagggatgaccccaaaatccgttctaaaatcttgtcagagcagtatggttgggataaggatcttgctaagaagatttggtgttttggacctgagaccactggacccaacatggtggttgatatgtgtaagggagtccagtatttgaatgaaatcaaggattctgttgttgctggattccagtgggcatctaaagaaggtgctttagcagaagaaaacatgagagccatttgttttgaagtgtgtga

SEQ ID NO: 2777 - DNA, 389 bp, Cicer arietinum
accaaatgctacttatgtctacactgcaaatgaatgtgttcaatgtaaatgcgactctactagtaacaacaactttatgttacagtgtgagccatctgaactaaaacccataaatcgttggtccgtttgtccgacaatggaatgttcgaagaatgtgttaattggtaacactacaacaacatccacagattcgtgtaatagcacgatttgtgattacggtggttataactcccgcaatatctctatggttaatgcaacccaaaacacatgtgctgtggcaccaagcggttcagattcgggggcaactgggagcagcttgagtggctcggtttggaataaacttcttattctcattcactttctcctcttttttgtctatcttttgtagt

SEQ ID NO: 2778 - DNA, 408 bp, Cicer arietinum
acatcttcggaggatatgtgcatagaggggacagtcctgcgaaacatatacgaaccaatttcttgattatcttccattaccagggtttgacggcctagatatcggtgaacaatgcctccgatttggaaataaggtttaaaggcaactaaatcagaaatggtagaaatactggccaggagagatgcgccctttctgcgatggctcctcattgttgacaacaaactgaattttacattttgtagaaacttctcagcgagctctccaggttcagccaccacaaatacatcattgtgccaactaacaattaagccatcagtgtcagcttgaagagccaaatggataacacccacttgtggagaattctgcaatttctcatgcaatgctttgacaggcaaagagaactgccta

SEQ ID NO: 2779 - DNA, 436 bp, Cicer arietinum
acaacactagtagctaacacttcaaacatgccggtggctgctcgtgaagcttcaatttatacaggaatcactttagccgagtattttagagatatgggttacaatgtcagtatgatggcagattcaacatctcgatgggcagaagcattgcgtgaaatctcaggaagactggcggaaatgcctgcagatagtggatatccggcttaccttgctgcacgtttagcctctttctatgaacgtgccgggaaagtaaaatgccttggaggtcctggacggacaggtagtgtaacaattgttggtgctgtttctccacctggaggagatttctcagatcccgtgacatctgcaaccctcagcatagttcaggttttctggggattggacaaaaagcttgctcagaggaagcattttccttctgtgaactggcttatttctt

SEQ ID NO: 2780 - DNA, 433 bp, Cicer arietinum
actacttgttgaagcttcacataatccagattctgggagattggtccaccatgctcgaacacttgagtcattttgtgctcgtaatggcatacgcctatccctcatgcaaggtttgtctgggattgtaaagacattcccatcatctacattcccaactccatttgcgtcacctctgtttacaggaagcttcccttcaagtccacttgtgtatagtcctgatattggtcaaagaattggacgaattgatctggtcccccctttaagtttagatggccaactgggaaaaacagttgcatcacctccgttgtctcctcgagggcttaggcagttctctttgcctgtcaaagcattgcatgagaaattgcagaattctccacaagtgggtgttatccatttggctcttcaagctgacactgatggcttaattgttagt

SEQ ID NO: 2781 - DNA, 438 bp, Cicer arietinum
aaacaaatgaggctattgagatcttaaagttgatgtcttcaactttcttgattgcactttgtcaagcaattgatttgaggcatttggaggagaatttgaagaacactgtgaagaacactgtgagtcaagttgcgaagaggacgctaacgactggcgtgaatggtgaactacatccatccagattttgtgagaaagatttgctcaaagttgttgatagggagtatgtttttgcatatgttgatgatccttgtctctctacataccctttgatgcaaaagttgagacaagtgcttgtagatcatgcattggtgaatgttgatggtgagaagaatttgaacacatcaatatttcaaaagattgcaacttttgaggatgagttgaagacccttttgcctaaagaagttgaaagtgcaagaattgcttatgagaatggacaat

SEQ ID NO: 2782 - DNA, 459 bp, Cicer arietinum
caatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagttcgacaatagattgcccccgaacccgctgacgggtgacgggcttgagaaatacagcaccttttgtgccattggtatgctggatggtgaaggaagcg

SEQ ID NO: 2783 - DNA, 417 bp, Cicer arietinum
acacagctcacaaaagagacttggtggagcttatgagaaacctcccgggacctttgttcctcttctctatacacaggtcctttatttctctcctcccgtctcccgcggcattaacttcaatacttaaaccccttactgaccctcaagctcagcaagaatcttctcacccttggccttggcggaggcgaagtcaccaaccatgtagaaggcaccctcaggaaggctgtcaccctcaccgttaaggatggccttgaaggagttgatggtctccttaaggtcgacgagcttaccctcgataccagtgaaaacctgggcgacggtgaaaggctggctcaggaaacgctggatcttacgggcacgctcgacagtaagcttgtcggcctcagacaactcatccatacccagaatggcaatgat

SEQ ID NO: 2784 - DNA, 256 bp, Cicer arietinum
cgggaccccaagccgtggaactttgaagatataaagaaccatgttgagaaatctgaccagggcgatgtagtcctcatcgacgtccgagaaccagtcgagcttttcgagacgggcaagatccccggtgcgatcaatattcgtatcacatcggcagctcagagcttccacatctccgacgaggattttgaggacatgtatggcttccggagaccggcaaagaacaaacagcttgtgttttattgcaaagcaggagtgc

SEQ ID NO: 2785 - DNA, 351 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacgagtggggaagttgaagctgcgagagaactcgccgaaggtgcgctcggtgagccagtacctgcccgg

SEQ ID NO: 2786 - DNA, 341 bp, Cicer arietinum; identical to SEQ ID NO: 202

SEQ ID NO: 2787 - DNA, 421 bp, Cicer arietinum
actatattcatcttaggttgaataatgatcccggttggacaaatatcaaggttattctttctgatgcaaatgttcctggtgaaggggagcataagattatgtcctatattcgccttcaaagaaatcttgagggatgtgatccgaatacacgacattgcctgtatggtttggatgctgatttgattatgttgggtcttgctactcatgaagttcatttttcaattcttagagaggttgtatttactcctggacaagataaatgcttcgtgtgcggtcagatgggtcatatggctgcagactgtcaaggaaaggcaagaaagaaagcaggagaatttgatgaaaaaggcaatgctgttgttcctaaaaagccgttccagtttctgaacatctggactctgagggaatatctggagtacctgcc

SEQ ID NO: 2788 - DNA, 282 bp, Cicer arietinum
acctaaataatgcatttgattttgtagtcacataagacatggtattctgtagaagacctctccgtaggtttcgttttggattttgcacacaaattcaataaatgtgttttgacagcattatagtaattattgttgtccatttcctgcagcaagaaccaggaaataaatcacatgggtcctttagatcttctgaatgttgaaggcgccacgcttcttaatatccttcagaaatgcatcaagattccggtcagaggatccaccgaccgccactgcctcctccgc

SEQ ID NO: 2789 - DNA, 239 bp, Cicer arietinum
acttcaatatttcctgcttgcaattgaatagcttcagatttcagatggcggggagagaatcatcagttgcagcacaatagacataaattcaaattatgattgtgccatgaataggagagaaaattttcagcatatccacaaggttttgctttgcatcatagctgaacttttgtaaggcttcggctagatacaccgtgcaataatttggcgaacccgataaagcttaactttccatcggt

SEQ ID NO: 2790 - DNA, 304 bp, Cicer arietinum
gattactgcaataacgagccattcagctgccactttacgttaacttggcaaaatgcatgggcagcagaggtatttaaaggggttggttgcgaggtcagcaacggaaattatctgagcatgaccatttcttccgctgattactccaaggccacatcgttttaaaaaacgttttctatttgctacagaaaatcattcaacactcatgaaaatgacacgttgccccatagctcctatcatgttcaaataatccgggattaaagtcttccttccgacttttggtttccgtgggttgaattcatgctat

SEQ ID NO: 2791 - DNA, 326 bp, Cicer arietinum
aaaattctttcttggcacgcactgttagtgcactgttaggagcgggattttctacgggctacccggccacacaatactgcggggacgccatcggctccctaacagcagttttcagagaaggaattttggagagttcaccttctctgacaacacctttgtcggatctaatggcggcacctcttaaccagaacgccttacatatcggaggacggtgcccgtggcatcggtagcgacatccttccgatcaacgacaccgattgcgatgggtttttcccctttgaaggcaagccgcaccgccggcctctgattccttcccaaggtttttc

SEQ ID NO: 2792 - DNA, 208 bp, Cicer arietinum
acgggaagtcgaggggcgcagagcccggattgtcgaaggctcgcgaagccggaatgtcggggtaagaagaagccgcaaataacacgtgagaagtagcgcccgaaggcgatgtcgagagctcgcgaagctcaatgtcgttgcagacactcgtcgcgaagaaaggtcaactctctgaatccctttcttcatgcagctgttagggtcccgt

SEQ ID NO: 2793 - DNA, 300 bp, Cicer arietinum
actatccccagaggttgttgagagagaggctgaaactggtggaaggcttggtgaactggatgcctatgagattgaagggggtgagacaaaatcagaaattcttcagaatttgtcagagttccagttttcttgtgtcatgttcaatgcagtgttggagaatgcctgcagtgagcaaggagcaaggacgtcggccatggacagttctagcaggaatgctggggatatgcttgaccgtctgaccctcacttacaatagaactcgtcgagcatcaatcaccactgaattgattgagattatttc

SEQ ID NO: 2794 - DNA, 354 bp, Cicer arietinum
acgcaaatctggctaggagggctgtggaaactgatatgccgattatggttcagatgcaggaattgcttcgaggagctaagaatgctgtgtctttggctcagggggtggtttattggcaacctccaaagcaagccttggataaggtgaaagaactcgtgttcgagccttctattagtcgttatggtaacgatgaaggtattcctgaactcagagcagcattagtgaaaaagttgcgcgttgaaaacaatttgcacaaatcctcagtaatggttacagcaggtgccaatcaggcattcgtgaatctagttcttactctgtgtgatgcgggggattctgtggttatgtttgctccgt

SEQ ID NO: 2795 - DNA, 435 bp, Cicer arietinum
actgcccagagaacctcttcttctttgcagcctcggctgccgcccggaacacgaccgggcttcgacaatttgtctcactggctgagaccactagacaaaaccgctgggtcgaaatggtacagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctc

SEQ ID NO: 2796 - DNA, 435 bp, Cicer arietinum
gggattttctaccggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgaca

SEQ ID NO: 2797 - DNA, 375 bp, Cicer arietinum
actagtgatttcgaaggcggccgcccgggcaggtacaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacgagtggggaagttgaagctgcgagagaactcgccgaaggtgcgctccgagagccagt

SEQ ID NO: 2798 - DNA, 420 bp, Cicer arietinum
acagagcttacctggagaccgtagaacggggcaattgcctcgtctacagagcagcgttctggccgccttgggtttttcccctgcaaggggtttccccaaggatgcatagtcctagggttgcagctactggcgagcttagggatcatggttctcctgcctttgggcgtggaaagccacctgatctatctgtgcaagagaattctaggctggagaggaatagttcccgctgacgggatgacctcttgaaagtaaagcgcctttgtgccgatgatatgctggatgaactagatgggagacgctgctggagggaatctctgctgagatcaactgtattgatgtccatgggacgtgcttcaccgacaactactgtagagcgggctacgagtagagaggcgcctcttggaggtaatgagtacctcg

SEQ ID NO: 2799 - DNA, 413 bp, Cicer arietinum
acagagcttacctggagaccgtagaacggggcaattgcctcgtctacagagcagcgttctggccgccttgggtttttcccctgcaaggggtttccccaaggatgcatagtcctagggttgcagctactggcgagcttagggatcatggttctcctgcctttgggcgtggaaagccacctgatctatctgtgcaagagaattctaggctggagaggaatagttcccgctgacgggatgacctcttgaaagtaaagcgcctttgtgccgatgatatgctggatgaactagatgggagacgctgctggagggaatctctgctgagatcaactgtattgatgtccatgggacgggcttcaccgacaactactgtagagcgggctacgagtagagaggcgcctcttggaggtaatgag

SEQ ID NO: 2800 - DNA, 206 bp, Cicer arietinum
tggacgccgagtgcttgtcattgaaagagatctgagtgagcctgatagaattgttggagagttgctacaacctggcggctatctcaaattagttgaactgggccttgaagattgtgtgaacaatattgatgcgcagcaagtgtttggttatgcacttttcaaagatgggaaacatactcgtctctcttatcccttggataagtttc

SEQ ID NO: 2801 - DNA, 238 bp, Cicer arietinum
acggttctttgccaggctctaacggtgagctcagcaacaacctcgggtgcaacctttggtgaatcggatcctggtgtcaccatgttaggcttcaagagagttccttcgaggaggacatggtggtcactcaaggccttgtaggttgctgcaaggacacgctcggtgatggcggcacacttgtgaatgtcgtgagatccgtcaacaaggatctcatgctcgacaataggaacaagtccga

SEQ ID NO: 2802 - DNA, 439 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccaaaattccttctctgaaaactgctgttag

SEQ ID NO: 2803 - DNA, 424 bp, Cicer arietinum
acaacaattaagcctatgttcttaaaccaagccataaatcgaccttgcaatccaaaacaattgaaaattctatacccgacagtgttgatgctgccccaaatgcaacaaatacaacaaatgctacccgagatttggagtctgaatttggagcaggccacgaagggaaagtttgggaaatttctgtggacaacgctgaaccaacaaaatccaaaggtgatctcctatcagtcctgaaggctgagaaagaagagttggaatcatcgctcagtaaggagaagctgcatactctacaactaaagcaagagttggctgatgctgagtctagtaactctgacctttacaaggagctccaatcaatacgtggtcagcttgctgctgagcagtcaaggtgtttcaaacttgaggtggaggttgctgaattagg

SEQ ID NO: 2804 - DNA, 435 bp, Cicer arietinum
tctctctctcgcgctctcacttaaccaaaaaccacgagaagaggaacaagatgcagatcttcgtcaagactttgaccggaaagactatcactctcgaggttgagagtagcgacaccatcgataacgtcaaggccaagatccaggacaaggaaggtatccctcctgaccagcagaggttgatttttgctggtaagcagctggaagatggtcgcactcttgcagattataacatacaaaaggaatcaacacttcacttggtgttgaggctcagaggaggaaccatgattaaagtgaagactctaactggaaaagaaattgaaattgacattgagccaaccgatacaattgatcgtatcaaggaacgcgttgaagaaaaagagggaattccacctgtgcagcagaggctcatatatgctggtaagcagcttgctgatg

SEQ ID NO: 2805 - DNA, 261 bp, Cicer arietinum
tctctctctcgcgctctcacttaaccaaaaaccacgagaagaggaacaagatgcagatcttcgtcaagactttgaccggaaagactatcactctcgaggttgagagtagcgacaccatcgataacgtcaaggccaagatccaggacaaggaaggtatccctcctgaccagcagaggttgatttttgctggtaagcagctggaagatggtcgcactcttgcagattataacatacggaaggaatcaacacttcacttggtgt

SEQ ID NO: 2806 - DNA, 181 bp, Cicer arietinum
actgagctgaacaagaaaatttacaagcttggcaagtctggagaagagacccatgatgcccaaactgattatgataggactgagaaagacatcaccccaatgggtggattcccccactatggtgttgtgaaggaggattatctgatgatcaagggaggtgttgttggtcccaagaaaaggg

SEQ ID NO: 2807 - DNA, 230 bp, Cicer arietinum
actgagctgaacaagaaaatttacaagcttggcaagtctggagaagagacccatgatgcccaaactgattatgataggactgagaaagacatcaccccaatgggtggattcccccactatggtgttgtgaaggaggattatctgatgatcaagggaggtgttgttggtcccaagaaaagggttattactttgcgtcagtctctactcaagcagacttctcgcaatgcctt

SEQ ID NO: 2808 - DNA, 372 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgagacgtgcttcaccgacaactactg

SEQ ID NO: 2809 - DNA, 430 bp, Cicer arietinum
actgagctgaacaagaaaatttacaagcttggcaagtctggagaagagacccatgatgcccaaactgattatgataggactgagaaagacatcaccccaatgggtggattcccccactatggtgttgtgaaggaggattatctgatgatcaagggaggtgttgttggtcccaagaaaagggttattactttgcgtcagtctctactcaagcagacttctcgcaatgccttggaggatatcaaacctaagtttatcgatacctcttcaaagtttgggcatggtcgcttccagacaacacaagagaaacagaagttctatggacgcctcaaagcttagttatggctgctgctttgaaatgttggaaatcgttatttatgttatttttgttgccatccttttgaactctgttgtggtgtcttccgttagctat

SEQ ID NO: 2810 - DNA, 434 bp, Cicer arietinum
actcccctcttcttttgttgcagccattttcgagaggcgatctgcacaaaagattcgacacaaccgctcacgaggcgaggaggatgacgaccaggtcaatgagtgggaacaatttcacgaggaccttgacatggaaggtgaaggttgggccaagacttgtgaggctgtcaaacctaacgtggaagacgagcctgctgtcattgaagtccgcaagctgcgagctgagatggaagaactcaaggcgatgctttctcaactgacaaacagcaaaggaagtgatgatgagaccataacgggctcaaagagtggaaaggagccagccactgaagacgacgatacccaagaggcatctgaggctgctgagacccaggatgcgccagacacgtcggatacaccagagggggaaggggcttctggtgatcaaaagcagggca

SEQ ID NO: 2811 - DNA, 438 bp, Cicer arietinum
acagactaccagtccagaaaactagaaattcgatatggacagaagaagagcaatgagcagctgaagcaatatgttcatttgttgaactctactctcacggctaccgagaggaccatttgttgcatactagagaacaaccagaaggaggatggggtagagataccagaagttctcaggccattcatgggtggaaagtctttcctgcctttcaagaaccaacctaataatgaagccaaagggaagaaatcaaaggcttaattgcattatttttagtctgaatgatatttatgaagagctagttcagaattgtaggttatgaccactgttaattatcttcaggaacatgcacaatacttggcatattctgtaactcatcaaattatagaccttgtgctttatttactctcttgtgcttttatttattttgaaatattaaga

SEQ ID NO: 2812 - DNA, 402 bp, Cicer arietinum
tttgagaaggcaacaaaaataacatctttcaaagaaaaactggacatccaatccggagtcttaatatttcaaaataaataaaagcacaagagagtaaataaagcacaaggtctataatttgatgagttacagaatatgccaagtattgtgcatgttcctgaagataattaacagtggtcataacctacaattctgaactagctcttcataaatatcattcagactaaaaataatgcaattaagcctttgatttcttccctttggcttcattattaggttggttcttgaaaggcaggaaagactttccacccatgaatggcctgagaacttctggtatctctaccccatcctccttctggttgttctctagtatgcaacaaatggtcctctcggtagccgtga

SEQ ID NO: 2813 - DNA, 366 bp, Cicer arietinum
gaataatataatgacaacacttggtggagttcgcgatgtgccaggaaaccagaacagccttgagatcgatagtctcgcccgctatgctgttgaggaacacaacaaaaaacagaattctcttctggaatttgaaagggtgataagtgcaaaacagcaagtggtttctggaaccttgcatcacatcactcttggggcaaaagatggggtgaataaaaaggtttatgaagtcaaggtttgggaaaagtcttggatgaacttcaaggaggtgcaggagttcaagcttgttgaagatgcatctgcggagtcaagtgcttaactaggttaataataattaataaaagtcatgttcctagcttggctcgaagg

SEQ ID NO: 2814 - DNA, 447 bp, Cicer arietinum
agctcccggctcccatggcggccgaaggaattcgatttcgagcggccgcccgggcaggtgaataatattatgccaacacttggtggagttcgcgatgtgccaggaaaccagaacagccttgagatcgatagtctcgcccgctatgctgttgaggaacacaagaaaaaacagaattctcttctggaatttgaaagggtgataagtgcaaaacagcaagtggtttctgggaccttgcatcacatcactcttggggcaaaagatggggtgaataaaaaggtttatgaagtcaaggtttgggaaaagtcttggatgaacttcaaggaggtgcaggagttcaagcttgttgaagatgcatctgcggagtcaagtgcttaactaggttaataataattaataaaagtcatgttcctagcttggctcgaaggtgagacgcctaaggataattta

SEQ ID NO: 2815 - DNA, 407 bp, Cicer arietinum
acgctagacactaccatgctcactgacctacagaatttgtgtccccaaaatggagatggaaatgcaactgctgttcttgataggaactcaactgatttatttgacaatcactactttaagaacttgctcaatggaaagggccttcttagttctgaccagattttgttttcttctgatgaagccaattcaactactaagcctttagttcaaagctatatcaacaatggttcacttttctttggagactttgtcaagtctatgatcaggatggggaatataaatccaaaagtggggtctgatggagagattaggaagagttgcagagttataaattcatagtgatgtgcattaggctttgcaaaatactagtatatgaaataagtggaagattaacaatgtgtcttcct

SEQ ID NO: 2816 - DNA, 407 bp, Cicer arietinum; identical to SEQ ID NO: 2815

SEQ ID NO: 2817 - DNA, 460 bp, Cicer arietinum
acgggaagtctcgtgaacgagatatggcccgagtcccccgcagtgtcatatcctcctcatttctcaggtaagaagcatctatgggttctgcttgtaggcctctcccttagctccatgggtgctctcatcgatcttgtcgccaactgcatctttggcagcggaagcacgagtgccaatgccggcgttggagtccttggcaacctccttgttagcctccttgctggtgccagagataccctcctggaccttctcggtagcttggttaacggtgttcttgatggtatccattgctggtttatatagttttcttgtttaaaaagaaaaagataattgagttggttatgttgaggttggtggtttgtttgaatttattagttagttgtgaaaaactgagaagaaggagaaggaggatgagcacacgatggccatggaccatggccatggaggttgtggtggttgt

SEQ ID NO: 2818 - DNA, 280 bp, Cicer arietinum
acaatgctgagaaaaggggcaaacgccaagtaatgattaggccatcctccaaagtcattatcaagttccttatcgttatgcaaaagcacggatacattggcgagttcgagtatgttgatgatcatagatctggaaagatcgttgttgaattgaatggtaggttgaataaatgtggtgttattagtccacgttttgatgttggtgttaagaagattgaaggttggactgctaggcttctcccttcaagacagtttgggtatattgtcttgactacctcagc

SEQ ID NO: 2819 - DNA, 237 bp, Cicer arietinum
acggttcgctgcaaggctctaacggtgtgctcagcaacaacctcgggtgcaacctttggtgaatcggatcctggtgtcaccatgttaggcttcaagagagttccttcgaggaggacatggtggtcactcaaggccttgtaggttgctgcaaggacacgctcggtgatggcggcacacttgtgaatgtcgtgagatccgtcaacaaggatctcaggctcgacaataggaacaagtccg

SEQ ID NO: 2820 - DNA, 429 bp, Cicer arietinum
caattccatcctattagattttcacttgttaaattcaaccattttcatctctcttgaattcttcattcatcaactttgttaaccatgtcgaatactgctggtcaggtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaagggtcagactccactgtttcctcgtatatttggtcatgaagctggagggattgtggggagcgtaggggagggtgtgactcatctggaaccaggggatcatgctctgcctgtattcactggggagtgtggggaatgtccacattgtaagtctgaggaaagcaacttgtgtgat

SEQ ID NO: 2821 - DNA, 206 bp, Cicer arietinum
acatcagaaattatgatagcataaaccccaccaattatggtgctaggtgccaatcccacacgtgcgtgtttaggtgtaaacacaacggctattacaatgaattggtcttcaaagagggacaaagagatcaactttgtaaatatcttctttaacagataagctttgtaaaaatttgtggtgtaaatgatacgagtttgagtttggtt

SEQ ID NO: 2822 - DNA, 437 bp, Cicer arietinum
tctctctctcgcgctctcacttaaccaaaaaccacgagaagaggaacaagatgcagatcttcgtcaagactttgaccggaaagactatcactctcgaggttgagagtagcgacaccatcgataacgtcaaggccaagatccaggacaaggaaggtatccctcctgaccagcagaggttgatttttgctggtaagcagctggaagatggtcgcactcttgcagattataacatacaaaaggaatcaacacttcacttggtgttgaggctcagaggaggaaccatgattaaagtgaagactctaactggaaaagaaattgaaattgacattgagccaaccgatacaattgatcgtatcaaggaacgcgttgaagaaaaagagggaattccacctgtgcagcagaggctcatatatgctggtaagcagcttgctgatgac

SEQ ID NO: 2823 - DNA, 151 bp, Cicer arietinum
cttttagtatggcattggttatagctgtgttatctattttcagaatgcagaaattagctcaggaacaaaatgaaaagattgaaaaagttaatcgtgaaaggaaatatcatcagcaaaatactgcatatgagcttaatgctttggcaatgca

SEQ ID NO: 2824 - DNA, 293 bp, Cicer arietinum
actcctcagtccttcccttgaaaccaatttggccaaaagtgagggagatgaacagtcccaaatgccaacagatcagccataaccaaaactgtgaagtgagagcaggaggggttgggaagtgagcaagttcagttccaatgctatcaaagaaaagtccagtcagacttttaccgtcgatagccggtatgctagacggtgccgaccaaccaattaacccaaacccaatcacattgaaatccctccgcagccaatccctctggaagcatgtaaccctcccaccatttccccgtgcc

SEQ ID NO: 2825 - DNA, 436 bp, Cicer arietinum
ataactttgctcacatatatctgattcagatccaaaccatagattagatctaaaatggcaacaaccacctttgcaaccgtcgtaggaatgggtggcgcatcacgtctcgcctcagggtttgtgaaaccacaagtgatggccaggaatcgcttgaggcaagctatggcacggggaaatggtgggagggttacatgcttccagagggattggctgcggagggatttcaatgtgattgggtttgggttaattggttggtcggcaccgtctagcataccggctatcgacggtaaaagtctgactggacttttctttgatagcattggaactgaacttgctcacttcccaacccctcctgctctcacttcacagttttggttatggctgatctgttggcatttgggactgttcatctccctcacttttggccaaattggtt

SEQ ID NO: 2826 - DNA, 418 bp, Cicer arietinum
actcctcagtccttcccttgaaaccaatttggccaaaagtgagggagatgaacagtcccaaatgccaacagatcagccataaccaaaactgtgaagtgagagcaggaggggttgggaagtgagcaagttcagttccaatgctatcaaagaaaagtccagtcagacttttaccgtcgatagccggtatgctagacggtgccgaccaaccaattaacccaaacccaatcacattgaaatccctccgcagccaatccctctggaagcatgtaaccctcccaccatttccccgtgccatagcttgcctcaagcgattcctggccatcacttgtggtttcacaaaccctgaggcgagacgtgatgcgccacccattcctacgacggttgcaaaggtggttgttgccattttagatctaatcta

SEQ ID NO: 2827 - DNA, 350 bp, Cicer arietinum
acgacggattccgcctccggaaacttctcctgcgtcacaggcgactgtggatccggaaaaatagcatgcggcggccgtagtggatcgccgcctgtgacgctagcggagttctcaataaacagtttcaacaatcaagacttttatgatgtaagcttagttgacggttataacgtcccgatggatgtgattccgttaagtaactctggaaagtgtaaagcacgggttgtcctacggatctgaatgcggtgtgtccaacggagttgaaagtaacggaaaatgggatagttgtggcgtgtcagggtccttgtgctgctttcaatttgcagtttttttgttgtgttgggaatcat

SEQ ID NO: 2828 - DNA, 263 bp, Cicer arietinum
accctgatgtcaaccacgctactgttaaaaccacttctgcggaaaagcctgtccgtgaactcatagctgatgatgcgtggttgaatgcggaattcataactaccgtccaacaacgaggtgctgcaattattaaagctagaaagctttcaagtgcattatctgccgctagcgctgcttgtgaccacattagagattgggttcttggaactcctgagggaacctgggtatccatggggagtttattctgatggatcatacaatgt

SEQ ID NO: 2829 - DNA, 204 bp, Cicer arietinum
acaatatttggtgttctatatattcttcttggaaagcgggtctggtttttccctaacattcttgccgaggaagcaacactgcgagagctgttcagattttggccaaagaaagatgaagaggaaagacctaagtggacgacaaggattttctattctgtggtggctgtgctgttcatattactgctgaggcatcatgcacctgat

SEQ ID NO: 2830 - DNA, 198 bp, Cicer arietinum
actatattcatcttaggttgaataatgatcccggttggacaaatatcaaggttattctttctgatgcaaatgttcctggtgaaggggagcataagattatgtcctatattcgccttcaaagaaatcttgagggatgtgatccgaatacacgacattgcctgtatggtttggatgctgatttgattatgttgggtcttg

SEQ ID NO: 2831 - DNA, 415 bp, Cicer arietinum
acaaagcagagaaacagagcgttggagagaagttgtagctgttccaacacttgtaacatcaccggcacttcttctacgtgaacgattttgattgcatccatttacatgaggaacttgaagctgctccaaatttgtaacaacctcatccatgtttggtctcaactttgcttctattgaaatgcaccttacggagagtgtggcaaccttgtaggcatcatctaattcatattggccttcaaggcgattatccaacacgcgcaaaaccttacgcctgttggatagataaggcctagcccattccaccaaattgtgttgtttgtgtggtctattcttgtcaataactctccttcctgataatatttccagtagaacaactccaaaactatagacatcactcttagtagtgtgattacca

SEQ ID NO: 2832 - DNA, 422 bp, Cicer arietinum
acaaagcagagaaacagagcgttggagagaagttgtagctgttccaacacttgtaacatcaccggcacttcttctacgtgaacgattttgattgcatccatttacatgaggaacttgaagctgctccaaatttgtaacaacctcatccatgtttggtctcaactttgcttctattgaaatgcaccttacggagagtgtggcaaccttgtaggcatcatctaattcatattggccttcaaggcgattatccaacacgcgcaaaaccttacgcctgttggatagataaggcctagcccattccaccaaattgtgttgtttgtgtggtctattcttgtcaataactctccttcctgataatatttccagtagaacaactccaaaactatagacatcactcttagtagtgtgattaccattggcta

SEQ ID NO: 2833 - DNA, 374 bp, Cicer arietinum
actggcaacgtggccgactgctttcgccgtttgctttgtcgttcttgagagtcaggacggaccagtgatcgactaaatgctaatcggcgctcaatatagtccaaggcactattgctctcagatgctgaaacggcattgcaggccacctcatgagccatgtccttgtacttctcttcccagactctcgttaagtttccttcataggtcttcctccattctgacgtctgacgagacggcagctggttccaaagctgctctagagttcgccatttcttacacgggtggaatacaactgccgctacgtaggcggtagaggtcagcttgccataatagtcattcagcttcttccatccgaacttgatgtaattcttcaa

SEQ ID NO: 2834 - DNA, 238 bp, Cicer arietinum
cacgttagctgtccccttacacaataatgtcatcatctctggccacttcgccacagtgaaatcaaaacttacaactaactctgaaatttccatggctcgttgaaatcgaattgattaataaaggaatcaagtcgaagcgttaagcattaattaaacggcatgatgacactagcttatggggaatgaatgggaaatggatttagtgagagagaagagtaagtggcaggcatgtacacgt

SEQ ID NO: 2835 - DNA, 335 bp, Cicer arietinum
gccgaggtgagtaaactaagttttcaactcaacaagaacaaatcatggcattgatggcagcaacagcaagctcagcaactgttgttaaacaatctcctttccttggacaaaggaaaggtgccagtgccaatcctcttagagatgttgtctccatgggaacttctaaattcaccatgggaaatgaattgtggtatggaccagacagagtgaaatatttaggacccttttcagctcagacaccttcatacttaactggagaattcccaggaaattatggatgggacactgctggtttatctgctgatcctgaagcatttgccaagaacagagctctt

SEQ ID NO: 2836 - DNA, 439 bp, Cicer arietinum
gagtaaactaagttttcaactcaacaagaacaaatcatggcattgatggcagcaacagcaagctcagcaactgttgttaaacaatctcctttccttggacaaaggaaaggtgccagtgccaatcctcttagagatgttgtctccatgggaacttctaaattcaccatgggaaatgaattgtggtatggaccagacagagtgaaatatttaggacccttttcagctcagacaccttcatacttaactggagaattcccaggaaattatggatgggacactgctggtttatctgctgatcctgaagcatttgccaagaacagagctcttgaggtgatccatggaagatgggcaatgctaggagcactaggttgcataacaccagaagtgttagaaaaatgggtgagagttgacttcaaagaaccagtttggttcaaagcag

SEQ ID NO: 2837 - DNA, 303 bp, Cicer arietinum
acttggacagctaccatatcatattttcaatgaagaagaaattgaagaagcaacaaataactttgaacaatcaaatctaatgggagaagggtcacaaggacagatatataaaggctggttgagagatggttcagtggtgcatgttaatcgtattaacataaagcaaaagggtttacctcacagcattatgaagcacttagaggtattgcaaaatttgaggcataggcatatggtgagtgttttaggacattgtgtcattactcatcaggaccctccacaagtaacaagcacagtgttcattgt

SEQ ID NO: 2838 - DNA, 436 bp, Cicer arietinum
actgattaattcattattcacaaagaaccataaaattcataacatcgtaaacttattctactgggccaacacaggccctatcacttccacaacaagtaaaagaaacatcagacagatattaatcccacagccacagattagaaaccaccacgaagacggagcacaaggtgaagggtggactccttctgaatattgtaatcagcaagggtccttccatcctccaactgcttccctgcaaagatcaacctctgctggtccggtgggataccttctttatcctgaatttttgccttcacattatcaatggtatcagagctctccacctcaagggtaattgtcttcccagtcaaggtcttcacaaaaatctgcataccaccacgaagacgcaacacaaggtgaagggtaggctccttctggatgttgtaatcagcgaggg

SEQ ID NO: 2839 - DNA, 413 bp, Cicer arietinum
ccatggcggcgcggaattcatagcgtggtccggccagggatgcacccaaactttgcaaaacctcgagtccttttaactttgccaagcctgagcatccccataaaacattggcaggagctcttacaaggttttttgtgcatcccctgataagcaaggaaggaaatgcgtcaagcttgttttgattatcttagccttggaggcctattctcggagggaccgatatctttactttcaggattaaaccctcgacccttaagcttggttctccatttctttgctgttgcagtatttggtgttggcgcgtttactactacccttccttcacctaaacggatgtggatcggagctaggttaatctctggtgcatctggaattatcttacccataattaaggctgaaggaattcgccaaat

SEQ ID NO: 2840 - DNA, 390 bp, Cicer arietinum
attctgaagaactttaaaagggtatgcagcacttgtggttgtaatggtgtgcatttttgtgtctgcatttgcgtggtcttggggtccgctcggttggctaattccgagtgagatatttccattggagactcgttctgcaggacaaagtgttacagtttgtgtcaactttctcttcacttttgtcattgcacaagctttttctttcaatgttgtgcaatttcaaatttggtatcttctttttcttctctggttggatcttgatcatgtctgcttttgtccttttccttgtccccgagacgaagaatgtccctattgaagagatgacagagagagtgtggaagcagcattggttgtggaagaggtttgtcgaagatgagaaagtagaggatg

SEQ ID NO: 2841 - DNA, 345 bp, Cicer arietinum
tgagaacggagtaggtgcgtgatgggcagtgtgcagctatgggagagtctcaaggagtccatcgtcatctacaccggtctcactccgaccaccttcttcactgtcttggctattctattggctttatactacatcttctctgctctctttgggtcatcctcctctgaacgtaaccaccacttccaagaggaagacctgcctcctctcaaaccgccggttcagctcggagagatcaccgaagaagagctcaaggcttacgacggctctgatcatgataaacccttgctcatggccattaaggctcagatctatgatgtctcccaaagcagaatgttttatggacct

SEQ ID NO: 2842 - DNA, 274 bp, Cicer arietinum
  misc_feature (112)..(112): n is a, c, g, or t
aggtccttaaacattctgctttgggagacgcatagatctgagccttattggccatgagcaagggtttacatgatcagagccgtcgtaagccttgagctcttcttcggtgatntctccgagctgaaccggcggtttgagaggaggcaggtcttcctcttggaagtggtggttacgttcagaggaggatgacccaaagagagcagagaagatgtagtataaagccaatagaatagccaagacagtgaagaaggtggtcggagtgagaccggtgtag

SEQ ID NO: 2843 - DNA, 337 bp, Cicer arietinum
ggcggcacctcagaaccagaacgtcttagatatcggaggacgatgccccgggcattcgtagcgacatccttccgaataacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgacaatagattgcccccgaacccgctgacgggtgacgggcttgagaaatacagcaccttttgtgccattg

SEQ ID NO: 2844 - DNA, 259 bp, Cicer arietinum
caggatatggtgcatataattcatatatttctgcatcgacgactagatatgcagcacgttggtgctccgacgtttgtatgagttatcccagttaatttatggaagaggagaacctgttcgtggaatgtgcaaaaagatttttgttggccggcttccccctgaggcaaccactgaggatcttcgcctgtattttggaagatttggccatatattagatgtttatattcctagggatgtcaagagatctggtcatagaggt

SEQ ID NO: 2845 - DNA, 290 bp, Cicer arietinum
actaggttgaattctattgcgacactgtcatagtagggaaaacttaacctgtctcacgacggtcttaatcccagctcacgtccctattggtgggtgaacaatccaacacttggtgaattctgcttccaatgataggaagggccgacatcgaaggatcaaaaagcaacgtcgctatgaacgcttggctgccacaagccagttatccctgtggtaacttttctgacacctctagcttcaaattccgaaggactaaaggatcgataggccacgcttttccggttcgtattcgt

SEQ ID NO: 2846 - DNA, 307 bp, Cicer arietinum
  misc_feature (39)..(39): n is a, c, g, or t
acaggaaggaacttgttgtttggacgaatttggtgaccntggatagcatcggtggtggatccgcagttgccccgttaaatagaccttcgaggaaaggcccaacctttatgaaagtaaagttgatttatcctttcggaaaagtagctcggattgtgcattaccaagaggaccggcttgcatgagaaaatcattgtagaatttactccccaaagcattgctgtatcatttattgttccgtagggagatatcgaatcgtagttgaaactgaaaagttgcgtcagattgtcaaagttcgggtgttgaatga

SEQ ID NO: 2847 - DNA, 184 bp, Cicer arietinum; identical to SEQ ID NO: 1366

SEQ ID NO: 2848 - DNA, 265 bp, Cicer arietinum
  misc_feature (10)..(10): n is a, c, g, or t
  misc_feature (173)..(173): n is a, c, g, or t
cctgaaaacncaacgctccggctctgcccaagtagcagagaggcaaggaaatacttagcaggcttattaacaaaataggaaaaccaatggaggccacgcaaacagcatgaaagacattgacttgggggatcagtttgttacaagcaccttggaagcatggcgactgtcggcangtacaaggctctagtggaccttagacagaacaaggaagcaaaggggttgtctctggcaggtttcatcagttggtttgtttggcgttcggcgt

SEQ ID NO: 2849 - DNA, 412 bp, Cicer arietinum
acaataatgccagtgttaaaatctgtaactgatcctgttataggtgctggaggaactgtatcaactcttgatagtttatcttgctgccccaagtgtttgtcataaaccccagtatactgaaagtgatggctccctgaatccacagctaacttcaaaggagcctcatgatgagtttctacagacaacgaaggggattgtaaacctgatgtatgagaaaaatcaactggcatgggtttggtagttctccaccagcaagatttatcatctaagtgatccgcacttgtaggcaagctatgtttctcccaaccaatcatatgtggaactttaccatgactgtcagttatatcttgacaccctaagttaatcctttcttcagcaacagaaccagcaaaatttgtttgatttgaggacc

SEQ ID NO: 2850 - DNA, 288 bp, Cicer arietinum
  misc_feature (95)..(95): n is a, c, g, or t
atcagcggccccgggcaggtcccatgcacgggtttttccctttaaggaagccgcaccgccggcctctgatccttccgaggtttttcctgccccgnacagtcactcgagctcaacttggtactggagattgtggactggtcagcagatgtacgatgcgtgagagaattctggtcggtggaaaaattcgacaaattgcctccgaacccgctgacgggtgacgggcttgacaaaaacagcgcccttttgtgccttggtatgctggatggtgaaggaagaggggtatcctgt

SEQ ID NO: 2851 - DNA, 285 bp, Cicer arietinum
cgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtaacgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 2852 - DNA, 285 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgttacatctgctgacgcagtccacaatctccagtaaccaagttgtagctcgtagtcgactgtcgcggcggcagggaaaaacctcgggaagggatcagaggccggcggtgcggcttgccttcaaaggagaaaaacccatcgcaatcggcg

SEQ ID NO: 2853 - DNA, 390 bp, Cicer arietinum
  misc_feature (154)..(154): n is a, c, g, or t
ggtccggccgagggagtaactagttttcactcacaaacaatatggattgatggcagcaacacaagctcacactgttgtaaacaatcccttccttggacaaaggaaaggtgccagtgccatcctcttaagatgttgcgccatgggaacttcaaanttcaccatgggaaatgaattgtggtatggaccagacagagtgaaatatttaggacccttttcagctcagacaccttcatacttaactggagaattcccaggaaattatggatgggacactgctggtttatctgctgatcctgaagcatttgccaagaacagagctcttgaggtgatccatggaagatgggcaatgctaggagcactaggttgcataacaccagaagtgttagaaaa

SEQ ID NO: 2854 - DNA, 386 bp, Cicer arietinum
actggtgcttccggagcactatcatgtgtgccaaatgaatcaaatcttgacgtttcccgagcaggtaaagatacactatcatgtgtgccaaacgaatcaaatcttgagaagtcaaaagcgttttccaaccagtctttgggcctttgtggtgaggtgctcgagttgaaaagtggggtgcttggaacagaatcatcaaaactgaatccaccggtcttctggaagagatcaccagcctgtggtgaagcggttttaatggggttgaggcccaggtccccagaactaaagaaataattgtctccagctccatcaagatctctctcctcctttgtggtgctactggcattgaatccccaaactgaatcaatatcatcatttgtgtcgaaggt

SEQ ID NO: 2855 - DNA, 421 bp, Cicer arietinum
cggccgaggtggggccccagaccagacgcctagatatggaggacgatgcctatggatcggtaggacatctcccgataacgacgccgattgcgatgggttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtacctgtacctgcccgggcggccgcccgggcaggtactccttgataagggtacctgggaagagt

SEQ ID NO: 2856 - DNA, 337 bp, Cicer arietinum
  misc_feature (101)..(101): n is a, c, g, or t
  misc_feature (110)..(110): n is a, c, g, or t
aggtcagtcccccatacgagatcgctagtccaactggcagcccagaccatcaacaaatcaactttcaatgatgacagccaccgactatttcgagaaaacancgctctttncccgaaagagcttaagctcataggaccttctaattgggagcagttctcaccagcccagaaggctatcttgaggatcaatggtctcgaggatgctgtctttggcgactatccttctgaagatcagatgacgactgaccagaagatcaaggcggcaaaagcggccatctccataaggggtaactgcactggggaggctctcagccaactcgtcggaatggaagatcaaa

SEQ ID NO: 2857 - DNA, 291 bp, Cicer arietinum
tttctcccatgtctcgcgctctctctaaactctcccccaaatctttattctccaaatcgttctaactcactataaccaagattactgctagcctatcgcctagagccaagcttcgaccgcgactgcttgtcacttttgggcgccttcttccatcactcgagaaagtcagcaccgtcaaagatctcttgattcctcgcagtcgggtcggcttggaagcaagctacatgtcgcctatcccaacccgtttcttattattagtaagataggttgccccttgctctttgctccagt

SEQ ID NO: 2858 - DNA, 353 bp, Cicer arietinum
accatgtggaaacgtgtcacaccaatttgttcttttttccctaataccaaaacaagagctttctcaatagaatcaggaagcttaggacaaatgaaacgtccaacaataaaaggaagaaccaaagtgacaacatcaagaccatgttgttcaccaaattgaagcactgctttttctgccaaagtctttgaaactccataagaccaaccaaatggtttgacagttctaaacaaatcaacatcactccaatcactctcatccaagacttgtttgtcttttccagtgaatgaaacagcagagccacttgaagtgtatataactctttttactgtctttgaatgaacacatgcttttaa

SEQ ID NO: 2859 - DNA, 215 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcgcccttggctttgccactttt

SEQ ID NO: 2860 - DNA, 332 bp, Cicer arietinum
cttttagtattgcactggttatagctgtgttatctattttcagaatgcagaaattagctcaggaacaaaatgaaaagattgaaaaagttaatcgtgaaaggaaatatcatcagcaaaatactgcatatgagcttaatgctttgtcaatgcaatggaaggagctctgtcagaaaaatataggcatcagtgctgcgtgtgcttctgttgaaatttgccttcatgaactgagaagagaagctgcagaaagaggctggaacttggatgctatcactgaaaatggccaattaaatcattccgagtcatgagattcttatgtgcttacgtagttttgt

SEQ ID NO: 2861 - DNA, 276 bp, Cicer arietinum
actaccttgatccagaattccaagatcttggtaaggaagccaattaaaggacaagaaagcgttgtggtggaagatgactcatttcaaaaggacaccgcacactcgaataattctccaaaattgttccatcatgtcaatcattgagctatatccttatcgatttacagtgaagacttacttggcaaggcaatagatggctttttgagaggtggattcattaataattattttgattattttattcaacgagatggatatatgatatggaaaattaat

SEQ ID NO: 2862 - DNA, 173 bp, Cicer arietinum
  misc_feature (28)..(28): n is a, c, g, or t
  misc_feature (33)..(33): n is a, c, g, or t
  misc_feature (54)..(54): n is a, c, g, or t
acagcaaacgctcgagcatgtatcgacnccgantccaagaggccttgcagatgntcggagcgagaatcagcacggcagcgattgtagatagtttagctcagcacgtcctgtgctccattaggaggcttttcggggccaatggccccccggacgaaaaatatacataacatagc

SEQ ID NO: 2863 - DNA, 397 bp, Cicer arietinum
actcattacccccaagaggtacctctctactcgtagctcgccctacagtagttgtcggtgaagcacgtcccattggacatcaatacagttgatcctcgcagagcttccctccagcagcgtctcctatctagttcatccagcatatcatcggcacaaaggcgcatttactttcaagaggtcatcccgtcagcgggatctattcctctccagcctagaattctcttgcacagatagatcatgtagctttccataccctgaggcaggaagtccatgatcccctaagatcgccagtagctgcaacctaggactatgcatccttggggaaaccccttgcaggggaaaaacccaaggcggccagaacgctgctccgtagacgaggcaattgccccgttccacg

SEQ ID NO: 2864 - DNA, 136 bp, Cicer arietinum
actcattacccccaagaggtacctctctactcgtagctcgccctacagtagttgtcggtgaagcacgtcccattggacatcaatacagttgatcctcgcagagcttccctccagcagcgtctcctatctagttcat

SEQ ID NO: 2865 - DNA, 153 bp, Cicer arietinum
actaaccattagacaaaatatgacctaatcggtatgtatacactaaatttggccacagatttttgggaaaacttgtgtgtatgaaaccagggtcacgccaaccaacagttcgtgcaggtgaaccacacatgctgttacgaccaaatgtcaatg

SEQ ID NO: 2866 - DNA, 413 bp, Cicer arietinum
acgaaccattagacaaaatatgacctaatcggtatgtatacactaaatttggccacagatttttgggaaaacttgtgtgtatgaaaccagggtcacgccaaccaacagttcgtgcaggtgaaccacacatgctgttacgaccaaatgtcaatgttccagcaggcgattgcacgggcatttttccgtcagcaccccattcaacaaacggcgttgcttcatttatgtcatatccacttgtccatgtaactgtcatttcatcccaagacttcccttgagctagccgaggatataaaggcactttaggattggcaaatgatatgaaattggaaactgccacaagtttaggatttgatagtccgcctgagaatagcgcaaatgagaaatccgcacgttgattgatcaactggaaactc

SEQ ID NO: 2867 - DNA, 408 bp, Cicer arietinum
actctttctgtccaatttgcatccagcaaaatcagaataaccaactagagtgcaagtagatcccttaggataccacaaacctagatttttggttcctatgagatatctaaaaaccctcttaactgcactaaggtgggattcctttggattggcttggtatctagcacacatgcacacactaaacataatatctggtctactagctgttaggtaaagtaaggatcctatcaagcttctaaacacagtcacatctacaggtttacccttctcatctttatctaagtagcaggcttgactcataggtgtatcaatggatttaaacttatcaaaaccaaatttctttaaaagatcattgcagtatttggtttgacttaggaaaataccattcttgctttgtttgatttgaaa

SEQ ID NO: 2868 - DNA, 329 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtaatcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgt

SEQ ID NO: 2869 - DNA, 429 bp, Cicer arietinum
cgaccactgtggcctgtggttacctggcaacatcttccatttatttggggagaataacacggcgtatcatgacattcatcatcaactacaaggactgaaatacaattattcgcagccgttctttcccatatgggataaacttctcgggacatacatgcctttcaatcttgtaaagcggcccgaaggggggtttgaggcaaggccttcaaaggactagttacaatggtaattgttatggcagcgtttttcgatcgaacgagaggctttactgcagacatttcttgagttgagtggcgcttacagattttttttggtggcttgacaatgttttcagatcatgttattgcagtaggttttgccaacccaccttgtgtagcataacaatgatgtcgtggttaatgagataacttttcattattattatgatgt

SEQ ID NO: 2870 - DNA, 285 bp, Cicer arietinum
aggtactatgatggggccaaggcaccctcctccatggacacacgactctcccacgcggatccgctcaccctgatgaactgacgaagaattcgacacattccaacgtacaagaccttctgatattgtgaggatgcgatacgatcggcttagaagtattgctgggaggatacaaactgtggtgggtgatttggcaactcaaggtgaaaggctgcagtctttgctgagctggagagatccaagagctactgccttgtttgtgcttttctgtttgattgctgctattgt

SEQ ID NO: 2871 - DNA, 309 bp, Cicer arietinum
aggtacctcataaaagaaaatactaagaaacttgtcgggaaaaagaaattacatgaatgaataaggttataaggctgcatcacccgcaatagtattagcaaagagccaactacgaattcttttcagttgtgccatgaaatttccttccagcttcaacagcttccctgaacgcatctacgagctccttgttctcagggtcaagcgttactccctcgtaaaaagcatttgcagcttcatcaaacttctgcaatatacgcaaggctgcaccttccctataacaagcttttgaccaatctggttttaatgctc

SEQ ID NO: 2872 - DNA, 305 bp, Cicer arietinum
acctcataaaagaaaatactaagaaacttgtcgggaaaaagaaattacatgaatgaataaggttataaggctgcatcacccgcaatagtattagcaaagagccaactacgaattcttttcagttgtgccatgaaatttccttccagcttcaacagcttccctgaacgcatctacgagctccttgttctcagggtcaagcgttactccctcgtaaaaagcatttgcagcttcatcaaacttctgcaatatacgcaaggctgcaccttccctataacaagcttttgaccaatctggttttaatgctc

SEQ ID NO: 2873 - DNA, 344 bp, Cicer arietinum
actcattatccccaagaggcacctctctactcgtagctcgccctacagtagttgtcggtgaagcacgtcccattggacatcaatacagttgatcctcgcagagcttccctccagcagcgtctcccatctagttcatccagcatatcatcggcacaaaggcgcatttactttcaagaggtcatcccgtcagcgggatctattcctctccagcctagaattctcttgcacagatagatcaagtagctttccataccctgaggcaggaagtccatgatcccctaagatcgccagtagctgcaacctaggaccatacatccttggggaaacccctcgcagggaaaaac

SEQ ID NO: 2874 - DNA, 305 bp, Cicer arietinum
gagcattaaaaccagattggtcaaaagcttgttatagggaaggtgcagccttgcgtatattgcagaagtttgatgaagctgcaaatgctttttacgagggagtaacgcttgaccctgagaacaaggagctcgtagatgcgttcagggaagctgttgaagctggaaggaaatttcatggcacaactgaaaagaattcgtagttggctctttgctaatactattgcgggtgatgcagccttataaccttattcattcatgtaatttctttttcccgacaagtttcttagtattttcttttatgaggt

SEQ ID NO: 2875 - DNA, 249 bp, Cicer arietinum
gtctaaggataagaaggttactgctttgaaggaggctaagaagaggttcgaggatcgtttcaaaactgggaagaataggtggttcttcactaagctcaggttttgagttagtttgttgttggaaactgtttttttgtatcgtgattttagtattttgttgtgtttttgaactggttatggattttggaattgttgttgctggtatttgataattggataatttggtaatgctactacattgaggattcc

SEQ ID NO: 2876 - DNA, 418 bp, Cicer arietinum
actccatgtcttctgcgtaaacttttcgagtgtcgcgaggatttcattttgcgaagttaccagcgcagagatgtggacatgcctgtttttggtgtcttccggattctgaagcaacctagctaccggttgcccaatgttaccaattgacattgcggtgaaaggctcatttcccgagtcaataatgttcgctaagtgattcttcacgtcaaaaccaaactctggaaagagagctaaggccctatccaagaaggcgccattcacgaatgatgaccaagtgaagctagggttcttctccgacttctctttcagcagctccatgaccttctgcttctttcctagcagagctgcgtattctggcacatcatgcagccctttcgggacgccgaattcactagggatatatcgccggaccccagcc

SEQ ID NO: 2877 - DNA, 308 bp, Cicer arietinum
actgagaatgcccttaaattgggtgaaaggaaggaactcaaaccgactgtgtcaaccatcggtggcactgcgcagtgtcaaaagtgtttccagagtggtcactggacgtatgaatgcaagaatgagcgggtttatatttcgagaccgtctcggacacagcaacttaaaaaccctaaattgaggccggatgtgtctgtgagttatgatttatatgatgatcatcgtgaggctaaggatgaaaaggctaaagtgagttccagagaggccaagaggaaacatcaagctgcctctgattctgggagtgatag

SEQ ID NO: 2878 - DNA, 137 bp, Cicer arietinum
acacaagactacctaatccaatgttataaagccatacctctcttgggaagtgttggtatgtcttttgcggtaaatagtaatagtatggaggcaaatgaggaacaatatcatgctcatgtgtgactcggattgtattt

SEQ ID NO: 2879 - DNA, 431 bp, Cicer arietinum
actatattcatcttaggttgaataatgatcccggttggacaaatatcaaggttattctttctgatgcaaatgttcctggtgaaggggagcataagattatgtcctatattcgccttcaaagaaatcttgagggatgtgatccgaatacacgacattgcctgtatggtttggatgctgatttgattatgttgggtcttgctactcatgaagttcatttttcaattcttagagaggttgtatttactcctggacaagataaatgcttcgtgtgcggtcagatgggtcatatggctgcagactgtcaaggaaaggcaagaaagaaagcaggagaatttgatgaaaaaggcaatgctgttgttcctaaaaagccgttccagtttctgaacatctggactctgagggaatatctggagtacctggcccgggcggcc

SEQ ID NO: 2880 - DNA, 416 bp, Cicer arietinum
actcttttgtattacacacaataacttatattgttatattgtttttttatagatccacataacagtttatttttaactcatgtgcatcacacgagtgcacatttaatatacagtaaaggttaatatttttaataagaactttggggacagtcttatgttatatataaaaaaaggcaaccaagtgctggcattaagccacgattgagcagtgaatctaatagcttcatctttagtaatgacatcgtttgtccatttaattcttgttgtagcattgacaccatatccaatgttgtaaaactgagcgaagtaagagttttcagtgtttgtttcattaattttccatatcatatatccatctcgttgaataaaataatcaaaataattattaatgaatccacctctcaaaaagccatcta

SEQ ID NO: 2881 - DNA, 442 bp, Cicer arietinum
  misc_feature (2)..(2): n is a, c, g, or t
  misc_feature (97)..(97): n is a, c, g, or t
antttcagcggcccccgggaggtactaggcaaagaaccatggatagggagagcttgtttctatgacttggttgttggcattattgataggccatganaaaccatcatgtcaaaaggttcatcctggatggttttcaagaactgtggttcaagcacagaagcttgacgaaatgctggaaaagcagggtgctaaaattgacaaggtgctcaattttgcaattgatgatgcaatccttgaggagaggattactggacgctggatacacccatccagtggcagaacctaccatacaaagtttgctccttccaaggttcctggggttgatgatgttactggtgaaccccttatccagcgcaaggatgacactgcagctgttcttaagtcaagactggatgcatttcacaggcagactgaaccggttattgattactattcaaagaag

SEQ ID NO: 2882 - DNA, 344 bp, Cicer arietinum
acattcaattgactttttattttcatcaaaatgactctccaaatctaagttcgagaaaaaaaccggcatttgcagcaaagttgaaacggtatgcagatttcagaatgtatcaaagtagaaattggcaaaccaagtttcctaaaaaaaatcaacggcaatgcccggggggcctctattgagacagcactttctcaacctgagaagtcacctctttgggaggtttttcagcatggggattagcaacaatgcccttctttgaatagtaatcaataaccggttcagtctgcctgtgaaatgcatccagtcttgacttaagaacagctgcagtgtcatccttgcgctgg

SEQ ID NO: 2883 - DNA, 445 bp, Cicer arietinum
  misc_feature (17)..(17): n is a, c, g, or t
  misc_feature (45)..(45): n is a, c, g, or t
  misc_feature (122)..(122): n is a, c, g, or t
  misc_feature (374)..(374): n is a, c, g, or t
  misc_feature (379)..(379): n is a, c, g, or t
gtacaagcattcaatcntttcaaaaacccacatatgaaatggacnataaatcaggcggagaaattatgaagttggatggttattccatttactattactagaagtggatccttgcaatcacntaagcaccgtcgtcttctacagtgttcacccggtcacattcatcaatccattcactgtatatgtctattgcctcagataaagctgtgattgtagtgctaaagctctcttgacatatcctgcaagaagcttcccctatcaagttcttcatatcaatgcggcagtcaacactggaaccatgattgcagaaaggacaactaaagacagtgtcaagcttatccatccgtttctttggtggtggctttgtttttgcnttccntcttacccatagctcaaatccaatgattccgatcacagagcaagatagagaagacgaaccgaaagg

SEQ ID NO: 2884 - DNA, 404 bp, Cicer arietinum
acaggataccccgcttccttcaccatccagcataccaaggcacaaaaggcgctgtattttctcgagcccgtcacccgccagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaa

SEQ ID NO: 2885 - DNA, 426 bp, Cicer arietinum
actattgacttccctgagtttcttaacctcatggcaaggaaaatgaaggacactgactctgaggaggagctgaaagaagcgtttcgggtttttgacaaggatcaaagtggtttcatttctgctgctgagcttcgccatgtgatgaccaaccttggtgagaagctcacggatgaagaggttgatgagatgattcgagaagctgatgttgatggtgacggccaaataaactatgaggaattcgttaaggtgatgatggccaagtgatttctctaagttgagggggacaatgtttacttgtataacagtgctttgtagtagtcattgacctttcttcctacatttttatttcacggttaaatgttgattagtggtaagtccctactattggtggttgtggttgaatggtgtcttcttagtttgtcttgt

SEQ ID NO: 2886 - DNA, 435 bp, Cicer arietinum
acgaatcatggcggcgccttcgcgtatacggcggagagcttcgccgaggttacgacaaccgcaaacgaaagggatgcggaagttgtgtttgttgatgtgattgtcttcatcggctagggttaggacttcactttcgtcgacgtaatcgattccgagatgttcgaggatctgagcttcgacgaagtgaccgatacgggctttggccatgacagggatagtaacggcctgtttgatttctttgatgagttgtgggtcgctcatacgggctacaccgccttgggcacggatgtcggctgggacgcgttcgagggccatgacagcacatgctcctgcttcttcagcgatacgtgcctgttctgcgttgacgacgtccattatgacacctcctcgaagcatttgtgcgaggcccactttgacggaaaagggggatttctt

SEQ ID NO: 2887 - DNA, 177 bp, Cicer arietinum
accggaactttataagctccaactgctggtattttattggaatgtttgtcttcattgtcttcgtcagaatctgaatgatcaaatctaatttttgacgttggtagcattatttcatcatcaataccaatcattactggatcctctaagctaatttttgcaaggtgatttactttctca

SEQ ID NO: 2888 - DNA, 166 bp, Cicer arietinum
actcttttgtattacacacaataacttatattgttatattgtttttttatagatccacataacagtttatttttaactcatgtgcatcacacgagtgcacatttaatatacagtaaaggttaatatttttaataagaactttggggacagtcttatgttatatata

SEQ ID NO: 2889 - DNA, 354 bp, Cicer arietinum
  misc_feature (216)..(216): n is a, c, g, or t
  misc_feature (233)..(233): n is a, c, g, or t
gcggccgaggacaaggagcgaactgaccaagccaggcctacaatgctatttcgtgctaagaaacttcccaacaccgatccatgcaatgctaaagtcgtaaagatgagtcattactgatcttgacttgtcgcgaaatctgagagctggataataaggtcgtcaagattccgggttgtggtgtgttgtcgcgtttactcgacgttgatgcggcgaganctcgtgcttcttggccnttgggaacaacaatgctcaggataccgtccttaaacttggcagagacgttgtcctggtcgacacgagtggggaagttgaagctgcgagagaactcgccgaaggtgcgctcggtgagccagt

SEQ ID NO: 2890 - DNA, 239 bp, Cicer arietinum
cacgttatttgcccccttacacaataatgtcatcatctctggccacttcgccacggtgaaatcaaaacttacaactaactctgaaatttccatggctcgttgaaatcgaattgattaataaaggaatcaagtcgaagcgttaagcattaattaaacggcatgatgacactagcttatggggaatgaatgggaaatggatttagtgagagagagaagagaaagtggcaggcatgtacagt

SEQ ID NO: 2891 - DNA, 346 bp, Cicer arietinum
  misc_feature (3)..(3): n is a, c, g, or t
ccnggcggcgcgggaattcatagcgtggtccggcgaggtacagaccgtcccattcccaggctgtatcttctgcaacacccgcagaaaggttgactggctcaccgacaagctcactgctcgtgatttcaccgtctccgccatgcacggtgacatggaccaggctcagcgtgacctgatcatgaaggagttccgatccggctcttctcgtgtcctgatcgccactgatctcttggcccgtggtatcgatgttcaacaggtttccctggtcatcaactatgatctccctgccaaccgtgagaactacattcaccgaattggtcgtggtggtcgtttcggccgaaagggt

SEQ ID NO: 2892 - DNA, 379 bp, Cicer arietinum
acaataactaacaactgcgggaagctggcaaaatatcataccagcaagacaagacagatattcaaccaacacaaatatccaaaagtatcctaatatgcagagacaaactatataatagcctccctccaccaatgaaacatcatatcttaatttatacacaccaatctcaatcatcatcttcctcatcatcatcgtcgtcctcatcatcatcatcctcgtcttggtggtcatcctctacacttgcttcatcttcattattaacttcggatttggatttgtcagattcctcctcctcatcatccgctgaacttgccttgttgttataagcattcagaagtttttcatactcaactttcctttttgcagccttggcttcata

SEQ ID NO: 2893 - DNA, 429 bp, Cicer arietinum
gtcgactctcatctcgttccgttcagaagaatccatcaacaaccatgactcgtggtaaccagagagagaaagaccgggaaagggctcagtctagaaccggtggttctaaaggaaagcctgtaaagactgatgggttgactcctgaacagcgtacggaaagggatgcaaaggcactgcaggagaagacggctaagaaagcagctcaggatgctggagggaataatgcaggtggaagcaaaaaataggcaataataatttgattattattaatttggtgcttgaagtgttattggctattatagacatttatggaaaattgaaaatacttgtgtgtcatattctgatcatcttttttttgtagtttagaatcaaatgtgtttatctttcattactattattattgtcatgtgtggtaactgaaagggattg

SEQ ID NO: 2894 - DNA, 435 bp, Cicer arietinum
gtcgactctcatctcgttccgttcagaagaatccatcaacaaccatgactcgtggtaaccagagagagaaagaccgggaaagggctcagtctagaaccggtggttctaaaggaaagcctgtaaagactgatgggttgactcctgaacagcgtagggaaagggatgcaaaggcactgcaggagaagacggctaagaaagcagctcaggatgctggagggaataatgcaggtggaagcaaaaaataggcaataataatttgattattattaatttggtgcttgaagtgttattggctattatagacatttatggaaaattgaaaatacttgtgtgtcatattctgatcatcttttttttgtagtttagaatcaaatgtgtttatctttattactattattattgtcatgtgtggtaactgaaagggattgatattgg

SEQ ID NO: 2895 - DNA, 372 bp, Cicer arietinum
ggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcgacaatagattgcccccgaacccgctgacgggtgacgggcttgagaaatacagcaccttttgtgccattggtatgctggatggcgaaggaagcggggtttcctgt

SEQ ID NO: 2896 - DNA, 270 bp, Cicer arietinum
actgttcgcgttgcaggttgtaggctgctgaagaggtgtctgtcattgcagatatggacagacgatccagtatcgaataaccacctctctggcttgctttcgtagctggcagatatcctgcacttctctacgacttggactggtgcgttggagatttcgtcctcaaggatcaggaatgacctttctaccgttctgcgatttgactctctgatgtggaggtttttggtgtcttcattttgtcgatcatgctcagctagttctttggctagc

SEQ ID NO: 2897 - DNA, 392 bp, Cicer arietinum; identical to SEQ ID NO: 1458

SEQ ID NO: 2898 - DNA, 437 bp, Cicer arietinum
acttattacctcttgggttgtaattgctatcttattaatttcaactattctagttgttagaaatccgcaaactattccgacgtccggtcagaatttctttgaatatgtccttgaattcattcgagacgtgagcaaaactcagattggagaagaatatggtccgtgggttccatttattggaactctgtttctatttatttttgtttcgaattggtcaggggctcttttgccttggaaaattataaagttacctcatggagaattagctgcacccacaaatgatataaatactactgttgcattagctttacttacgtcagtagcatatttctatgcgggtatttcaaaaaagggattggcttattttggtaaatacatccaaccaactccaatccttttaccaattaacatcttagaagatttcacaaaacctttat

SEQ ID NO: 2899 - DNA, 439 bp, Cicer arietinum
acaaaaaagacgtggtaacaaaagaagaagagaaaaagggtgattttgattatgaatgttctgtttgtttgtcggtttatgaagaaggggaagatgttaggaaattaccaaagtgtaaacattgttttcatgctctttgtatagatatgtggctttattctcattttgattgtccaatttgtagaacacctgttgggtcttttcgtcataattttgtagaagagaattctcgtgatgggttgatggaatccagtggtattgtctatgtttgatttgatgagtttgaaaaatatttgtgtagagaaaatgttgttttgcttcaaagacataacattgaatgaaccaatgttttgaaaatgatattggatcatggttcaatcggttgaactttgaatttatctgagatagttcaatcggttgaactttgaatttatctgac

SEQ ID NO: 2900 - DNA, 435 bp, Cicer arietinum
ctctcctatcaacaatttttgtttcccagaaataccctcccaaatacgtcaaattcccttcgctgccactttctgcacttccgcgttcttcacctgctccgatggaagctcctcccgaaggttaccgcaggaacgagggaatctgtctcatcaataatcacaaaaagattttcgcagcttcaaggctagacattcccaatgcttggcaaatgcctcagggtggtattgatgaaggtgaggatccgagaaatgctgctattagggaactaagagaagaaacaggtgttagttcagcagaagtgattgcagaggcaccttactggttaacttacgacttcccaccaaaagtcagggagaaattaaacattcagtggggatctgattggaaggggcaggcacaaaaatggtttctttttaagtttactggagaagatc

SEQ ID NO: 2901 - DNA, 365 bp, Cicer arietinum
gaatgagggtgttgctgccttctataagggtctatcagctgggttactcaggcaggctacatacaccactgcccgacttggaacatttcgaatcttgacgaataaagcaattgaggctaatgatggcaagcccctgccactttaccaaaaagctctgtgtgggctgactgccggtgctattggagcaactgttggtagtccagcagatttggcactcattcgtatgcaggctgatgcaacattacctcttgctcagcgccggaattatacaaactccttccaggcactttaccgtattgctgcagatgaaggggttctgtcactttggaaaggtgctgggcctactgtagtgagagccatggcat

SEQ ID NO: 2902 - DNA, 417 bp, Cicer arietinum
acagagcttacctggagaccgtggagtgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggggaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 2903 - DNA, 336 bp, Cicer arietinum
actaccttgatccagaattccaagatcttggtaaggaagccaattaaaggacaagaaaacgttgtggtggaagatgactcatttcaaaaggacaccgcacactcgaataattctccaaaattgttccatcatgtcaatcattgagctatatccttatcgatttacagtgaagacttacttggcaaggcaatagatggctttttgagaggtggattcattaataattattttgattattttattcaacgagatggatatatgatatggaaaattaatgaaacaaacactgaaaactcttacttcgctcagttttacaacattggatatggtgtcaat

SEQ ID NO: 2904 - DNA, 319 bp, Cicer arietinum
caaggatgcacggtcctaggttgcagctactggcgatcttaggggatcatggacttcctgcctcagggtatggaaagctacttgatctatccgtgcaagagaattctaggctggagaggaatagatcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggctagctacgggtagagaggtgccttttgggggaatgagt

SEQ ID NO: 2905 - DNA, 310 bp, Cicer arietinum
ggatcactcaaggctgaagtgaccattaaagtgcgagctgaattcaactcaagcatcaatgctaacactgttcttgtacagatgccacttccaacattcacagctcgtgttaattttgagttagaacctggagcagttggacacacaactgattttagggaagcaaataaaagactggaatggggactcaaaaaggttgtcggtagctctgaacatactttacgtgcaaagctgacgttttcacaggagttacatggaaatatcatgaaagaagcagggcctcttagcatgacatttacgatacctatgt

SEQ ID NO: 2906 - DNA, 308 bp, Cicer arietinum
accgttgtttcgttggtggtctagcctggaccaccgacagcgacgccccagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgt

SEQ ID NO: 2907 - DNA, 437 bp, Cicer arietinum
acatgatcggtcaacatcccggttccgatgacaattctcgtccaccttttctccgtcgaacccgccgcaacggaggtgaccggtcacctttcaatccggtgatcgtcctacgcggaagtggatcaacggaggtaacagaaggtggtagcacaggagagagtcgtgggtttgagcttttctatgatgatggtgctggttctggtcttagacctttaccaccaagtatgtcagagtttcttttgggatctggatttgatagactgttagaacaactttctcagattgaaatcaacggtattggaagatatgaacatccaccagcttcaaaaacagccgttgattcattaccaactattgaaatcaatgggtgtcatttggatatggaatcacactgtgcagtttgcgaagaggcttttcagttaggtacctgcccgggc

SEQ ID NO: 2908 - DNA, 338 bp, Cicer arietinum
gggaactgcgaacaattactgctgtaactcttgttgctgaggatgctgagatcagcttcaatgctgccatgcttcaggaaggacttgctagaatggaaaaaagaaacaggtgggacagatcagcaagaaagcaggcccttgatagcttggaagcgttccaaggagaggctaggacaagcaggcgtggaatgtggcagtatggagatattcagtcagatgaagaggattctggtcctcctcagagaaaagccgctggccgcagataagtgtaatgcgattaataaattatataatatatagacatcttgagagaaaatgattcaagttatagacatgag

SEQ ID NO: 2909 - DNA, 240 bp, Cicer arietinum
cggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgt

SEQ ID NO: 2910 - DNA, 379 bp, Cicer arietinum
cgtactggttttagaaggagggtataatcttgactcgattgcaaagtcaatgcatgcttgtttagaggttttgcttgaagacaaacctcttattgaatcttcttcagaagcctatccatttgagtctacatggcgtgtgatccaagcggttcgccaggaattaagtcccttttggcctacgcttgcgtgtgaattaccacaatcaataattggtcaagtggcaccacctccgcatactcttttctcaagctctgactctgagactgaggatgaaaaagctccactcaaatttaaaaatattgcagagcttcttgaagatgtaatcaaaccattttccacgctcaaagttgatgcatatggagagactgatgcttcttgg

SEQ ID NO: 2911 - DNA, 433 bp, Cicer arietinum
acaaagttgggtgctggggaggatttatatgcgctttttgctggagttctaacaatgagaccttggaatagagttgttgacccatccatggatcatttagttatacagggaagtgagagtgaccgttcagaactgcagatgtatgcttctgaatatttccatgaaatctcggagcttctaaggagattaccacgtgtgattcttctaatgatgaagacaaacgactgtttacgggcagtcaacaatacgctgttacagggatcatctctggagacatttttaatcactggaaaggtttcttctgaggctgtcattgaagcaaaaatgtcacaaagcaaatcacttttaacttggtttaacgtgaaattggataagattttgctggaaatacggctttggggaatgcaaacggccttgtggcttttacaactga

SEQ ID NO: 2912 - DNA, 460 bp, Cicer arietinum
acgcatactgcccagagaacctcttcttctttgcagcctcggctgccgcccggaacacgaccgggcttcgacaatatgtctcactggctaagaccactagacaaaaccgctgggtcgaaatggtatagagcttacctggagaccgtggaatgaggcgactacctcgtccacagagcagcgttctagccgccttggggttttctcctgcgagggttttccccaaggatgcacggttctagggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggacgctgctggagggaagctctgcgaggatcaactgtattga

SEQ ID NO: 2913 - DNA, 360 bp, Cicer arietinum
acataattataaattaggcgtagtggccaatctccaaaatttagagttccactcatgcagtattttcaacttggccacatgtgaaggtaggagttaatcccaataatataaagttcagtgttcaaaaaatgctgtattacatcaactacagatatcatcgtaacacacaacacaatccatcacgctgcttgattttcactatttatccttcagttcacaaaacatgtcataacacaatcagagattttcttatccataatctcctcacagcaaattttccagatgaggctcggtcagtaaaatataagttgaacaacacgagtggaaacagtgattccaagaatatgatgtacctgcccg

SEQ ID NO: 2914 - DNA, 270 bp, Cicer arietinum
acaacaggagcaatagcacaagactgggaaccaatcgtgctacacaaatcaaaacccaaagcacaagaccttcgaaatccaaaagcagtgaaccaagctctccgaaccggagccgaaattttaacggttaaaaaattcgacgccggttcgaacaagaaaaccgccggttcggttttaaacgcgaggaaattagatgaagcggctgaaccagcagcgttggagcgggttggtggggaagtgggacacacgattcaaaaagcgcgtttggat

SEQ ID NO: 2915 - DNA, 200 bp, Cicer arietinum
cacgttagctgtccccttacacaataatgtcatcatctctggccacttcgccacagtgaaatcaaaacttacaactaactctgaaatttccatggctcgttgaaatcgagttgattaataaaggaatcaagtcgaagcgttaagcattaattaaacggcacgatagacagctagcttatggggaatgaatgggaaatgga

SEQ ID NO: 2916 - DNA, 217 bp, Cicer arietinum
ggtttatctactgctaacaccatagagggtgcacgcgctggtgctaggcagctggaagtcacaattaatgggattggtgaaagggctggaaatgcctcgttggaagaggttgtgatggccctgaaatgtggaggacatgtctttgacaatctgttcactggaattaatacaaggcacatttatatgacaagcaagatggttgaagagtacctcggcc

SEQ ID NO: 2917 - DNA, 214 bp, Cicer arietinum
actgtttcccacatcggctgggcgcccggggctgaccccatccaagactctccctgtgttatcatgatggagtttgacaaatacaacggaccggtgttcctgaccacccccgatggcaagaagattgtcccgattctctcagttgagagggacttcctcatcggagccactttctgcgctcgcacgcagtttcccctgatcgtatgctacgcca

SEQ ID NO: 2918 - DNA, 403 bp, Cicer arietinum
tgttgatgggccatcagccaaagactggagaggtggaagagctgcctcatttaacatcattcctagcagtaccggagctgctaaggctgttggcaaagtgcttcctgttttgaatggaaaattgaccggaatggcattccgtgtcccaactgttgatgtctcagttgttgaccttacagtgaagcttgagaaggccgctacctacgacgaaatcaaggctgctatcaaggaggagtctgagggcaagttgaaaggcattctcggatacactgaagatgatgtggtctccaccgacttcattggtgatactaggtcaagtatctttgatgccaaggctggaattgccttaaatgaccggtttgttaagcttgtctcatggtatgacaacgagttgggctacagt

SEQ ID NO: 2919 - DNA, 297 bp, Cicer arietinum; identical to SEQ ID NO: 2041

SEQ ID NO: 2920 - DNA, 385 bp, Cicer arietinum
ggagattataacatgggagaaggaggaagaagaaaaagaagaagaagaagctcaagtagaaatatggaaatacatatttggttttgttgaattagctgtggtgaaatgtgctattcaacttggaatagctgaagccattgaaaatcacaaaaaaccaatgtcactattagaaatatcatcaactctaaattgtgacccttcatatctcaaccgcatcatgagattcctaacacataggaaaatattcaaaacaatacctagcgaccataacgacaatcctagctatgttcaaaccccactctctcgccgtttgatttcaaacagcgaaaaaagtatgtctgctctccttttattagagagcagtcatgtaatggttgcaccttgg

SEQ ID NO: 2921 - DNA, 244 bp, Cicer arietinum
gcagtccgaaatccagcaaatatgaagatcatcgcggcgtatttgctggccgttttgggcggtaaagcagcccctacctctgatgatatcaaacacatcctcacttcagttggaattgaggccgaggatgagaagattgagttgctcttgggtgaagtcaagggaaaagattttgccgagctaattgcaggtggaagagaaaagttgtcttcagtgccatctggtggaggtgctgttgctgttt

SEQ ID NO: 2922 - DNA, 415 bp, Cicer arietinum
ctgctatcctcgagtatttaactgctgaggtgttggagttggccggcaatgcaagcaaggatctgaaggtgaagcgtattaccccaaggcatctacagcttgctatccgtggagatgaagaactcgacaccctcatcaaaggaacaatagctggtggtggtgttattcctcatatccacaagtctcttatcaacaaatcatcaaaggaatgaagtgttcgtaatttgtttcgaatcaacgtggaagaaaagaccgattttaatgtaaatttggtgataacttaattttacagataatttgctcgctgcgttggtttgattgattgagccatccttcttaagataatctgaaatttcttctttatttattatatggattgtattaactgacatgctcacttttgtgttatggtacc

SEQ ID NO: 2923 - DNA, 225 bp, Cicer arietinum
acttaaactcagacacggatcttatgatataagattaaggtccttaaatttgattagtgaaaattgagatctaaattgaagagaaaaaggttttgttttgttttgttttgtttttgtttcacttaaatggagagttttggtatcttaagcaacgccaattagcacaattctttaaacagctactatacaaccatttatctccattaactcccatgtgtctacctt

SEQ ID NO: 2924 - DNA, 293 bp, Cicer arietinum
acagagcttacctggagaccgtggaacgaggcgactacctcgtccacagagcagcgttctagccgccttgggtttttccctgcgaggggtttccccaaggatgtatggtcctaggttgcagctactggcgatcttaggggatcatggacttcctgcctcagggtatggaaagctactcgatctatctgtgcaagagaattctaggctggagaggaatagatcccgctgacgggatgacctcttgaaagtaaatgcgcctttgtgccgatgatatgctggatgaactagatggg

SEQ ID NO: 2925 - DNA, 278 bp, Cicer arietinum
acttacattgtttaaaacgctgatagacaaaggattcaaagtcttcctactaactggtagagaccaagcaacactcgccaaaatcactaccaacaatttgcatagccaaggatttatcggctatcaacgccttattttgaggaatgcgcaatacagaggacaaagtgcagtaaaatacaagtcggcaattcggaaggagatagaagagcaaggatatagaatatgggggaatgtaggagatcagtggagtgatctccaaggagagtgtttgggcatgc

SEQ ID NO: 2926 - DNA, 160 bp, Cicer arietinum
acagcaaacgctcgagcatgtatacggctccgatgcaagaggccttgcagatggtccgatcgagaatcagcacggcagcgattgtagatagtttagctcagcacgtcctgtgctccattaggagactttttggggcctacggccccccggacgaaaaata

SEQ ID NO: 2927 - DNA, 272 bp, Cicer arietinum
cagcctccatcagttgtgcctggtggtgaccttgcaaaggtgcagagagcagtttgcatgatcagcaacaacactgctgtagcagaggtcttctctcgcattgatcacaagtttgatcttatgtatgctaaaagggcctttgttcactggtatgtcggtgagggcatggaagaaggggagttctcagaagcacgtgaagatcttgctgctcttgagaaagattatgaagaagtcggtgctgagggagcagaagatgaagatgaaggagagga

SEQ ID NO: 2928 - DNA, 438 bp, Cicer arietinum
gattcagatccaaaccatagattagatctaaaatggcaacaaccacctttgcaaccgtcgtaggaatgggtggcgcatcacgtctcgcctcagggtttgtgaaaccacaagtgatggccaggaatcgcttgaggcaagctatggcacggggaaatggtgggagggttacatgcttccagagggattggctgcggagggatttcaatgtgattgggtttgggttaattggttggttggcaccgtctagcataccggctatcgacggtaaaagtctgactggacttttctttgatagcattggaactgaacttgctcacttcccaacccctcctgctctcacttcacagttttggttatggctgatctgttggcatttgggactgttcatctccctcacttttggccaaattggtttcaagggaaggactgaggagtacc

SEQ ID NO: 2929 - DNA, 423 bp, Cicer arietinum
taagagccttgtgcgtcagatgttggaacctgatcctaaaaaacgcttgacggcggaacaggtgcttgaacatccctggctacaaaatgcaaagaaagcttcgaatgttccattaggagatattgtgaggacaaggcttaaacagttctctttgatgaacagattcaaaaagggagctctccgggtaattgcggaacatttatctcttgaagaagtagaaataatcaaagacatgtttacattgatggatactgacaaagatggcagaataacatatgaggaactgaaggctggtttgcagaaggttggttcacaactggctgagccagagataaagttgctgatggacgtggctgatgttgatgggaatggagtgcttgactatggggagtttgtagctgtgacaattcacttgcaaagaat

SEQ ID NO: 2930 - DNA, 256 bp, Cicer arietinum
acccgtttggcaaatgactcaaaggctgcaaagaagggtggtgggaggcagtttgatggtttgattgatgtttacaagaaaaccctcaaatctgatggcattgctggcctttatcgtggattcaacatctcgtgcgttggaattatagtgtatcgtggtctttactttggaatgtatgattctctgaaaccagttgttttggttggtgggatgcaggatagtttctttgctagtttccttttgggatgggcaatca

SEQ ID NO: 2931 - DNA, 384 bp, Cicer arietinum
gcccccgtggacacgtgtttatagagttcagcgggatattccgatgccattggttacctctggagttgagaaagggaatctaagggagctagcattagcacgaatggaagacctgggattaaaatgtcgtgatgttcggaccagagaagctggaatccaggatattcatcaccaaattaagccagaagaggttgaacttgttcgtcgtgattatatggcaaatgaaggttgggaaacatttctgtcatatgaagatacacgacaagatatcctcgttggtttgttgcgactgagaaaatgtggccggaacactacttgtccagagcttatggggaaatgttctattgttcgtgagcttcacgtttatggaactgctgtacctgc

SEQ ID NO: 2932 - DNA, 246 bp, Cicer arietinum
gccgaggtacaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcacgtttactcgacgttgatgcagcgagactcgtgcttcttggccttggaaacaacaatgctc

SEQ ID NO: 2933 - DNA, 292 bp, Cicer arietinum; identical to SEQ ID NO: 1390

SEQ ID NO: 2934 - DNA, 406 bp, Cicer arietinum
gtttcatttcattcttcactgatctcagagatgtcaacatctgataaaccagaagtaggggaaagggatgaaaaagaaaagcaagatgaagggaagggtggatttctcggtacggtgaagggtttcattcaggacattggtgagaagattgaggaaacaattgggtttgggaagccaactgcagatgtttcagcgatacatgttcctaaaattaatcttgatgaagcagatcttgttgttgatgttctcataaagaacccgaatccggtgccaattcccctaattgatattaactatttagttgagagtgatgggaggaaattagtttccggattgataccggattctggtacaatccgtgctcatggtgaggaaacaatcaaaattccagttactttgatttatg

SEQ ID NO: 2935 - DNA, 292 bp, Cicer arietinum; identical to SEQ ID NO: 1390

SEQ ID NO: 2936 - DNA, 352 bp, Cicer arietinum
acctgagatgggaggtgaatctgccggaacctcagcttctcgtccaggcaatggttcaactgctggtcctgaacgcgctcagggggccgtagagggtcaaaagaagagagggagaagcccagccgacaaagaaagcaaacggcttaagaggctactgaggaacagagtttcagctcagcaagcaagggagaggaaaaaggcatacttgagtgacttggaatcaaaagtcaatgacttagagaagaagaattcagagcttaaagaaaagctttcaactttgcagaatgagaatcaaatgctgagacaaatattgaagaacacaacagcaagtaggagagggaacaacagtggt

SEQ ID NO: 2937 - DNA, 438 bp, Cicer arietinum
taaaaaacaattgtttgagtaaagaattgaagtgctacaatggcatcaaataaagaagaggtgaagctttttggaatgatgttaagtccatttgttactagggtagagattggtctaaaattgaagggagttggatacaaatatgagttagaaaaaatggggaatttaagtgaagcactcatcaattacaatcctgtttataagaaagttcctgtattagttcataacgaaaagcccgtttcagaatcacttataattcttgaatatattgatgagacttggaaacaaaatcctatcttgccttctgatccttacaagaaagcattggctcatttctggtccaagttcatagatgacaagtttttgagtgctataaaaaaagcaattttcactattgatgagaaagaacgtgagaatggtattgaggaaacagaagtg

SEQ ID NO: 2938 - DNA, 376 bp, Cicer arietinum
acagtaaacgagggcaaatatcatgccaccaaaagaccaagcaatcccttgaataccaacagatttgcattttgagtcagatctgttcacacccataaccgtcaagatggttatgtaaagaaacagaaaagtggccacaaactcagctatcccagctctgtagaaagaccatgatgtgagttcagatggttcaaacaatggtgcaggtggtggttccttgtagtcttttccatcgtcttggctctgagctgctataccaattggttgtctctctgggtatttgtttgctcccaatgagacatcttgttcctttgcctccatttctgatcactttgttgttgatgataatgaatgaaaaatgggttgtggttgtggt

SEQ ID NO: 2939 - DNA, 183 bp, Cicer arietinum
actgcaacggatgcatttgagaaaaaccgctcacaagacctaatcttcttagatttcactggataaggctcttcctgattaatgttccatagatatacattagagtcctcgccagccgataaaatatgtttcccgtccgaagtaaacgatgcacaccttgggcttcctgtgtaaagacttttg

SEQ ID NO: 2940 - DNA, 393 bp, Cicer arietinum
ctttccttaattttcacaattttcacaatatggatcaagaaaaagaacaaagtttcaaaaacccaagaaacataatcttcaacaaatacgaaatgggtaaagtattgggtcaaggaaactttgcaaaggtttatcattgtagaaacctttcaacaaatgagagtgtagcaatcaaggtgataaaaaaagagaagcttaaaaaagagaggctagtgaagcaaatcaagcgtgaagtttcggttatgcgtctagttcatcaccctcatgttgttgaactcaaagaagttatggcaacaaagagaaaaatctttcttgtaatggaatatgtaaaaggaggtgaactcttcaccaaagtagaaaaaggaaaattgaaagaagatgttgcaagaaagt

SEQ ID NO: 2941 - DNA, 350 bp, Cicer arietinum
cagaaacttgagtcttctatacacaagtctttcttttttagaccaatctctacttttcaaacacattaaaaaatgggttttcgtttacctagtatcatcagaagggctgcaaaccaagcatcttctaaaggcgtggatgtgccaaagggatatcttgcagtgtatgtgggagagaaaatgaagcggtttgtaatcccaatatcatatttgaatcaaacttcattccaggaattgttgaaccaagctgaggaacaattcggatatgagcatccaacgggtggtctcacaattccttgcagagaagacgttttcttagatattacttctcgtttgaatttttgctgatctct

SEQ ID NO: 2942 - DNA, 382 bp, Cicer arietinum
aaaaattttcccttggcacgcactgaaagtgcactgttaggagcgggattagctacgggctactcggccacacaatactgcggggacgccatcggctccctaacagcagttttcagagaaggaattttggagagttcaccttctccgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtgga

SEQ ID NO: 2943 - DNA, 437 bp, Cicer arietinum
taaaaaacaattgtttgagtaaagaattgaagtgctacaatggcatcaaataaagaagaggtgaagctttttggaatgatgttaagtccatttgttactagggtagagattggtctaaaattgaagggagttggatacaaatatgagttagaaaaaatggggaatttaagtgaagcactcatcaattacaatcctgtttataagaaagttcctgtattagttcataacgaaaagcccgtttcagaatcacttataattcttgaatatattgatgagacttggaaacaaaatcctatcttgccttctgatccttacaagaaagcattggctcatttctggtccaagttcatagatgacaagtttttgagtgctataaaaaaagcaattttcactattgatgagaaagaacgtgagaatggtattgaggaaacagaagt

SEQ ID NO: 2944 - DNA, 222 bp, Cicer arietinum
acccgacccggtgctgcttccgaagagatccaattgcgtattgatccaatggacttggatgatgaattaactggtcttcatcgccaagttagaaggttgagaaatgttgctgaggagattgggacagaaatgaagtatcagaaagattttctggaacagctgcaaacgacaatgataaaggctcaagctggagtgaagaataatttaagaagattgaacaag

SEQ ID NO: 2945 - DNA, 416 bp, Cicer arietinum
agcagaagagggacaagtaatcggtgttcatactgtggatgcttggaaagatcagatccagaagggaaatgagtccgggaaattgattgttgttgattttactgcttcttggtgcggcccatgccgtttcattgctccaattctagcagagattgctaaaaagctgccgaatgtcaccttccttaaggttgacgtggatgaattgaagactgttgctgaggagtggggtgttgaagctatgccaacattcttgttcttggaagaaggaaaactagtggacaaggttgtgggtgctcagaaggagaagctgcaatcgacaatagccaagcatgcttgaagggtcatataaataaaatattgtcatctatttcgagtcagtttgcatttttttctatttgagtcagtttgcctggttt

SEQ ID NO: 2946 - DNA, 355 bp, Cicer arietinum
actactctgcttccttttcccagcgctttatacacggatagttgttgtttggcgagaaaagagaactcttggaagaaattggtcactgaacaggaagtcattgctcaggagaccgttaagaatagaagatacggcgagaggaggttaccttcggatttaatggtgttggaatgtttgtttcatttcattcattcttctagtgaacattcaagttcctatacgctcactttctgttttgaagaatgtctcactcaaaagcaaaagcaatcttagcagctggttttccttaatggctcaaacagaagaaactaataaaaactgacattttgttgtcaataaaagaatcaccagaagt

SEQ ID NO: 2947 - DNA, 422 bp, Cicer arietinum
actgttgaaatcattacccctgttgaactcatcaagaagggagaggagggggggtcgtcagaagctgcattgcttgccaagctaggcataaggcccttttcatatggtcttgtggtgctttctgtttatgataatggttcggtatttacccccgaggttcttgatctcactgaggatgctctcattgagaagtttgctattggtgtctcaatggtgacttcactttcgttggccatctcatacccaacacttgctgctgctcctcacatgtttgttaatgcctacaagaatgttcttgctgtcgcagttgcaacagaatattctttccctgaagccgacaaggtcaaggagttccttaaggacccaagcaagtttgctgtagctgcagttgctaccccagctgctgattctggtgctgccct

SEQ ID NO: 2948 - DNA, 294 bp, Cicer arietinum
actgctgcgccgtttaataatgtctatgtgaaaaacctatcagaggctatggcggatgatgacttgaagaaaatatttggagagtatggaactattactagtgctgtagtaatgagagatgtagatggtaaatcgaaatgttttggttttgtcaattttgaaaatgcagatgctgctgctaaagccgtggaggcacttaatggaaagaaatttgatgacaaggagtggtatgttggaaaagccctaaagaaatatgaaagggaacttgaactgaaagaaagacatgaccagagt

SEQ ID NO: 2949 - DNA, 405 bp, Cicer arietinum
actatctcgattttgatgtggatggtgtaaacaactcttttgagaaaacaagtttaaaaaccgttagaataactgatggaagttcaaagagaaaaagttattggaccacggagacccaaactgctaaaaccgaatcagatgcaaaaattacaattgggctgagcccagctgagcttgttgttgtgaatccaaacaaaaaaactgtggttggaaacgaggtcggataccgtttgattccagcaattccagctcatccacttttaacggaagatgattacccacaaatacgtggcgcatttaccaattataatgtttgggtcacaccttataatagaactgagaaatgggctggtggactttatgttgatcatagtcgtggagatgatactttagctgtttggactc

SEQ ID NO: 2950 - DNA, 354 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgtcgcggcggcagggaaaaacctcgggaagggatcagaggccggcggtgcggcttgccttcaaaggagaaaaacccatcgcaatcggcgtcgttgatcggaaggatgtcgctaccgatgccacgggcaccgtcctccgatatctaagacctgcccggg

SEQ ID NO: 2951 - DNA, 183 bp, Cicer arietinum
acaaaattttctacacaggaagcccaaggtgtgcatcgtttacttcggacgggaaacatattttatcggctggcgaggactctaatgtatatctatggaacattaatcaggaagagccttatccagtgaaatctaagaagattaggtcttgtgagcggttttctcaaatacatccgttgcagt

SEQ ID NO: 2952 - DNA, 174 bp, Cicer arietinum
accaatctgttgaaaaacagcagacatcccacttttggctgagaagatgaagcctgagatgattcagaagctaagagagatgcaggcggaggaggaggggcagcaggtgcagcaggtgcattagtttttgatggagcaattatttttcccgtttgactccatacagggcctaaa

SEQ ID NO: 2953 - DNA, 205 bp, Cicer arietinum
gcggcacctcagaaccagaacgccttagatatcggaggacggtgcccgtggcatcggtagcgacatcgcttccgataacgacgccgattgcgatgggtttttctcctttgaaggcaagccgcaccgccggcctctgatcccttcccgaggtttttccctgccgccgcgacagtcgactacgagcatacaacttggttactggaga

SEQ ID NO: 2954 - DNA, 351 bp, Cicer arietinum
acaaatagctatcaaatgtcatcttctgcacatattcatcagcacacatctccacaaacgcttccctagcaggattcgaccgataaaacactttttgaagaatgtccaaaaccttgtaagtaggccaataagtcttgtcccatttctccaaatactttctcaaatccccttcttcaaccatcctcttcccgttctgcgaaccctgcacgattgcctctgcgcacatccgtccactcttggctgcaaaatagattccttcgccggaacatttggtcacatagccagcagcatcccccacgagtgcgacccttcccgacaatcttcgtggccttggatgttctggtatagggt

SEQ ID NO: 2955 - DNA, 429 bp, Cicer arietinum
acctcgggccgcagtcgatttgggccgagcgatcaggcctggtggcatagtcgaaagtgataagttgccttctgatgtcaggaaacgaactatggatgctgtggatgcttgtggtggtagggtgaccattggtgacgtggctagtaaggctggtcttaagttgaatcaagctcaaaaggcactccaagctcttgctgctgataccaatggtttcttagaggtttctgaggaaggagacgttttatatgtgtttcccaaagattatcgatcaaagctcggtgccaagtcatttaggattaaagctgaaccttttattgaaaaagctaagggcgccggagaatacttgataagagtttcttttgggacagcacttattgcatccattgttattgtttacactgcaataattgctcttgtaactagcagcag

SEQ ID NO: 2956 - DNA, 428 bp, Cicer arietinum
gcttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgccttgatagagttgaggttattgctgaaaacaaagataaatgggatatgcatcgttgctgttagctactagtatggtgattatcacagcttctttgagttgtcttgtaactttgttgttgtttatag

SEQ ID NO: 2957 - DNA, 136 bp, Cicer arietinum
acgctgagctacaagggcgctgcttacctcggatccctcatcttcttcgctacctctgctcccggctacattgctcagatcttcgtggagaagcgacctctcgacaccgtcggcgtcagcctggctaccaagctcg

SEQ ID NO: 2958 - DNA, 307 bp, Cicer arietinum
gcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgcctttgtgccttggtatgctggatggtgaaggaagcggggtatcctgt

SEQ ID NO: 2959 - DNA, 396 bp, Cicer arietinum
ggagaccgtggaacgaggcgactgcctcgtccacagagcagcgttctagccgccttgggtttttccctgcgaggggtttccccaaggatgtatggttctagggttgcagctactggcgatcttaggggatcatggacttcctgcctcagggtatggaaagctacttgatttatccgtgcaagagaattctaggctggtgaggaatagatcccgctgacgggatgacctcttgaaagtaaatgcgcctgtgtgccgatgatatgctggatgaactagatgggagacgctgctggagggaagctctgcgaggatcaactgtattgatgtccaatgggacgtgcttcaccgacaactactgtagggcgagctatgagtagagaggtgcctcttgggggt

SEQ ID NO: 2960 - DNA, 282 bp, Cicer arietinum
caatcctttgcttccttccttcattcatcccctcttcacaaacaaaaacctttctaacatttcaattccaatcattactattactatcaacaccaatggaaggatctggagtcgtaacagtctacggcaacggcgcaatcaccgaaacaaagaaatcccccttttccgtcaaagtgggcctcgtcacaaatgcttcgaggaggtgtcataatggacgtcgtcaacgcagaacaggcacgtatcgctgaagaagcaggagcatgtgctgtcatggccctcgaa

SEQ ID NO: 2961 - DNA, 176 bp, Cicer arietinum
cgagaagaaatggaagaagaagccgtagtggtcgcagaagcactcgagatactgtccaccgccgaatcatcgaatccaaatccaacagaaacaactcagcagcaattgttgagtgtggaacagagatatcagatcgtcaggagtatcggagaagagtgcattcaagaagatgaact

SEQ ID NO: 2962 - DNA, 423 bp, Cicer arietinum
tgcttcatcaagatgctttataaatcatctatgaagtcattgaaaatggtaatggctaatttgataacaatgtttttgctaatagaggtgattgcgtgcgggttcgggttcggattcggggcagatggtgggttaaacatgaactactacttgatgagttgtccttttgttgaacctgttgttaagaatgtagtcaatagagctttggacaatgatcccacccttgcagctgctcttattagaatgcacttccatgactgcttcatacagggatgtgatgggtcagttcttattgactccactaaggataatacagcagaaaaagattcaccagcaaatttgagcctaagaggatttggaatcatagatgatatcaaagaagagcttgaaagacaatgccctggtgtggtttcatgtgctgat

SEQ ID NO: 2963 - DNA, 404 bp, Cicer arietinum
actttcttgcaacatcttctttcaattttcctttttctactttggtgaagagttcacctccttttacatattccattacaagaaagatttttctctttgttgccataacttctttgagttcaacaacatgagggtgatgaactagacgcataaccgaaacttcacgcttgatttgcttcactagcctctctttttgaagcttctctttttttatcaccttgattgctacactctcatttgttgaaaggtttctacaatgataaacctttgcaaagtttccttgacccaatactttacccatttcgtatttgttgaagattgatgtttcttgggtttttgaaactttgttctttttcttgatccatattgggaaaattgtgaaaattaaggaaagacctgcccgg

SEQ ID NO: 2964 - DNA, 337 bp, Cicer arietinum
gactggtttccctttcccaaccacagcaagaggccaaccaatgaagcggagagggacagaaatgagccactgcttccaattaagcctggtagttgtagtgaacttcccaagaaattcaacgatgataacctgaagcacaacagtgaaggctattatccccataaagaggtagtttttcgtgactcctttaaaaatgttgaattcatctggcttttgtgcattaaattcattaaatatttgacagataacaaatgcattagggatcaaagtgttcttttctttggctgcgtgttcagtctgctcatgctccagacctagtatggagatacctcggaaa

SEQ ID NO: 2965 - DNA, 428 bp, Cicer arietinum
acagagcttacctggagaccgtggaacgaggcgactgcctcgtccacagagcagcgttctagccgccttgggtttttccctgcgaggggtttccccaaggatgtatggttctagggttgcagctactggcgatcttaggggatcatggacttcctgcctcagggtatggaaagctacttgatttatccgtgcaagagaattctaggctggtgaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctatgagtagagaggtgcctcttgggggtaatgagtacctcggccgcg

SEQ ID NO: 2966 - DNA, 429 bp, Cicer arietinum
acaaatctgaagatgaagagcataagaagaaggttgaggccaaaaatgcattggaaaactatgcatacaacatgaggaataccattaaggatgacaagattgcaggtaaacttgattcagctgacaagaagaaaatcgaggactccattgagcaggctatccaatagctagacagcaaccaacttgcagaggcagatgagtttgaggacaagatgaaggaacttgaaagtgtctgcaaccctatcattgccaagatgtacaaggaagttgagctcaagtgatgtgaaaagagacgcagaaagcaggttgcgcgatggggatttcaagggagcctatgttggcctactggtagttcagctttttgaagatggaaccggacgtgcggtcagtgatggggtagacaatgacatgttgggggttgttcctgaa

SEQ ID NO: 2967 - DNA, 430 bp, Cicer arietinum
acttcccccaggaaaagtccacttgctggaagtcctgataatcgtagccaggatggaaggtctcttacccctcgcagtgtctcaccgcaaggtcgccctaaagcttcccgaagcccatctccccgaaattcaaatggcgatgaataagtgatttttcagaagtattccagagacaccttgactagtgcacccgttgctgctgtcttgataatattccgtgatttggtcaatgtgaatgaatggtcttgtcaaagtcattgaaggattttattatctaagtgcagttggtagggtcagacttccttggtgtttgaatgtttctatattttgattatgtcgtctacttcagaattgggtaacttttggatctcgtagttgctaggttaatatttcagtatgagagatttttccattttaaacctgcccgggc

SEQ ID NO: 2968 - DNA, 421 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgtcgtggcggcagggaaaaacctcgggaagggatcagaggccggcggtgcggcttgccttcaaaggagaaaaacccatcgcaatcggcgtcgttgatcgggaggatgtcgctaccgatgccataggcatcgtcctccgatatctaaggcgttctggttctgaggtgccgccattagatccgacaaagttgttgtcagagaaggcgaactctccaaaattccttct

SEQ ID NO: 2969 - DNA, 438 bp, Cicer arietinum
actgtgatttcgtcacaacaacaacccacaagagcttaaggggccccagggctggtatgatcttctaccggaagggacctaagccacccaagaagggtcagcccgagaatgcagtttatgattttgaagacaaaatcaactttgctgttttcccctcccttcagggtggtcctcacaaccaccagattggtgcccttgctgttgctttgaaacaggccacgacgcccggattcaaggcatatgccaagcaagttaaggccaatgcagttgcacttggaaattacttgatcagcaagggatacagccttgtcactggaggaactgaaaatcatcttgtcttgtgggatcttcgccctcttggcttgaccggcaataaggtggaaaaactttgtgatctatgtaacatcactgtgaacaagaatgctgtttttggtgata

SEQ ID NO: 2970 - DNA, 323 bp, Cicer arietinum
accttgtctttgctgacctaactgttggacagtttgtctatgttatccgcaaaaggattaaattaagtgcagaaaaggctatctttatatttgtggacaatgtccttcctcctacaggagcaatcatgtctgccatttatgacgacaagaaggatgaagatgggtttatgtatgttacatacagcggcgagaacaccttcgggaatctgacttcccatactcagtaggcatcacaaatgtatactgtatgatctgctctcattggtttgtctgttaaattctctgtagaactcataacaagaacataactcttaatgttatgt

SEQ ID NO: 2971 - DNA, 389 bp, Cicer arietinum
cgctggcgctgcactcgctcacactctcggcaaggatggacgccgagtgcttgtcattgaaagagatctgagtgagcctgatagaattgttggagagttgctacaacctggcggctatctcaaattagttgaactgggccttgaagattgtgtgaacaatattgatgcgcagcaagtgtttggttatgcacttttcaaagatgggaaacatacccgtctctcttatcccttggataagtttcactcagatgtatctggcagaagctttcacaatggccgttttattcagagaatgcgagagaaggctgcttcccttcccaatgtaaatttggagcaaggaacagtcacttccctacatgaagagaaggggacaatcaaaggtgtccctg

SEQ ID NO: 2972 - DNA, 312 bp, Cicer arietinum
acaatatcaatgtaacttagagacaagaggcaaaaaccaaattcattactaatcacacataatgactggaggatagtagtccctttatttgacataccaaatttattagccttcgtagtattatattaggttctttagggacaattggtggtcaacaattacaagcacacttgtattgttgagtgcattcagcaaagcccttgcctgagtctgcatcagggccttcagtcctgaaaattgaacaactccacccttctccacatttgcagaatgtttcgctgtcattgtcactactactctcaatttcagggg

SEQ ID NO: 2973 - DNA, 186 bp, Cicer arietinum
accaataagtataagatattaaaattaaaaataaagatacggataaatttttttgtaagaccatcaaagagtaagatctgctaagtcaaaagatctaccaacagctttgctccaagagtctggtttctttttcctcacatccgcggccattaccggactgaaaacgccagcgtccttcagtttttc

SEQ ID NO: 2974 - DNA, 367 bp, Cicer arietinum
cgaggtacaatggataagagcgacactccttaatcttgtttggaattccacattgtccattctcataagcaattcttgcactttcaacttctttaggcaaaagggtcttcaactcatcctcaaaagttgcaatcttttgaaatattgatgtgttcaaattcttctcaccatcaacattcaccaatgcatgatctacaagcacttgtctcaacttttgcatcaaagggtatgtagagagacaaggatcatcaacatatgcaaaaacatactccctatcaacaactttgagcaaatctttctcacaaaatctggatggatgtagttcaccattcacgccagtcgttagcgtcctcttcgcaacttgact

SEQ ID NO: 2975 - DNA, 383 bp, Cicer arietinum
accttcccagtagctgtcttaggtaacggtccaaagacaaccgacttcgggacccaataagcaggcattttggccctgcagaacttcagtatatcctcaactagaagctgctcgttactgctatccactcccggcttcaatgtcacaaatgcacacggagactcaccccatttctcatctggcctcgcaaccaccgatgcttcgagtattgcaggatgcgagtatagagtattctctatctctacactgctgatattttcagcacctgagatgatgatgtcctttgatctgtctttaatttctatgtatccatctggatgctttacagcaagatcgccagaatgaaaccatccattagcaaaggactcttcattagctttagg

SEQ ID NO: 2976 - DNA, 266 bp, Cicer arietinum
accaaactcagagaacagttcactgagtttttcatcactaacactgtcgtccaagtttttgacatacaagtttgcaccataatatttgtccacagtttccttcatactctggtcatgtctttctttcagttcaagttccctttcatatttctttagggcttttccaacataccactccttgtcatcaaatttctttccattaagtgcctccacggctttagcagcagcatctgcattttcgaaattgacaaaaccaaaacatttcg

SEQ ID NO: 2977 - DNA, 424 bp, Cicer arietinum
acgctagattttaccatgctcactgacctacagaatttgtgtccccaaaatggagatggaaatgcaactgctgttcttgataggaactcaactgatttatttgacaatcactactttaagaacttgctcaatggaaagggccttcttagttctgaccagattttgttttcttctgatgaggccaattcaactactaagcctttagttcaaagctatatcaacaatggttcacttttctttggagactttgtcaagtctatgatcaggatggggaatataaatccaaaagtggggtctgatggagagattaggaagagttgcagagttataaattcatagtgatgtgcattaggctttgcaaaatactagtatatgaaataagtggaagattaacaatgtgtcttccttgtgatagtgtacctgc

SEQ ID NO: 2978 - DNA, 257 bp, Cicer arietinum
tgacgtcgcatgctcttcgccgccatggggaccgcgggaattcgattagcgtggtcgcggccgaggtggaaagttgtagagacggatgtgcttagcttgattgagaaattgatgaatcaattgattaaattggatggtataatggttgatggggatgttaaattacagaggaaaatgcaggtaaaaagagttcaaaagtatgttgaaactttggatttgttgaaaattaagaattgtaatgggagtcatgccccaat

SEQ ID NO: 2979 - DNA, 288 bp, Cicer arietinum
acctatcctgacttctactttaaaatcactaacagtgaacacaaagttgaactcaaagagaaattccaacgcatgtgtgataaatctatgatcaaaagtagatacatgtatctaacggaggagattttgaaagagaatcctagtgtttgtgaatacatggcaccttcattggatgctaggcaaggcatggtggttgttgaggttccaagattagggaaagaggctgcaggtaaagctatcaaagaatggggtcaaccagaggcaaagattactcatttgatcttttgt

SEQ ID NO: 2980 - DNA, 272 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgtcgtggcggcagggaaaaaccttgggaaggaatcagaggccggcggtgcggcttgccttcaaaggggaaaaaacc

SEQ ID NO: 2981 - DNA, 206 bp, Cicer arietinum
  misc_feature (163)..(163): n is a, c, g, or t
ccccggcctctgatcccttccgaggtttttccctgccgccgcgacagtcgactacgagactacaacttggttactggagattgtggactgcgtcagcagatgtagcgatgcgtgagagaattctggtcggtggaaaaattcgacaacattgcctccgaacccncatgacgaggtgacggggcttgacaaaaacagcgcctttttgt

SEQ ID NO: 2982 - DNA, 381 bp, Cicer arietinum
  misc_feature (74)..(74): n is a, c, g, or t
attcggagggcgccgggaggacttaaaaagatactctaattgactcttctcatccacctgcaggaaaaaactgnaacccggaatgaaatagcagggtatctaaagatcatcctgaacacagtggtatatctgcttcggattttgatttttcatccccaagataatgcaggataccatcccagaatatattgagcagaaggattctgctaacaagaaagctaagataattaagggatgatgtttgagaaatatcatcccaaggttttgtgcagtttctgggtcggtttgtttgtaatatattaactctaggagattgtgttagggaacaccaagtccagttgcattgaaacaaaagtttgttcttgcgagttttttggagtt

SEQ ID NO: 2983 - DNA, 165 bp, Cicer arietinum
ctccacagccctctgccaagggggtcggggttgctcatatccagggagagaacttctaccagaccgttgccaagttcactggttgactgcatggtagcagccaagccaaggctgcgcctgaggtggcatcaaacaccaatactcctgccgaggctgaaaaggata

SEQ ID NO: 2984 - DNA, 419 bp, Cicer arietinum
acaaggagcgaatgaccaagccaggcctacaatgccatttcatgctaagaaacttcccaacaccgatccatgcaatgccaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacgagtggggaagttgaagctgcgagagaactcgccgaaggtgcgctcggtgagccagtacctcggccgcgaccacgctcgagcggccgcccgggcaggtactcttcaagcttgacgcgagcagcatcgatagcata

SEQ ID NO: 2985 - DNA, 415 bp, Cicer arietinum
acacactcaagtgtttctattacaagagtgatcatacattaaaaaaaacatttaaaagcaccaaataaaagccagcatataggcaaccacaacacacaagtaaaaacaaactatgcctcaatttaattaaaactgattaattaatctcatcccctcttcaaccaaatcttccaaaacagatttcttactatttaccacattacatttagcacgaatttcaccttgatttccagtcaaaacatccaactgactaacctttaaaaaagcatcaacaaacttctcaaagaacaaattctgattaacagcaaagtcattaaccaacccttttgtcctcttatcattaatcaaatcttgatcagatgtaaacaaaccttgtttattcatcaaatcaagataatatttgttatcaaacact

SEQ ID NO: 2986 - DNA, 145 bp, Cicer arietinum
acaaaagatcaaatgagtaatctttgactttggttgaccccattctttgatagctttaactgcagcctctttccctaatcttggaacctcaacaaccaccatgccttgcctagcatccaatgaaggtgccatgtattcacaaaca

SEQ ID NO: 2987 - DNA, 421 bp, Cicer arietinum
actgctccaagaaatactaatccccatggtcacgtcaaaaaatggaacatggacccaccaagacagaaatcatctgaccgtataagtatagttacaatcatcccaaaatgaaataagaacaaccaccaaaagaaagatatcaagtccctatacaacaaaactaatctgatcatactctagcaactacaataacatgggtgacctccacacactccacaagttccgtctgacgcaacatccatcttcgaggtaacctcatcctcatcaacatccatagatggatcgctctctttagaagtcagatccacccacgagatagggggcttcggcggcgccgggacctcaaaacagtctgctactttagtgacaatcggtaaaggatcattcacttgaagaggaggctctgactcggcccgcctag

SEQ ID NO: 2988 - DNA, 226 bp, Cicer arietinum
gattcagatccaaaccatagattagatctaaaatggcaacaaccacctttgcaaccgtcgtaggaatgggtggcgcatcacgtctcgcctcagggtttgtgaaaccacaagtgatggccaggaatcgcttgaggcaagctatggcacggggaaatggtgggagggttacatgcttccagagggattggctgcggagggatttctttgtgattgggtttgggttaat

SEQ ID NO: 2989 - DNA, 269 bp, Cicer arietinum
accttctctgacttaagtggtttcacaacctcccatgtgaaatcagcatcatctctaccaaaatgtccataagcagcagtcttcaaaaaccttttatttccacctcttaaaagatcaaggttaatagagatcattccaggcctaaaatcaaaattctccttcacaatctgaagaatttctcttatcaggtatctttccagttccataagaatcaacaaagacagacaaaggctctggaacaccaatagcataagaaacttgcacaagac

SEQ ID NO: 2990 - DNA, 162 bp, Cicer arietinum
accacacaaatccgtccttttccaagccttttagcaatacaatccgtgacgagggttttccatccttccctacagttgacaagcccatagcatttggttccttcaaacccgcagccaatgcatcatcaaaccatttacgaaactgattattggggtctgcct

SEQ ID NO: 2991 - DNA, 163 bp, Cicer arietinum
acacctttgattgtccccttctcttcatgtagggaagtgactgttccttgctccaaatttacattgggaagggaagcagccttctctcgcattctctgaataaaacggccattgtgaaagcttctgccagatacatctgagtgaaacttatccaagggataag

SEQ ID NO: 2992 - DNA, 429 bp, Cicer arietinum
aaattctttcttgccacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgtccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaa

SEQ ID NO: 2993 - DNA, 204 bp, Cicer arietinum
accaactagaaatatttgcatcaacaactttgattttattgacaatccttgatgaacatactagtctatgatctcttctagatgatctgtattccagtatcaagtcatgtgatacaggaaatcatgagttttgaagctgggatctgtagatgtcatgaccggaagtagccggagttaccggagacaacctgacagagaacgagt

SEQ ID NO: 2994 - DNA, 391 bp, Cicer arietinum
acttgccaactgtctcaattttcttcaaatctcctcccattttattattaagcttagcaaaccaatcagcaatccatattttgactcggcaaccagcagaggttagcttgttcacattgagtgttttcatgacaccctgagcaatgtgcattcttccagaaggttcgaaaccatcataacaaacaggctcaggctttttagcgaggagattaagaagttcatcttcttgaatgcactcttctccgatactcctgacgatctgatatctctgttccacactcaacaattgctgctgagttgtttctgttggatttggattcgatgattcggcggtggacagtgattcgagtgcttctgcgaccactacggcttcttcttccatttcttctcg

SEQ ID NO: 2995 - DNA, 429 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgcgcaagagaattctaggctggagaggaatagttcccgctgacgggatgacctcttgaaagtaaatgcgcctttgtgccgatgatatgctggatgaactagatgggagacgctgctggagggaagctctgctaagaccagctgtattgatgtccaatgggacgtgcttcaccgacaactactgtagggcgagctacgagtagagaggtgcctcttgggggtaatgagtacctcggccgcg

SEQ ID NO: 2996 - DNA, 384 bp, Cicer arietinum
acacctttgattgtccccttctcttcatgtagggaagtgactgttccttgctccaaatttacattgggaagggaagcagccttctctcgcattctctgaataaaacggccattgtgaaagcttctgccagatacatctgagtgaaacttatccaagggataagagagacgagtatgtttcccatctttgaaaagtgcataaccaaacacttgctgcgcatcaatattgttcacacaatcttcaaggcccagttcaactaatttgagatagccgccaggttgtagcaactctccaacaattctatcaggctcactcagatctctttcaatgacaagcactcggcgtccatccttgccgagagtgtgagcgagtgcagcgccagcg

SEQ ID NO: 2997 - DNA, 421 bp, Cicer arietinum
ctcaaggatgggtctatcagaaccgctgtcgacactggttgtggggttgcaagttggggaggttatcttttgtcacgtaacatattaacagtgtcatttgcaccaagagatacacatgaagctcaggttcaatttgctcttgaacgaggtgttcctgcattgattggaattattgcatcaataaggctaccttacccctcaagagcctttgatatggctcattgctcaaggtgcctcattccatgggccaactatgatggactatacttgactgaagttgatagagtgctacgtcctggtggatattggattctatcagggccaccaataaattgggagacacattggaaagggtgggagaggactcgtgagagtctgaatgaagaacaggattcaattgagagtgtgacgaaaagtcttt

SEQ ID NO: 2998 - DNA, 210 bp, Cicer arietinum
ggcgcatttcgttccgtccggcgaagaaaaccaaagcaccaagctatgggacactctaacgtttggaactctcaccccaagacctacagtcctggttctcgtacttgccgtgtttgtgggaatccacatggattgatcaggaagtatggtcttatgtgttgcagacaatgcttccgtagcaatgccaaggaaattggcttcgtcaagtac

SEQ ID NO: 2999 - DNA, 329 bp, Cicer arietinum
cgtggtcgcggccgaggttagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccggacgactactgtatggcgagctacgagtagagaggtgcctcttgggggtaatgagtacctg

SEQ ID NO: 3000 - DNA, 182 bp, Cicer arietinum
acggctctcatgaaattgaccccgacttgcagaaagtgtttgccgagatcgagaagggcacttttggctcggtccatgactttagcgccctggtcactgttgtccgtgatcacggtgactactacttggtgtctgacgacttccacagctacaacgagactcataagctggtggatgaggcg

SEQ ID NO: 3001 - DNA, 297 bp, Cicer arietinum
actataatttaatataagaaacaacatcccaatcccataatcaatgaagaagaagaggtttaaaggaagtgaggttcttgaaatggatccaagatttctccaacacttgggcagtataattctttgtaacggattcattcttaacagtcaacaatagacggtagtttgttccagacacttcttgagtctcacctttgatcactttcaccagcttcaaattcttaccagattgtttatcgtattctgttaccgcgaattccgcgatctccgccacgtgtgggtctgtgatgttcttga

SEQ ID NO: 3002 - DNA, 226 bp, Cicer arietinum
acgtttccaatcaaagcattgaatcaataatgccaaagtcatgctaattgttcgaagagccaaagcttctccaggacacactcttcttcccatcccaaatgcaatcaccttttcaatctccccttttttgtcaaacctctccggcttgaaggttgtggcctcactccatgacttaggatccctgtgaatggcccatgcattgatcaatactatggtgtctcttggt

SEQ ID NO: 3003 - DNA, 378 bp, Cicer arietinum
acagctccccattacgtgctctatttgtttgagcagtaatccaccgaaactcaccattcaaattatactccttcatgagatcgtgcatcttctcaatctctgcaatttcttctctgtcactggacttcttcacatcaatataaccagctacaacgacaaggttgaccagttccctcaatttgctgttcttagcatagctttctaccaaaccagttatgtttttaacactgtagagccttgccatggagaaaattataggctttgaccggtccttcagtgaaccaatgcactcgtcagtctgctcggtatcatataatagcttttcaattgaaccatgcagggacgtgagtcttttctccttttcagagtaggggaaat

SEQ ID NO: 3004 - DNA, 404 bp, Cicer arietinum
actcattacccccaagaggcacctctctactcgtagctcgccctacagtagttgtcggtgaagcacgtcccattggacatcaatacagctgattttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatggccagtagctgcaaccctagaaccgtgcatccttggggaaaacccttgcaggagaaaaccccaaagcggccagaacgctgctctgtggacgaggtagtcgcctcattccacggtctcc

SEQ ID NO: 3005 - DNA, 102 bp, Cicer arietinum
caaggatgcacggtcctaggttgcagctactggcgatcttaggggatcgtggacttcctgcctcagggtatggaaagctacttgatctatctgtgcaagaga

SEQ ID NO: 3006 - DNA, 296 bp, Cicer arietinum
ctcagaacccgaacgccttagatatcggaggacgatgcctatggcatcggtagcgacatcctcccgatcaacgacgccgattgcgatgggtttttctcctttgaaggcaagccgcaccgccggcctctgatcccttcccgagggttttccctgccgccgcgacagtcgactacgagctacaacttggttactggagattgtggactgcgtcagcagatgtagcgatgcgtgagagaattctggtcggtggaaaaattcggcaaattgcctcctaacccgctgacgggtgacgggct

SEQ ID NO: 3007 - DNA, 394 bp, Cicer arietinum
acaacaagatcatgtagagcttttcggatgctaactaaaacacaccatagcacaacttcattctacatttttacatacaatatcataatggacataataccattcactcaatattgattctaacaactttctttgttcttccctcagaattgttccctgtttcatactttgatgcaaatccacttccttttctatcctgatccaaagatggaagtgaccgaacctggtttttgtttagctcaccaactctagaatcatttttcctatgcacatcataatcaggtaacttccctagattatttcctttccatgcttcctcaaaccgtgcaagctcatcttcattaagattgtgcagtgtctgtgttgtatcaaccttcccatctgagtcaagctt

SEQ ID NO: 3008 - DNA, 136 bp, Cicer arietinum
acttgggaagatgggagcacctccaaagagtgatgttccaattattacaccaaatgagctcactgaagctgatggtttgttgtttggttttccaacgagatttggagtgatggctgcacaattcgaatcatttttg

SEQ ID NO: 3009 - DNA, 425 bp, Cicer arietinum
actgttgatgatactcttctgccctgtagaactttttggcaggaaggatctcagtaacaatcttcctgtttaacttcttttgttgttgttctaacgattctcgggccgctttctcttgttcaggggtataatagtatattcctgaccggtattgtgttcccacatcattcccctgtctgttcagtgtggttggatcatgtctaacccagaacgcatcaagcaatgtctcatagctacattctttaggatcatactggaccctgacaacctctgagtgtcctgtggtccctgaacagatactctcgtagctcggattatgcaaaagtccctggctataacctacctcggtcttggtcaccccagctaccctctggaaggccagctcaacactccaaaagcagccagcgccaaactgggcaaaccgt

SEQ ID NO: 3010 - DNA, 426 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaatcgtgcatccttggggaaaacccttgcaggagaaaaccccaaagcggccagaacgctgctctgtggacgaggtagtcgcctcattccacggtctccaggtaagctctgtacctgcccg

SEQ ID NO: 3011 - DNA, 417 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctccaggtaagctctgt

SEQ ID NO: 3012 - DNA, 268 bp, Cicer arietinum
ctactattgggggtagaaatggtcagccaaagcagactataagctatatggcagagcgtgttgtaggacatggatcatttggagttgtcttccaggctaagtgcttggaaacgggtgaaactgtggctatcaaaaaggttcttcaagacaagaggtataagaaccgggaactgcaaacaatgcgccttcttgatcacccaaatgttgttgctttaaagcattgtttcttttcaaccactgaaaaggatgaactctaccttaatttggt

SEQ ID NO: 3013 - DNA, 230 bp, Cicer arietinum
acaaggagcgaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaa

SEQ ID NO: 3014 - DNA, 226 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgtcgcggcggcagggaaaaacctcgggaag

SEQ ID NO: 3015 - DNA, 426 bp, Cicer arietinum
acaattaatacatttcactttaatacgctaattgcagaaatattatgacacaaacaaaaacaatacacatagaaaatagaaaatagataaggaattgaactcaaatggttaatattctagttaaagacaaattattaagaagaatttgagttcaaattctagccgaaataattttgatcgaaactttacttacatctagattattaaggccctattgccatgagaaatggagggtttaaaacaaaacaaaacacacacacacaaaatagatcaatgaaacaagcttagcagttatctggaggagtgagattacatttagcaggaagtgaagaagcaagaattgggtcaattccaaataaaggtaactctgatgagttcttataagaacaaagacatctcaagtcagctccattaagtgccttgcag

SEQ ID NO: 3016 - DNA, 164 bp, Cicer arietinum
acagagcttacctggagaccgtggaacggggcaattgcctcgtctacagagcagcgttctggccgccttgggtttttcccctgcaaggggtttccccaaggatgcatagtcctaggttgcagctactggcgatcttagaggatcatggacttcctgcctcaggg

SEQ ID NO: 3017 - DNA, 424 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgggaggtgtaggataagtgggagctggagacagcgaaagtgaaataccactacttttaacgttattttacttattccgtgaatcggaggcg

SEQ ID NO: 3018 - DNA, 394 bp, Cicer arietinum
actccattccagatgtattggaacaaaattcaaaaaagtaatttaaccatataagttaaaaaaattcttaaagttgatgaaaatatctggtgcttgaaccatattcactcaaggttactcggatttgctgattcataagcagcatctgcagaagaggtgtccatttgatgtagacctaattcttcatcttgctcccatgtcctctcatattcctcgtatattaattgtttgtcgtctttaagatcatcagttgcaggtgctataaaagaatttccttctggatcatcaagaattaaagtccaaggtttttccaaggtaagaagcttgttcagcctgtccccaaagtcaagccacttgcttcttctatcctcctcaagactatctccgaaacctg

SEQ ID NO: 3019 - DNA, 391 bp, Cicer arietinum
gtccatgtttccctccaagatcttgaggatgaaaacgagacaaaacggttggaagaaatggaaggagcaaagagtcgtctaaaatttttcgaaatggatcttcttaacagcgactctatcgctgccgccgtgaaaggttgtgctggcgttgtgcacctcgcatgtcctaacatcatcggtgaagtcaaagaccccgagaagcaaattttggaatcggcgattcaaggaacggttaacatgctaaaagtggcaaaggaagcgggtgtggagcgtgtagttgccacgtcatcgatttcagctatcattccgagtcctaattggccagctgataagattaagggagaggattgttggaccgatcttgactattgcaaggaaaaggggttatact

SEQ ID NO: 3020 - DNA, 205 bp, Cicer arietinum
actatttacctgagcatgagcgtgcaaaaaaacagttctttgagtatttgcaaggtgaagcagaatctggtctagagagacttcatcaatgtgctgaaaaagaactacaacagtttctcagtgctgatggcccatctaaagaattcaatgacttccgtacaaagttagctggattgactagtgtgacaaaaaattacttcgagaa

SEQ ID NO: 3021 - DNA, 240 bp, Cicer arietinum; identical to SEQ ID NO: 320

SEQ ID NO: 3022 - DNA, 412 bp, Cicer arietinum
caactctacttcatcatccactaccttgcctcttatccagatccatcactcgatctccatcagtcatccaagatgcccgccgccatggaacccactcagcaagcccccatgacctctgacaacggagacatcgtcacacagcagcctagcgctgaacctcagcctgatatgaccatgcttggtggtgaggaggctggctgtgagatctgctgtggtctctgcgcctgcgatgagggatgctgctaagcagacagcctcacgtagagtgttctgagtagaatagactgctcgggatggagtttgggtagcattgttatcgtgatttagcaactcctgtctggatggttgatccagtggagcaataaactacattcatacgagaaagaagagagacagaaagaagagtaagctt

SEQ ID NO: 3023 - DNA, 424 bp, Cicer arietinum
ttacaaaaacgagaaccacagtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacgtgattagcgagaaccaccatcaccaccaccatatccacgatctctgcgaccaccacaaccacaaccacaacccatttttcattcattatcatcaacaacaaagtggtcagaaatggaggcaaaggaacaagatgtctcattgggagcaaacaaatacccagagagacaaccaattggtatagcagctcagagccaagacgatggaaaagactacaaggaaccaccacctgcaccattgtttgaaccat

SEQ ID NO: 3024 - DNA, 264 bp, Cicer arietinum
ggcattagcagctgtatcagcaatggcacccaaacagagaaccgctagggtaagcagaaaccccgatttgatcaggggaatcggaaaatactcaaaatctgccatgtaccacaagagaggtctctgggccatcaaggccaaacacggcggcgctttccctaaacatgatcccaaacctaagcctgaagctcccgctgagaaggctcctaaattctaccccgccgatgatgtcaagaagccacttcgcaacaagcacaaacctaa

SEQ ID NO: 3025 - DNA, 390 bp, Cicer arietinum
acactcaagtttatcgaaagaattctggtttctacctaatatgtatatgtaaaaataagagaggaggattacaaagaatatactcattagtttatcaaagccccaaaacagataaaattaaaaaacaaacataacaaatcaatacagaaagaggaaaatagttagttaacttcagtggttctatccttgcagagcatatgccactcttgtagcactgctgcttgaagagcttgatgctcagcctcctcagcagttaatttggatagtgttgtaggtcccttctttttctcatcttcttccccatccttccttttgtctttaccttcttcctcgtcggattcggattttggggttttgggccgtggttgggctgccttcaacaaggctatc

SEQ ID NO: 3026 - DNA, 432 bp, Cicer arietinum
acaacattttcagcgatttcgttgactatgctacgcaaccaaccaatgcgaagttgagcagactctacatcattaagaatagccaacaattccttgactttggacttggctaagtgcattaccgaggttgattgtaactcttggatcacaaagcacacacactcgatgtaatacgaccgcatcacaacggattccaaatggcagctttctcctatatcaccatacttgttgaagatggatagcaggatgggagcaaagctttccttcacatggtattttccaactggaacacgcgtctcggaaaccacagactcactctcctcttcatcactgtcctcattatcacggagaaaatcagaaaaacagtagtgcttggacccaccagctgatgtagttaaaccttctccaatgtcatcaacagaggtgattgga

SEQ ID NO: 3027 - DNA, 346 bp, Cicer arietinum
ggccgccagggcaggtacctaaataaaaagcctcttcgcaaattagacagtgtgattccatatccaaatgacacccattgatttaaatagatggtaatgattcaacggctgtttttgaagctggtggatgttcatatcttccaataccgttgatttcaatctgaaaaatttgttctaacagtctatcaaaatcagaaaccaaaagaaactctgacatacttggtggtaaaggtctaagaccagaaccagcaccatcatcatagaaaagctcaaaaccacgactctctcctgtgctaccaccttctgttacctccgttgatccacttccgcgtaggacgatcaccgg

SEQ ID NO: 3028 - DNA, 151 bp, Cicer arietinum
gggcaggtacttctttaggtcgtccattttgcaaaacctccaatcttccgacggacgaagaaacattgacaatttttggtgagcttgaacactgaagaaacggaataagagcttcggtgaattctttggtgccaaaataatttgttctaag

SEQ ID NO: 3029 - DNA, 417 bp, Cicer arietinum
actcattacccccaagaggcacctctctactcgtagctcgccctacagtagttgtcggtgaagcacgtcccattggacatcaatacagctggtcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctccaggtaagctctgt

SEQ ID NO: 3030 - DNA, 314 bp, Cicer arietinum
ctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcggacgtccttccgatcaacgacgccgattgcgatgggtttttctcctttgaaggcgagccgcaccgccggcctctgatcccttccggag

SEQ ID NO: 3031 - DNA, 435 bp, Cicer arietinum
acacaagaagactccggtgctagttcatgatggaaaacccatatgtgagtcaatgatcattgttgaatacattgatgagatatggccacaaaactcattgcttccagctgatccttatgatagagctcaagcccgattttgggttaaatatatcgatgaaatgatttcgacactttcagcaatcattcgtagcaaaagtagtgaagaccgagagaaggccaaagagaatctatgggaacggctaggagttgttgaggatcaatgtttgaaagacgaaaataaattttatggaggagacaacattaacattgtagacatagctctcggatcttttgtcaaatttattgaggttttggaaaatacatttgaagtggaaattttgcaaactgagaggttcccccatttgcatttatggtttaataatttcaaggatgt

SEQ ID NO: 3032 - DNA, 418 bp, Cicer arietinum
acttcccccaggaaaagtccacttgctggaagtcctgataatcgtagccaggatggaaggtctcttacccctcgcagtgtctcaccgcaaggtcgccctaaagcttcccgaagcccatctccccgaaattcaaatggcgatgaataagtgatttttcagaagtattccagagacaccttgactagtgcacccgttgctgctgtcttgataatattccgtgatttggtcaatgtgaatgaatggtcttgtcaaagtcattgaaggattttattatctaagtgcagttggtagggtcagacttccttggtgtttgaatgtttctatattttgattatgtcgtctacttcagaattgggtaacttttggatctcgtagttgctaggttaatatttcagtatgagagatttttccattttaa

SEQ ID NO: 3033 - DNA, 344 bp, Cicer arietinum
cgggcaggtacaaaaatcagactagatcacactaaaagttctcctaatcaaacaagctgaatcccatgtcgtcgtcactctcttccttgggttcttccttcttctcttctgcaggtgcagcaactgcagttgcggcagcagcagcaactggggctgaaacagaaaccggagccccacctcctgtggttttcaatatcaaatcctcaaggtttttcttctcggcaagtttagcaaacaagcttggccaataagattcaacatcaacctttgcagctttcaacaaagtggaaattttgtcaccagtgacagggatttgttcatcatgaaggatcataagcgagtag

SEQ ID NO: 3034 - DNA, 112 bp, Cicer arietinum
acttcttctgctcatacttgtttacatttaaaatgctaataacaagcaataaaagccttataagccaaggcaagtagagttgcaatagttcatttgaagtttgactaaggaa

SEQ ID NO: 3035 - DNA, 390 bp, Cicer arietinum
actatgatgttatcctccattatttgctgctgtagcggcataagaagaggggggaccattttcagatatgcgagaaagacattcttgcccttgtcctccatctccccttgtgattgtgaaccccgcattatgattgtgagcggcgagatggttgaggaaacctgcgggggagcttttctgacggagcaacgccgatccatcaaaggcgtcgtatgaagaagaagatgacctctgctgagtggagtcaccggagaaatagtgtcccgttcccggggggaaaaggcgcgatcctcctgatgctatgacggcatcgaccgtggtggtgagaagagagccaggtgcagaaccgtatctggtgagggcattgaggcaatgtagaagaaggtcggg

SEQ ID NO: 3036 - DNA, 196 bp, Cicer arietinum
taacggaaaattttgttgttcggcattgccaagaaagagttcctaaattattaaatttagcaattatagagaaaggataataaaattgtgattaagctgaggcatgtgattcatttgcaatcttctctgccttagcaatgacctcgtcaataccaccaaccatgtaaaatgcctgctctgaaaggtcatcatattt

SEQ ID NO: 3037 - DNA, 428 bp, Cicer arietinum
acaacagacaaaaaaaagatactctcccatcttcgcaaatgatgtagttcaaaattggcgaaaaatataatgaaattgtaatgtaaagagtatttgactatatcagttcttgaatctgacgctacgactgatatttgcattaattccagtggattccccaccatagggtgcagttggttttctgatgctttgaacctgtcccttgcgattcttaacagctttttgatgcttgagcttgtaattctttctgggattctttttcgccttgttgcgacttcgagttagtcctctgttcttcgatatctgaggagtgataagacgctttccgtccacagtctcctctgtgccagaggggacagctgatttactcgaagaggtcgagtaggtcccagcttttgcagcaagttttgctgctcgcaatttttccg

SEQ ID NO: 3038 - DNA, 162 bp, Cicer arietinum
actccttcggcaataatagcaacaactctaattgtaggctgcttcaaagcagccatggatgatgcagcagcactcctaaatgatgcaaaattgatgaacacatcagcagtaggatgtgcagcacaagcggcttcaatggtagcatgaactgggatggcaatt

SEQ ID NO: 3039 - DNA, 128 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggt

SEQ ID NO: 3040 - DNA, 139 bp, Cicer arietinum
aaaaattctttcttggcacccactgttagtgcggtgctaggagcgggattttctacgggctatgcgactacacaaaactgcggggatgctatcggctccctaacagcagctttcggagaaggaattttggagagttcgc

SEQ ID NO: 3041 - DNA, 223 bp, Cicer arietinum
cccgaggtttttccctgccgccgcgacagtcgactacgggctacaactgggttaggggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 3042 - DNA, 200 bp, Cicer arietinum
actgctccaagaaatactaatccccatggtcacgtcaaaaaatggaacatggacccaccaagacagaaatcatctgaccgtataagtatagttacaatcatcccaaaatgaaataagaacaaccaccaaaagaaagatatcaagtccctatacaacaaaactaatctgatcatactctttttactacaataacatgggtg

SEQ ID NO: 3043 - DNA, 238 bp, Cicer arietinum
attctattcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggatgtttttgcccgtggcatcggtagcgacatcctt

SEQ ID NO: 3044 - DNA, 216 bp, Cicer arietinum; identical to SEQ ID NO: 2214

SEQ ID NO: 3045 - DNA, 104 bp, Cicer arietinum
actggctcaccgagcgcaccttcggcgagttctctcgcagcttcaacttccccactcgtgtcgaccaggacaacgtctctgccaagtttaaggacggtatcctg

SEQ ID NO: 3046 - DNA, 407 bp, Cicer arietinum
gtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacgtgagtagcgagaaccaccatcaccaccaccatatccacgatctctgctaccaccataaccaccaccacctcctccgccatatccacctccaccaccatatcctccaccgccacctctgttatatccaccttcacgacgtccaccaccatatccaccgcctccaccatatccaccgccaccacggccgcctccaccaccgctaccacgagactgagcttcgttcacggtaatgttacgtccgtcaacatctt

SEQ ID NO: 3047 - DNA, 424 bp, Cicer arietinum
actttcaggtggtggagatgcttcttgaccacctcgagctggccgttcaaggggtgataatcgaagagaatgacgaccatatcatggaagaggttcacctgttcgatgacatggatgcgaagacccggaagcttttgaagatttacatcaagttcggatggaagaagctgaatgactattatggcaagctgacctctaccgcctacttagcggcagttgtattccacccgtgtaagaaatggcgaactctagagcagctttggaaccagctgccgtctcgtcagacgtcagaatggaggaagacctatgaaggaaacttaacgagagtctgggaagagaagtacaaggacatggctcatgaggtggcctgcaatgccgtttcagcatctgagagcaatagtgccttggactatattgagcgccg

SEQ ID NO: 3048 - DNA, 413 bp, Cicer arietinum
acagagtttacctggagaccgtggaatgaggcgactacctcgtccggggaggggcgttctggccgctttggggttttctcctgcaagggttttccccaaggatgcacggttctagggttgcagctactggcgatctttggggatcatggacttcctgcctcagggtatggaaagctacttgatctatctgcgcaagagaattctaggctggataggaatagttcccgctgacgggatgacctcttgaaagtaaatgcgggggtgtgccgatgatatgctggatgaactagatgggagacgctgctggagggaagctctgctaagaccagctgtattgatgtccaatgggacgtgcttcaccgacaactactgtagggcgagctacgagtagagaggtgcctcttgggggtaat

SEQ ID NO: 3049 - DNA, 150 bp, Cicer arietinum
gtcggatctcctggcggcacctcagaaccagaacgccttagatatcggaggacggtgcccgtggcatcggtagcgacgtccttccgatcaacgacgccgattgcgatgggtttttcccctttgaaggcaagccgcgccgccggcctctga

SEQ ID NO: 3050 - DNA, 395 bp, Cicer arietinum
atcgattttgtagccgcgccccaatctcgtttctcacttcttccctccgagccacccaaagtgactaagagaaccaagaaggccggtattgttggcaaatacggcacacgatatggtgccagtttaaggaagcagattaagaagatggaagtcagtcagcacagtaaattcttctgcgagttctgtggaaagtatgctgttaagaggaaggctgttggtatctggggctgcaaagattgtggaaaggtgaaagctgggggtgcatacacattgaatactgccagtgctgtaactgtgcgaagcaccatccgaaggctgagggagcagaccgagagttagacaaccagtttacattattctcattttgttttctaagtcattgcagaaacttttgt

SEQ ID NO: 3051 - DNA, 358 bp, Cicer arietinum
actgctccaagaaatactaatccccatggtcacgtcaaaaaatggaacatggacccaccaagacagaaatcatctgaccgtataagtatagttacaatcatcccaaaatgaaataagaacaaccaccaaaagaaagatatcaagtccctatacaacaaaactaatctgatcatactcttgcaactacaataacatgggtgacctccacacactccacaagttccgtctgacgcaacatccatcttcgaggtaacctcatcctcatcaacatccatagatggatcgctctctttagaagtcagatccacccacgagatagggggcttcggcggcgccgggacctcaaaacagtctgcta

SEQ ID NO: 3052 - DNA, 422 bp, Cicer arietinum
gcgatgccctctcaagtacactcgtgccattctcgatgccatccaccctggcgaacttgccaatgtcgagtatgagaactatgaggtcttcaacctccaggttcccaagacctgccccaacgttccctcagagcttctcaacccctccaaggcttggaccgctggcgaggacagcttctagaccgaggttgtcaagctgggcaagctcttccgcgagaacttcaccaagtacgagagcgaggctaccgaggatgtcgtcaaggctggtcccgttgtctaagaagaggaagaatgagagtaaaaaggaacaaaagggaaagcgattttttttgcgattggtcatgacaaattcgagcaactgtttatcatctgggtccggcgtcattacatggcggccatcaaccggctgtcctcttcttttt

SEQ ID NO: 3053 - DNA, 170 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccag

SEQ ID NO: 3054 - DNA, 215 bp, Cicer arietinum
accttccggattagtgcttgggatgagtggagcttgggaagatgcgaaggattcctcagttagagtggaggcagaggccgtcgtgggagctgaggatacagtggttggaccagggactggcagaaaggataagggctcgatgcccatggagtgagagattgtagggccatctaggcgggccgagtcagagcctcctcttcgagtgagtgatcctt

SEQ ID NO: 3055 - DNA, 230 bp, Cicer arietinum
accattgttcaagagggaaattgaggaaatttatgagatgggttgactacacaatgatagctacaacaactgtttgtctatcaagggccatcagaaatgagaacccaaagttgctgatggcggcatctgcagcatttcttccagttaatccattaatggtttcagttattcacactgggatgatggaggtagcatttgctaaaagggcattgaaagatccagacttgaga

SEQ ID NO: 3056 - DNA, 458 bp, Cicer arietinum
  misc_feature (7)..(7): n is a, c, g, or t
  misc_feature (22)..(22): n is a, c, g, or t
gatttcngagcggccgcccggngcaggtggtcgactctcatctcgttccgttcagaagaatccatcaacaaccatgactcgtggtaaccagagagagaaagaccgggaaagggctcagtctagaaccggtggttctaaaggaaagcctgtaaagactgatgggttgactcctgaacagcgtagggaaagggatgcaaaggcactgcaggagaagacggctaagaaagctattcaggatgctggagggaataatgcaggtggaagcaaaaaataggcaataataatttgattattattaatttggtgcttgaagtgttattggctattatagacatttatggaaaattgaaaatacttgtgtgtcatattctgatcatcttttttttgtagtttagaatcaaatgtgtttatctttattactattattattgtcatgtgtggtaactgaaagggattga

SEQ ID NO: 3057 - DNA, 173 bp, Cicer arietinum
gattcagatccacaccataggattagatctaaaatggcaacaaccagcctttgcaaccgatcgtaggaatgggatggcgcatcacggtctcgcgctcagggtttgtgaaaccacgagtgatggccaggaatctgttgaggcaagctatggcacggggaaatggtgggagggtt

SEQ ID NO: 3058 - DNA, 255 bp, Cicer arietinum
ctttcttcttttgcagcctgtgaatgacaaagtccaaccgaaggatggttcggagaatctttacagcacaatacctacaaagcaagcaggggacaaaaactcttcaaccaaagttgttccaatcacctctgttgatgacattggagaaggtttaactacatcagctggtgggtccaagcactactgtttttctgattttctccgtgataatgaggacagtgatgaacaggagagtgagtctgtggtttccgagac

SEQ ID NO: 3059 - DNA, 433 bp, Cicer arietinum
acgacggattccgcctccggaaacttctcctgcgtcacaggcgactgtggatccggaaaaatagcatgcggcggccgtagtggatcgccgcctgtgacgctagcggagttctcaataaacagtttcaacaatcaagacttttatgatgtaagcttagttgacggttataacgtcccgatggatgtgattccgttaagtaactctggaaagtgtaaaagcacgggttatcctacggatctgaatgcggtgtgtccaacggagttgaaagtaacggaaaatgggatagttgtggcgtgtcagggtccttgtgctgctttcaatttgcagtttttttgttgtgttgggaatcattcaactccagagacttgtgaaccaagtgtgcatgctcagatattcaaaaaggcatgtcctcaagcatatagttatgcttatg

SEQ ID NO: 3060 - DNA, 346 bp, Cicer arietinum
gttggatctactacccttcttactaacgtcactatgactgctcaaaccaaagaagagcttcttgctacccatctcgaacaacaaaagatccatcatgatgagcctgtagttgaggatgatgatgatgatgaggacgacgatgatgaggatgacgatgatgaggacgatgacaatgcagaaggtcatgaaattgatgcatctggtaggtccaaacagacccgaagcgaaaagaagagtcgtaaggcaatgctgaaacttggaatgaaaccagttactggtgtcagtcgtgtgacagtcaagaagagcaagaatatcttgtttgtcatctccaaacctgacgttttca

SEQ ID NO: 3061 - DNA, 158 bp, Cicer arietinum
acttgggaagatgggagcacctccaaagagtgatgttccaattattacaccaaatgagctcactgaagctgatggcttgttgtttggttttccaacaagatttggaatgatggctgcacaattcagatcatttttggatgcaactggaggcctatgga

SEQ ID NO: 3062 - DNA, 282 bp, Cicer arietinum
acttgaggtgggttcaaatgttacgaggttcagtgttggagaaattgtgggagttggactcctcgttggttgctgcaaaagctgcagagcatgtgaatctgatattgaacaatgactgtaacaagaagatctggtcttacaatgatgtttataccgacggaaaagccactcagggtggttttgctgaagccaccgtcgttgagcaaaaatttgttgtgaaaataccagagggattggcggcagagcaagttgcgccattgttatgtgcgggtgtgacagtgt

SEQ ID NO: 3063 - DNA, 334 bp, Cicer arietinum
ataattctcacttgtttgtttcaatcatcatccatgtcgactactgctggtcaagtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaagggtcagactcctatgtttcctcgtatatttggtcatgaagctggagggattgtggagagcgtaggggagggtgtgactaatctgaaaccaggggatcatgctctgcctgtattcactggggagtgtg

SEQ ID NO: 3064 - DNA, 229 bp, Cicer arietinum
gtcaaaagctttgcttgttcggcacctcctttattctacgcactcctttctgcttatcctgcgctactttcacccgtttcgcggactcaaatccacaattacgcgtcttcgcccttttccacactctcaccacctaccgcttcaagagtctcaactccacaatttcgctctttcgtctcacttcaggaaagaatcatgagttgtttcagctgttgcgaagaggatgagt

SEQ ID NO: 3065 - DNA, 332 bp, Cicer arietinum
actcaaggaaggtaatggagaattgtgtggcacacttgaaatctattggaacttatggcgatgaagaagttgaagctatgcaaaaatttgctgaagccttcaagaatgtgaattttccacctggtgcctctgttttttataggcaatcacctgatggagtattagggcttagtttctctaaagatgcaagtatcccagaaaaggaggatgcagttattgagaacaaggcagtttcatcggcagtgttggagactatgattggtgaacatgctgtttctcctgatttaaagcgctgtttggctgcaagattacctgctttgttcgaccagggt

SEQ ID NO: 3066 - DNA, 131 bp, Cicer arietinum
aatagaaaagagagtaattgggtttttggaatggcgagttcaaaaaattcagatgagtcagacaagccacaaccagtgatgttggttgcaatcgatgagagtgagcacagtgcatgcgctctgaaatggac

SEQ ID NO: 3067 - DNA, 295 bp, Cicer arietinum
gcaacgaccacgaaccattacgaagcacgactccgaaacgatcgatcaactaatacctttgaaaattcaagaaaacatcactaaattgtcataatggagttcggtaacgctggagtattgaacgaggatggtatccatgttgatatggatcgcctgaagaagggagaggtcaacctgggaacctcgattatggcggttactttcaaggacggtgtcattcttggtgcggattcgcgaacaacgaccggtgcctatatcgcaaaccgagtgacagacaagttgacgagagtacctg

SEQ ID NO: 3068 - DNA, 434 bp, Cicer arietinum
cggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaatttgacagactgcccccgaacccgctgacgggtgacgggcttgacaacaacagcgccttttgtgccttggtatgctggatggtgaaggaagcg

SEQ ID NO: 3069 - DNA, 435 bp, Cicer arietinum
acaattgggttctctggtgcggcccttgctaacttggttaatgttgctgccctcaaggctgcaaaggatggtgccaaagccgtgaacatgcatgattttgagtttgcaatggacaagattacaatgggaagtgaacgcaagtcagctgttctatctgatgagtcaaaaaagatgaccgctttccatgagggtggccatgcgttagtggcaatttattctgatggtgcgcttcctattcgcaaggcaactatagttcctcgtggggcggctcttggcatggtttctcagttgccagacaaagatcagaacagtgcctcccgtaaagagttgcttgcgagtcttgatgtttgtatgggaggtaaggttgctgaagagctaatttttggagataatgaagttacttctggtgcatcctcagatctttcacaggcaact

SEQ ID NO: 3070 - DNA, 428 bp, Cicer arietinum
acaaaacctacccattaaataataaaccaccaaaacagttgtagcgagaatcactctaatcggaaggagagtaacgagggcgaaaccgaggaggagtttctctttaggagctaagtctcctcttcccatggttccgtaaacatcgcgacgaacatatggagcaaatttcttctcgaggtcttgtaggtcgacggcgttggtggtggaggaagatactgaatctgatttgagaagaggacgatcgtcgcgaacggtgttgatgtttccgtttgatttcggtggttttgaattgaggtctttcagttctgactccatccccttcatcatagttcatagattgttgttacttctcattcttagctttcatatactactactgctactctcgtgagtcgtagtagctaataggtaattaattaatagttaat

SEQ ID NO: 3071 - DNA, 118 bp, Cicer arietinum
tgtacaaggacctcgtcagcgtcttcggcggcgagaagacctgcaagaccttccagatcaagaccaagactgagctcaacgagctcctcaccgacgaggaggtcaacgctgctgagtg

SEQ ID NO: 3072 - DNA, 190 bp, Cicer arietinum
gattatctcgaattaatttaaaaaaatcaaagggttttccccgtttgactattgagggtaacttcatcaagttcgctgccgtgggagtctatttagaagacatagcagtggcttcacttgccactaaatggaaggggaaaacctctcaacagttgctccagacccttgatttctacagagacatcatttc

SEQ ID NO: 3073 - DNA, 416 bp, Cicer arietinum
actttagcaacagaatacgttacccgaaaacaagtcacatggtagggtcctgcgctgcaaagactttgcccactctacactcgccgacggataaagcatcaaccttttcgtcagagcacacaatcaccattcccttgttatcctgtccgaccatatccagatattctctagtcgttcgttccacaaaccacaccgagccactcgaacggtccatgtccacgacgagggcgaggtaattatcatttggaatgtccgcgttgttataggaatgccacattggtggggagcaagactgtttggtcactgtgttgcatttctcaactatcttatcgtcggtagtgttttttctaacgcgatacttttgcatcgatgaggcggcaacgttttgctcgacgtaaggcgaatatagacagacg

SEQ ID NO: 3074 - DNA, 324 bp, Cicer arietinum
cacggcctagtgcttgggggcgttaggaaagaccccaaagacgcttggagcgtcacggcctgggccgactctgattggaaaggcgacaatttcacaggaagatcgacgtttggatggctcgttcagcttgaagaatctacggtctcatggagagcgaaacgacatgaaacagtagcactctcaactaccgaggccgagtatactgctctatcacaatgcgccagagaattaacatggattcggaatctgttctcagaactacaactatcactagacattccgatccttttgaatggcgataatcagggttctctgagactctgc

SEQ ID NO: 3075 - DNA, 259 bp, Cicer arietinum
cgctttgctagggtagagaatttttgcaggctaaaatggcagcaaaagcagctgtggggctaacgggaccctaacagctgcctgaagaaagggattcagagagttgacctttcttcgcgacgagtgtctgcaacgacattgagcttcgcgagctcttgacaccgccttcgggcgctacttctcacgtgttatttgcggcttcttcttaccccgacattccggcttcgcgagccttcgacaatccgggctctgcgcccct

SEQ ID NO: 3076 - DNA, 424 bp, Cicer arietinum
acaattgggttctctggtgcggcccttgctaacttggttaatgttgctgccctcaaggctgcaaaggatggtgccaaagccgtgaacatgcatcattttgagtttgcaatggacaagattacaatgggaagtgaacgcaagtcagctgttctatctgatgagtcaaaaaagatgaccgctttccatgagggtggccatgcgttagtggcaatttattctgatggtgcgcttcctattcacaaggcaactatagttcctcgtggggcggctcttggcatggtttctcagttgccagacaaagatcagaacagcgtctcccgtaaagagttgcttgcgagtcttgatgtttgtatgggaggtaaggttgctgaagagctaatttttggagataatgaagttacttctggtgcatcctcagatcttt

SEQ ID NO: 3077 - DNA, 228 bp, Cicer arietinum
gtcgactctcatctcgttccgttcagaagaatccatcaacaaccatgactcgtggtaaccagagagagaaagaccgggaaagggctcagtctagaaccggtggttctaaaggaaagcctgtaaagactgatgggttgactcctgaacagcgtagggaaagggatgcaaaggcactgcaggagaagacggctaagaaagcagctcaggatgctggagggaataatgcag

SEQ ID NO: 3078 - DNA, 388 bp, Cicer arietinum
acaattgggttctctggtgcggcccttgctaacttggttaatgttgctgccctcaaggctgcaaaggatggtgccaaagccgtgaacatgcatgattttgagtttgcaatggacaagattacaatgggaagtgaacgcaagtcagctgttctatctgatgagtcaaaaaagatgaccgctttccatgagggtggccatgcgttagtggcaatttattctgatggtgcgcttcctattcgcaaggcaactatagttcctcgtggggcggctcttggcatggtttctcagttgccagacaaagatcagaacagtgcctcccgtaaagagttgcttgcgagtcttgatgtttgtatgggaggtaaggttgctgaagagctaatttttggag

SEQ ID NO: 3079 - DNA, 125 bp, Cicer arietinum
cagatcgattggcgtttccagaggccaactatccaatatgagtaagcttcaaagtgatgctttgagagaagccatctcaggaatcacggctgattccaaggagaaaaacaggaaatttgtggaga

SEQ ID NO: 3080 - DNA, 367 bp, Cicer arietinum
actagtgatttcgagcgccgcccgggcaggtacaatgtcctctagcttttcaggaacaacccccaacatgtcattgtctaccccatcactgaccgcacgtccggttccatcttcaaaaagctgaactaccggtaggccaacataggctcccttgaaatccccatcgcgcaacctgctttctgcgtctcttttcacatcacttgagctcaacttccttgtacatcttggcaatgatagggttgcagacactttcaagttccttcatcttgtcctcaaactcatctgcctctgcaagttggttgctgtctagccattggatagtctgctcaatggagtcctcgattttcttcttgtcagctgaatcaag

SEQ ID NO: 3081 - DNA, 186 bp, Cicer arietinum
acacaaagatttaaagtcattttttcaattttctctccatttctaagttaagttcgcagccttcgcagtagcttcatcgatattacccaccaaataaaacgcttgttcgggaagactatctaattctccagaaagaatcaatttaaaccctctaattgtttcttctagcgcgacatatttccctgg

SEQ ID NO: 3082 - DNA, 261 bp, Cicer arietinum
ctcaccaatatcgttctttttgcaaattgtgttgtgagtgattttatctttgtcttttgagaatatgtctggctgcaactgtggaagtagctgcaactgtggtgatagctgcaaatgcaacaagaggtctagtggattgaactatgccgaaggcggcgaaaccacagagacggtggttttgggcgttggtccgacaaagattcagttcgagggagctgaaatgagtgttgcagctgaagatggtggctgcaagtgtggatc

SEQ ID NO: 3083 - DNA, 265 bp, Cicer arietinum
accagaggccattcatgaagggcaagctttacatccactttacagtggagttccctgagactcttagtcttgaccaggtgaagggtttggaagctgttttgccagctaaaccttcatcgcagttgacagatatggagctggacgagtgtgaggaaactacacttcatgatgtcaatatggaagaggagacgaggaggaatctttttcagcaacagcaagaggcatacgatgaggacgatgatatgcctggtggggcacagagggt

SEQ ID NO: 3084 - DNA, 303 bp, Cicer arietinum
tagaattgttggagagttgctacaacctggcggctatctcaaattagttgaactgggccttgaagattgtgtgaacaatattgatgcgcagcaagtgtttggttatgcacttttcaaagatgggaaacatactcgtctctcttatcccttggataagtttcactcagatgtatctggcagaagctttcacaatggccgttttattcagagaatgcgagagaaggctgcttcccttcccaatgtaaatttggagcaaggagcagtcacttccctacatgaagagaaggggacaatcaaaggtgt

SEQ ID NO: 3085 - DNA, 141 bp, Cicer arietinum
agtgtgctgaagctcaaggcaaacatttcggtttgattgccactgagaagggctggaacatcttcgttggcggtaacggtggtgcgaaccctcgccatgccgagcttctagccaaggatgtgcccccagctgatgtcgtga

SEQ ID NO: 3086 - DNA, 315 bp, Cicer arietinum
acttcaatcttgcctcggatgacagtttgcgacctgctagaaactttgatcatgagcctgtttttgatgggatgctatcaaactcaaggagcagcgactatcttactggaaaaatagaagcatctgagagcttcaacttataccagtctgcaggcgactacggcatggaaggttgacactcggtgtttcttctgatggatgtgattagctgtaaagaaatcgtagtgtggttttgagctggttttgattagaaaaacagagtgaaccaattgaaattggaaacttacaagttatatataaatagttatatagttt

SEQ ID NO: 3087 - DNA, 230 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctg

SEQ ID NO: 3088 - DNA, 214 bp, Cicer arietinum
accagcttaaatatccagcacctggagctccaaatttagctaaaagggtgaaggagctactcaacaaatccggtttcaaccgtgtcgccgaagacgaaaaactaggactcgatcacggtgcttgggttccactcatgttaatgtatccagaagctgacattccagtttgtcaattgtctgttcaatctaacaaagatggaacttaccattataa

SEQ ID NO: 3089 - DNA, 214 bp, Cicer arietinum
acagagcttaccccgagaccgtggaatgaggcgactacctcgtccacagagcagcgttctggccgctttggggttttctcctgcaagggttttccccaaggatgcacggtcctaggttgcagctactggcgatcttaggggatcatggacttcctgcctcagggtatggaaagctacttgatctatcagtgcaagagaattctaggctggagag

SEQ ID NO: 3090 - DNA, 392 bp, Cicer arietinum; identical to SEQ ID NO: 1458

SEQ ID NO: 3091 - DNA, 198 bp, Cicer arietinum
acacggccgtcggcggtgagaccggcgatggcaactccgatatgatcatcaaccttaaagatcttcttctgatgagaagagagttcggaattagctttgttaacgcacgcgagaaccacgtgagttttggatcggagacctattgcggctgaaccttgtttcactgcttgcatatggtattcgacttggaataatctt

SEQ ID NO: 3092 - DNA, 198 bp, Cicer arietinum; identical to SEQ ID NO: 2830

SEQ ID NO: 3093 - DNA, 405 bp, Cicer arietinum
acttacaatggggaggatgttgccatcaaaatcttggagaggcctgaaaatgatacagcgaaggctcagttgatggaacaacaatttcagcaggaggtcatgatgcttgctacactgaagcatcccaacatagttcgtttcataggtgcatgccgtaagcctatggtgtggtgcattgttactgagtatgctaaaggtggatcagttcggcagttcttaaccaagcgccaaaaccggtccgttcctctcaaactagctgtcaaacaagccttggatgttgcaagaggcatggcatatgttcatggtctgggattgatccatagggacttgaaatctgacaaccttttgatttttggtgacaagtcaatcaaaattgctgactttggagtcgcccggattgaggtg

SEQ ID NO: 3094 - DNA, 245 bp, Cicer arietinum
gtcggctgcacctggaaatgcaatggcaccactgatgaggtgaagaagattgttactactttgaatgaagctaaggtccctggtgaagatgttgttgaagttgttgtgagccccccttatgtgttccttcccgttgtgaaaagtttactccactctgacttccatgttgctgctcaaaactgttgggttcgcaaaggtggtgcttataccggagagattagtgctgaaatgcttgttaatttgga

SEQ ID NO: 3095 - DNA, 205 bp, Cicer arietinum
accagagtttctaaccccgaggctacctactaggttccatcatttctcctttccgatcgttctcctccgcggacccacgctactacgaccccggagcttttcagcactgtctcaattcaacatacctacctaatacgtttgtcccaggagaataaacgaatactacagccaaaatgtcgccaaccgaggagaagagtgacgatat

SEQ ID NO: 3096 - DNA, 425 bp, Cicer arietinum
acatacatatacatacccatacagaagaaaagtatttttttttacagaaaaaacaaaagaagcaaattatatattgtcttctccagcggttgattttggtttcttcactatcaaaacagggcacttcacattctgtgcgcagtgattgctcacgcttccaaggaaagccctcttgatgacaccatagccgtgacttcccatgatcaaaatatcaacacccaatttttgaaccgcatgacatatcacgtccctcggatcgccattctctatcttggtctccacattttggaggtctttacaaactctcttggctttctccaagacacaatcggcaacttgttggctatacttctccatggttgcagttatgtcagatgaaaaaaggtatcctgtgccatcaaaggccgaataaacggcacgagggg

SEQ ID NO: 3097 - DNA, 200 bp, Cicer arietinum
acaaagcccgcctgggagagatcttcacaacgactgatctcggacccgccaaacacttcctcggcgtaagaataacccgcgacaggaacgcaaggctaatctatctttcccaggatgcatatttcactagaatactgaagagattcggcttagaaaactgccgaccagtcaagacccctatggagcgaaattcgctctcg

SEQ ID NO: 3098 - DNA, 271 bp, Cicer arietinum
acacggccgtcggcggtgagaccggcgatggcaactccgatatgatcatcaaccttaaagatcttcttctgatgagaagagagttcggaattagctttgttaacgcacgcgagaaccacgtgagttttggatcggagacctattgcggctgaaccttgtttcactgcttccatagcgtattcgacttggaataatcttcctgctggactccatgttgttacgtctgtgtcgtattgatttctaaacattttggattttgattttgattttg

SEQ ID NO: 3099 - DNA, 324 bp, Cicer arietinum
  misc_feature (201)..(201): n is a, c, g, or t
gtaaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttanatatcggaggacggtgcccgtggcatcggtagcgacatccttccgatcaacgacgccgattgcgatgggtttttcccctttgaaggcaagccgcaccgccggcctctgattccttcccaaggt

SEQ ID NO: 3100 - DNA, 329 bp, Cicer arietinum
accattcttctgttcacttattcctaccatcgtttcatcaaaggcgcttaagaatagtctgcgcaaattatctggccacagccactctgtcaatcacatccagtgctctatttttgtcgataccaaaatcaatcacaggaagcttagagcaaattctgttaaaagataattccttgtttctactagctgatgagtaactgctacttttgatcattcttttgttatctgtcaaccccatcttcacattgtcgaagtccaagcttttactgatccctctaacacgaattctgttacttacatccttcagcatgatctgctcgtcggatgtt

SEQ ID NO: 3101 - DNA, 118 bp, Cicer arietinum
acagatcttacctggagaccgtggaacgaggcgactgccttgtccacagagcagcgttctagccgccttgggtttttccctgcgaggggtttccccaaggatgtacggtcctgggttg

SEQ ID NO: 3102 - DNA, 208 bp, Cicer arietinum
aggcaggtacgctgagctacaagggcgctgcttacctcggatccctcatcttcttcgctacctctgctcccggctacattgctcaaatcttcgttgagaagcgacctctcgacaccgtcggcgtcagcctgggtaccaagctcgttgagaccctcggtctctccgtcttcctcacctggtggggaacccgaaccaaccctttggagta

SEQ ID NO: 3103 - DNA, 205 bp, Cicer arietinum
actagtgattatcgagcgggcggccgaggaggtacaaagtatcttgttctcgtttatatattaggtatagaagtaaattctcttaattgagttttatttatttattttattttatatgtaagagtaaaaaatggaaactagttaaaaatacatgaatctcttaccatttagaccattcacatgtcggaaagttttcatttatgtt

SEQ ID NO: 3104 - DNA, 214 bp, Cicer arietinum
ctaatttccatcaattcctcaccaaatggaggtcaggttgttatagcagcctctctaactaaagaacagttggggaaatctgtccatcttgttaatttggagctcagcataacacacggtggtagtggggtggcagaagcattgttgaacgagatgtttggaaataatgtgctagaatcagaagagggtattagcctacacatcagtagaaagt

SEQ ID NO: 3105 - DNA, 433 bp, Cicer arietinum
acagggctgtaagggatagctgcagaggtcatccagttgacgttgcttcactacatgctttcttatctcacaaaggaaaatctgactatgtaaagttggaagaatttccctctattattccttgttccatcattcatgcaggaacaaattcatgtttagctcatgaaataaatgcaacatcatcaacgtttaagaagacattcccactttacttctctttgacctttgtcccatttgtcgttctgcacctacaaaagttcactgcagctcctttccgcactttctggtttgccgttaaaggggccgttcgctcaacagcctttttgtctgcttttgttggaatctttcagggagtcatatgttttcatagaaaacttgcttcaagagatcacaaattggtgtattggatagcaggtggaatatctgccctttc

SEQ ID NO: 3106 - DNA, 285 bp, Cicer arietinum
acagggctgtaagggatagctgcagaggtcatccagttgacgttgcttcactacatgctttcttatctcacaaaggaaaatctgactatgtaaagttggaagaatttccctctattattccttgttccatcattcatgcaggaacaaattcatgtttagctcatgaaataaatgcaacatcatcaacgtttaagaagacattcccactttacttctctttgacctttgtcccatttgtcgttctgcacctacaaaagttcactgcagctcctttccgcactttct

SEQ ID NO: 3107 - DNA, 438 bp, Cicer arietinum
gtgaaaactcaaaactgttatttagaagaaagaaaattgtaatttatatttttaataagatctggaaaaaaacatagaaagagaaacaacatgtgaattacacaaatgagatttgcaaacagaggaaacagaagagattgattgatgaagaaagagaaagagaaaggaattgctgtgtcaagccccatcagtggcgaagaagacagtgatgataaacaacaacacccttccttttcctccgccagattctcttcccgtaacgcttcttccaaatacgatttcgtcaaggtaaaggtgtggttgggtgataatgcggatcattactatgttctttccagatttttgctcagtagaatgctaactgtaaccaagattccaaaccatgtagctatcaaaattgctctcgaactgaagaagctgctcatagacaatagcctt

SEQ ID NO: 3108 - DNA, 293 bp, Cicer arietinum
acaacctctacaccaagatcacaggtggtcagcgtatcgacttgtttggtgcccagaagcaggaccttctcgacatctggggccagcttgttgctggtggtatggagtccggtcatgcttatgccaagtctctgcgaaccgtcaagagttgcgttggttctacatggtgtcgattcggtctgagtgacagtgttggtatggccgttcgtctggaggagcgatacaagagtattcgagctcctcataagatcaagggtggtgtgagtggttgtgtgcgagagtgtgctgaagct

SEQ ID NO: 3109 - DNA, 137 bp, Cicer arietinum
actgtcttaaccaagaagaaggccgtccacaagacaacgaactacagatgacaaaaggcttcagagcacccttaagagaataggggtgaatgccatccctcagattgaggaggtcaacatctttaaggatgatgttg

SEQ ID NO: 3110 - DNA, 694 bp, Cicer arietinum
acattcaatagcacgatccacgcctccgttggtcatttcagcaattacttgttgcacgggtttgtcatgctcttttgggtttacaaactcattgaccccaaacttcttagctaattcaaatcggctggaaactaaatcaaccccaatgattcttgatgcaccagaaatccttgccccttcagcagcagcaaggccaacagctccaagtccaaagataacaacagaggaacccggtttcggtttagcaacattgatagtagcaccaagacctgtgcatattacctcggccgcgaccgatttcgagcggccgcccgggcaggtaaaaattctttcttggcacccactgttagtgcggtgctaggagcgggattttctacgggctatgcgactacacaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactgga

SEQ ID NO: 3111 - DNA, 353 bp, Cicer arietinum
acaatgccgcgctgtggctgacaaagcatccgatgcgttttacaggctcaccaacacaagggagcagatccagtcatatgttttcgacgttataagggccagtgtgccaaagttggaactggatgcagtctttgagcagaagaatgatatagcgaaggctgtcgaagacgagcttgagaaggcgatgtctaactacggatacgagatagtccagactctcattgttgatgtagagcctgatgttaatgtcaaaagagcaatgaatgaaatcaatgcagctgcaagactgaggttggctgcaaacgacaaagccgaagcagaaaagatactgcagatcaagaaagccgagggag

SEQ ID NO: 3112 - DNA, 145 bp, Cicer arietinum
accagaggattaccactgctatttcagttgttgcacccatatgctatgcacacttagctgcaactcaattggggcagttcatgaaatttgaagacaaatctgagacatcctcaagccatggtgggctgagtgctgcaggagctgt

SEQ ID NO: 3113 - DNA, 435 bp, Cicer arietinum
gcagtccgaaatccagcaaatatgaagatcatcgcggcgtatttgctggccgttttgggcggtaaagcagcccctacctctgatgatatcaaacacatcctcacttcagttggaattgaggccgaggatgagaagattgagttgctcttgggtgaagtcaagggaaaagattttgccgagctaattgctagtggaagagaaaagttgtcttcagtgccatctggtggaggtgctgttgctgtttctgctgcacctggtggaggtgctgcagcagctgctgcacctgctgctgaagccaaggaagaaaagaaggttgaagaaaaagaagaatctgatgatgacatgggcttcagtttgttcgactaaaaggtctgatctttttgccggaaaatttgcaattcctgttagagttgtagttgaaacacaacattttgt

SEQ ID NO: 3114 - DNA, 299 bp, Cicer arietinum
acagagcttacctggagaccgtggaacgaggcgactacctcgtccacagagcagcgttctagccgccttgggtttttccctgcgaggggtttccccaaggatgtatggtcctaggttgcagctactggcgatcttaggggatcatggacttcctgcctcagggtatggaaagctactcgatctatctgtgcaagagaattctaggctggagaggaatagatcccgctgacgggatgacctcttgaaagtaaatgcgcctttgtgccgatgatatgctggatgaactagatgggagacgc

SEQ ID NO: 3115 - DNA, 196 bp, Cicer arietinum; identical to SEQ ID NO: 445

SEQ ID NO: 3116 - DNA, 432 bp, Cicer arietinum
ctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttctcctttgaaggcaagccgcaccgccggcctctgatcccttcccgaggtttttccctgccgccacgacagtcgactacgagctacaacttggttactggagattgtggactgcgtcagcagatgtagcgatgcgtgagagaattctggtcggtggaaaaattcgac

SEQ ID NO: 3117 - DNA, 434 bp, Cicer arietinum
cgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccga

SEQ ID NO: 3118 - DNA, 133 bp, Cicer arietinum
acaacaaaatcatacatatattatcatacatatatgcatatgtatagccataaggacgcctaacggagtccgtcgcctttttgtgacttgccggtttaccaagctatagccaaagcttctcttcctatggagt

SEQ ID NO: 3119 - DNA, 332 bp, Cicer arietinum
tgtgtgtgaaacctcctgagaaagtgtttgaggaaaaatgggaaggaagaaagggtatgtcgaattcgaagaatctccaccggatgattttgatccggcgaacccttacaaggatccggtggctatgttagaaatgagggaacacattgttagggaaaaatggatccaaatcgagaaagctaaaatcattagggagaaacttcgttggtgttatcgaattgaaggtatcaatcatcttcagaaatgtcgtcaccttgttaaacagtatcttgaatcaacacgtggtattggttggggcaaggatggtcgtcacccttctctccatggaccaa

SEQ ID NO: 3120 - DNA, 216 bp, Cicer arietinum
atttcctatatatcatctcactccttcccttacaatctccactaccatcacactagtctactaaatcctagtttcctttatcagtctttctctttgtaacaccaacgaagagagatggagtcctcatcgacaccaaaattctatgcttacataatcgtttgcatgctcttcatctcttcagccacaccaattcttggttgtggctattgtggtgga

SEQ ID NO: 3121 - DNA, 377 bp, Cicer arietinum
agctgttttgatatgtatgtatgtatgtatatttttcgtccggggggccaaaggccccgaaaagtctcctactggagcacaggacgtgctgagctaaactatctacaattgctgtcgcgctggactcctcctagaatacccgccatgtccactcgcatcaacggagagcctctcgagctccttcccccgagggcaccttcctactcgtagccagccctacggtaggttcaagcacatcatcttggatgtcaaagcaggtgattcaggacatatccccatgcaactgcgattccgtctagttcatccagcatatcatcggcacgaaggcgcattactttcaagaggtcatcccgtcagcgggaactattcctctccag

SEQ ID NO: 3122 - DNA, 438 bp, Cicer arietinum
acttaaactttagttttcaattcatcattgaaaacaaatcacagtaggagccttttttttcccctcttatcagttggttctcattttaagttaaatctattctgggatggtttttatttccatttttatttttatatatgttgggttatacatgcctgtctgatttctaggacttggttgaatttgctgtgcctgtttactgggaatgtataaaagtagtgaggagtttgtatggaaagattctctagcccttcctcccacacaataaaaggagtgaaatgatgttgagaacatgttttctggatgaatgcgttgaataatatgttggttgttatacaatgtttgaatttttaaatatataggccctcaaagattttctagcaaagtttgaagacagggagataaaactattggtttaatagtgtcgtctttaatgat

SEQ ID NO: 3123 - DNA, 415 bp, Cicer arietinum
acaaagcttacctagaggccgtggaaagaggcgaccacctcgtccacagagcagcgttctagccgctttgggtttttctcctgcgagggttttccccaaggatgcacggttctaggttgcagctactggcaatcttaggggtcatggatttcttgccttagggtatggaaagctacttgatctatctgtgcaagagaattctaggctggagagggacgagttcccgctgacgggatgccctcttgaaagtaatgcgcctttgtgccgatgatatgctggatgaactagatgggagacgctgctggagggaagctctgcgaggatcaactgtattgatgtccaatgggacgtgcttcaccgacaactactgtagggcgagctacgagtagagaggtgcctcttgggggtaatgagt

SEQ ID NO: 3124 - DNA, 180 bp, Cicer arietinum
acttcccctgatgaaaagcttgagccaattctaactcactaggctgtcttgagccatcccctgcatatgttcctgaaccataaggtgaaccacctttcaccttctccatctcaaacatgccagctccaaatgtgtatccaactggcacaaatatcattccatggtgaacaagttgagtaa

SEQ ID NO: 3125 - DNA, 351 bp, Cicer arietinum
accgcaacttgtctgtgcctgaattgactcagcagatgtgggatgctaagagcatgatgtgtgctgccgatccacgccatggccgttatttgactgcatcagcaatgttccgtggtaaaatgagcacaaaagaagtagatgagcagatgatcaatgtgcaaaacaagaactcttcatactttgttgagtggatacctaataatgtcaagtccagtgtctgtgatatcccacctaagggccttaagatggcatccactttcattggtaattcaacttcaatccaggagatgttcaggagagttagtgagcagttcacagctatgttcaggcgcaaggctttcttgcattggt

SEQ ID NO: 3126 - DNA, 366 bp, Cicer arietinum
acaagagatcaaggctatctagaaacatgaggactgtgaaccgtgcttatggtggagttttatctggaggtgctgtcagagaaagaatcattcgagctttcttggttgaagagcagaagattgtgaaaaaggtcttgaagatccaaaagacaaaggagaaacaagcttcaaaggcttaagtttcaagaaaagagataaagatctttttggagggattttaggtttgagtcattatagtaaaaaacaaatttattagaactgttgttcccttgttaattttgtgctcatttggtttctttgaactcattttagtgcaactgttagcctattatgatacagttttgttcggtttattgatattttcat

SEQ ID NO: 3127 - DNA, 208 bp, Cicer arietinum
accagcaacaatataaagcataaaataaaataaaataaaatttaacaataggtcaagcaaatcaaattatatcagacacttgacactactaaaatgtctcaattgaaaaggaaaatccaacagaacctaatacaagtaataactcaaaattaacaaaatgttgtgtttcaactacaactctaacaggaattgcaaattttccggcaaa

SEQ ID NO: 3128 - DNA, 437 bp, Cicer arietinum
acgatgaccactcatgataaccagaaacctattggaatcagaggaactgccgaagaagtggctagctcctcccctggaaaaactaagaaacgtaagctatttgatgtggcttatgatgatgatgtgcagtttttggacactgcaagttctctaaaacaaaacctacccttcgaccacaagggtgacgacgacgatgatgcagaatcaagatgctcgggtagcaattacagtcgagggtcaggtgaaatgggttccttaacaggcaataagaagatgagaaaggaaaagattcaagatgttctaagcattctgcaatgcatagttcctaatggaaaggacaaggaaccaatccagcttcttgatgaagccatacgttgcttgaaatccttgaaactcgaaggcacgagctcttggactcggatgccttataaattgtg

SEQ ID NO: 3129 - DNA, 420 bp, Cicer arietinum
actgctattatcatcataagcataactatatgcttgaggacatgcctttttgaatatctgagcatgcacacttggttcacaagtctctggagttgaatgattcccaacacaacaaaaaaactgcaaattgaaagcagcacaaggaccctgacacgccacaactatcccattttccgttactttcaactccgttggacacaccgcattcagatccgtaggataacccgtgcttttacactttccagagttacttaacggaatcacatccatcgggacgttataaccgtcaactaagcttacatcataaaagtcttgattgttgaaactgtttattgagaactccgctagcgtcacaggcggcgatccactacggccgccgcatgctatttttccggatccacagtcgcctgtgacgcagga

SEQ ID NO: 3130 - DNA, 341 bp, Cicer arietinum; identical to SEQ ID NO: 537

SEQ ID NO: 3131 - DNA, 434 bp, Cicer arietinum
acgacggattccgcctccggaaacttctcctgcgtcacaggcgactgtggatccggaaaaatagcatgcggcggccgtagtggatcgccgcctgtgacgctagcggagttctcaataaacagtttcaacaatcaagacttttatgatgtaagcttagttgacggttataacgtcccgatggatgtgattccgttaagtaactctggaaagtgtaaaagcacgggttatcctacggatctgaatgcggtgtgtccaacggagttgaaagtaacggaaaatgggatagttgtggcgtgtcagggtccttgtgctgctttcaatttgcagtttttttgttgtgttgggaatcattcaactccagagacttgtgaaccaagtgtgcatgctcagatattcaaaaaggcatgtcctcaagcatatagttatgcttatga

SEQ ID NO: 3132 - DNA, 291 bp, Cicer arietinum
actggagcaaagagcaaggggcaacctatcttactaataataagaaacgggttgagataggcgacatgtagcttgcttccaagccgacccggccgcgaggaatcaagagatctttgacggtgctgactttctcgagtgatggaagaaggcgcccaaaagtgacaagcagtcgcggtcgaagcttggctctaggcgataggctagcagtaatcttagttatagtgagttagaacgatttggagaataaagatttgggggagagtttagagagagcgcgagacatgggagaaa

SEQ ID NO: 3133 - DNA, 432 bp, Cicer arietinum
gagaagctgactcgtcaacaggccaggcaacacatagaatctctagaggaatccacgataagggccattcagttttgaggaagcttgactcagatgggaaggttgatacaacacagacactgcacaatcttaatgaagatgagcttgcacggtttgaggaagcatggaaaggaaataatctagggaagttacctgattatgatgtgcataggaaaaatgattctagagttggtgagctaaacaaaaaccaggttcggtcacttccatctttggatcaggatagaaaaggaagtggatttgcatcaaagtatgaaacagggaacaattctgagggaagaacaaagaaagttgttagaatcaatattgagtgaatggtattatgtccattatgatattgtatgtaaaaatgtagaatgaagttgtgctatggtg

SEQ ID NO: 3134 - DNA, 409 bp, Cicer arietinum; identical to SEQ ID NO: 170

SEQ ID NO: 3135 - DNA, 299 bp, Cicer arietinum
acaataaaaacctagtaactgcagttaatcagagcattgctccaacacacacaatggttttaatccttagaaaataagcaaccaacaaccaaaccagtatgtcaactttgacatatatcaaaaaattaacgggctttaaaaacaaaagccagagatgcattattttaaggcaaaacaaaattgaaggatatttgtgggtaaaagaccggcaaatctaacctctacaacctcccattcaaattccccttcttcctctgttactcttccatcaaagaaaaatcacctcctttttccacagt

SEQ ID NO: 3136 - DNA, 422 bp, Cicer arietinum
cagaaacttgagtcttctatacacaagtctttcttttttagaccaatctctacttttcaaacacattaaaaaatgggttttcgtttacctagtatcatcagaagggctgcaaaccaagcatcttctaaaggcgtggatgtgccaaagggatatcttgcagtgtatgtgggagagaaaatgaagcggtttgtaatcccaatatcatatttgaatcaaacttcattccaggaattgttgaaccaagctgaggaacaattcggatatgagcatccaacgggtggtctcacaattccttgcagagaagacgttttcttagatattacttctcgtttgaatttttgctgatctcttcagaagaaggagctgacatagattatttgaggcaaatttgtataggccggcactcacttattttttcatta

SEQ ID NO: 3137 - DNA, 443 bp, Cicer arietinum
actttcctcgtaataaaaggcaacccttgcaacgttcttcacaaagtcggtcaaagcagtcaactctctcgaagccttatcataaacgcgacaccgcacaagtgctggaacaaacaaccacaacgccgtatacaacacaaacaccactgtgagcagccacgacatcatcctcggcaacttcaacttctccccaacagcttttttaatcccaacttgaacagccaaacacaccccatgtaatataaaaaagcacgttgcgttccacgagggttcccaagcctcccacgtgcgcttttcccttttaatgtaataaaaaacaacctcgtgcatcaaagccgacacgctaaaagtagcgacaatcgcaggtagtggggcccactttctcccaatcaaacgacaaaaaaatttcactgcgggttcgtatacggtggggtgtagtacct

SEQ ID NO: 3138 - DNA, 414 bp, Cicer arietinum
acgtatttcagcgagcctctattcgaaggtgtaggcgaacctggatcgacggagatctcgtcagcgggattgtcgcagagtcagggatatttgagtgcgttggcaacgagggctatcattctgattgaggctgatgagccggcgatcggactccttgcgtttgttggtattggtatggacgaggttagtacctcggccgcgaccacgatcgagcggccgcccgggcaggttctcggtctcatttctagtgctaaagatatagaggctcttgctttaacggttgactgcaccggcggagtttactttgttcccgcctttaatggattgtttgctccatggtggcgtgatgatgctcgaggggtttgtattggaataacaagatataccagcaaggctcacattgctcgagccgtt

SEQ ID NO: 3139 - DNA, 164 bp, Cicer arietinum
ctttttttaaccgatcatcatcaatggaaaaaccaaaaacttccgaattggatgctccccttcatacaattggatttgagtttgtagatttaacaccacgaaaagtttctggcactctgcatcttacccaaaagtgttgccagccatttggggtgcttcatgga

SEQ ID NO: 3140 - DNA, 166 bp, Cicer arietinum
cgagaccttcacctgctaaatagcccgtattgcttcggcagtatgctggcttcttagagggactatcggctcaagccgatggaagtttgaggcaataacaggtctgtgatgcccttagatgttctgggccgcacgcgcgctacactgacggagccagcgagtatgt

SEQ ID NO: 3141 - DNA, 368 bp, Cicer arietinum
acagatgctaccaccatgacaaagacattatccttggtttttgtctcgcatttgacatcgagttgctgcactcgaagcgataatccaccagctatttgataaccaagacaccagggcaagcaatggcatccaggttcaagaacatcaacaaatcttccgaactgctctttgatcgcaacatttgactgatctacttgataacaacccaatgcttgacccatctttcaatcctgcacttggagacacagatcgaaatttttaattagtccaaataagtgcgaactactaaatgcttatataattaaactatatatatagatacaccaaagggtatttgtaaaccctttcgtgaagcatttgaattgaaa

SEQ ID NO: 3142 - DNA, 103 bp, Cicer arietinum
gagaaagtgttcgaggaaaaatgggaaggaagaaagggtatgtcgaattcgaagaatctccaccggatgattttgatccggcgaacccttacaaggatccggt

SEQ ID NO: 3143 - DNA, 314 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcgggaggatgtcgctaccga

SEQ ID NO: 3144 - DNA, 258 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcg

SEQ ID NO: 3145 - DNA, 229 bp, Cicer arietinum
gtcgactctcatctcgttccgttcagaagaatccatcaacaaccatgactcgtggtaaccagagagagaaagaccgggaaagggctcagtctagaaccggtggttctaaaggaaagcctgtaaagactgatgggttgactcctgaacagcgtagggaaagggatgcaaaggcactgcaggagaagacggctaagaaagcagctcaggatgctggagggaataatgcagg

SEQ ID NO: 3146 - DNA, 174 bp, Cicer arietinum
acagagcttacctggagaccgtggaacgaggcgactacctcgtccacagagcagcgttctagccgccttgggtttttccctgcgaggggtttccccaaggatgtatggtcctaggttgcagctactggcgatcttaggggatcatggacttcctgcctcatggtatggaaagct

SEQ ID NO: 3147 - DNA, 196 bp, Cicer arietinum
caagatctttctgaaagtgaaaataaggaggattacaagaaattctgggagaactttggtaggtttattaagttgggatgcattgaggacagtggaaatcataagcgcattaccccattgttgaggttttacacttccaaaagtgaggaggaccttaaaagcctagatgactatgttgaaaacatgggcgaaaacc

SEQ ID NO: 3148 - DNA, 297 bp, Cicer arietinum
accgttgttccctgggtggtctagcctggaccaccgacagcaacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtatcattaccgtgaacgaagctcagtctcgtggtagcggtggtggaggcggccgtggtggcggtggatatggtggaggcggtggatatg

SEQ ID NO: 3149 - DNA, 133 bp, Cicer arietinum
actccataggaagagaagctttggctatagcttggtaaaccggcaagtcacaaaaaggcgacggactccgttaggcgtccttatggctatacatatgcatatatgtatgataatatatgtatgattttgttgt

SEQ ID NO: 3150 - DNA, 438 bp, Cicer arietinum
gtagcttaaagcttatagctagatatttatagatttttattatatggctacctttaccaaattatttgttactttatctattttttctctatttgcttgttctaccaatgcacaacttattgataatttttatggaaaaacttgtcctaaactccaaaccattgtgcgtaatgaaatgatcaaagctataaaagcagaagctagaatgggggcttcaatacttcgtttgttcttccatgattgctttgtcaatggatgcgatgcatcggtcttattggatgacactgccacctttaccggtgagaaaaatgctggacctaacaaaaattcagctagaggtttcgaagtgattgataccattaaaactaaagttgaagcttcttgcaatggcactgtctcttgtgctgatattctagcacttgcaactagagatggagt

SEQ ID NO: 3151 - DNA, 272 bp, Cicer arietinum
acagagcttacctggagaccgtggagtgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggggaggaatagttcccgctgacgggatgacctcttgagagtaaatgcgcctttgtgccgatg

SEQ ID NO: 3152 - DNA, 280 bp, Cicer arietinum
acgggaagtcgaggggcgcagagcccagaatgtcaaaggctcgcgaagccgtaatgtcaaggtgagaagaagccgcagatgtcacataggaaatggtgcccgaaggcgatgtcgagagctcgcggagctcagtgtcgttggagacacatgtcacgaagaaaggtcaactctctgaatccctttcttcaggcagctgttagggtcccgttagccccacagctgcttttgctgccattttagcctgcaaaaattctctaccctagcagagcgctaacagcgg

SEQ ID NO: 3153 - DNA, 429 bp, Cicer arietinum
actattgacttccctgagtttcttaacctcatggcaaggaaaatgaaggacactgactctgaggaggagctgaaagaagcgtttcgggtttttgacaaggatcaaaatggtttcatttctgctgctgagcttcgccatgtgatgaccaaccttggtgagaagctcacggatgaagaggttgatgagatgattcgagaagctgatgttgatggtgacggccaaataaactatgaggaattcgttaaggtgatgatggccaagtgatttctctaagttgagggggacaatgtttacttgtataacagtgctttgtagtagtcattgacctttcttcctacatttttatttcacggttaaatgttgattagtggtaagtccctactattggtggttgtggttgaatggtgtcttcttagtttgtcttgtaat

SEQ ID NO: 3154 - DNA, 229 bp, Cicer arietinum
cccgaggtttttccctgccgccgcgacagtcgactacgggctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgtacctgc

SEQ ID NO: 3155 - DNA, 269 bp, Cicer arietinum
aaagattctacccgccgctcaataggaattgcgtttcaaggtgtcccgcaaggctcatccgccttacgaggcccaccaacgacacgtgcctctggggggccaaggccccctactgctggtcggcgagcgaacgacgggcacacgcatcgcttctagcccggattctgacttagaggcgttcagtcataatccaacgcacggtagcttcgcgccactggcttttcaaccaagcgcgatgaccaattgtgcgaatcaacggttcctctcgt

SEQ ID NO: 3156 - DNA, 244 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcgg

SEQ ID NO: 3157 - DNA, 249 bp, Cicer arietinum
acagagcttacctggagaccgtggaacgaggcgactgccttgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaa

SEQ ID NO: 3158 - DNA, 224 bp, Cicer arietinum
gttttgcaggctatggatgggtgcagctataaagctgcggctggtggatctctttccaataccctagttgccctggcaaggcttggaaatcgctccgcccgagctcctgcaataaatgtggcaatggctggcagtgtggcgagcgatctattgggtggcttctacagagaaaaattaaggcgagcaaatgtgcaatttctttctgcgcctatcaaggatgcgac

SEQ ID NO: 3159 - DNA, 319 bp, Cicer arietinum; identical to SEQ ID NO: 2904

SEQ ID NO: 3160 - DNA, 264 bp, Cicer arietinum
gtcgcaaaaatggtttccctaaaactgcagaagaggctatcagcaagcgtcctgaaatgcggaagaggaaaggtttggcttgatcccaatgaagtcaatgaaatctccatggccaattctcgccaaaacataaggaagcttgttaaggatggttttatcatcaggaaacccaccaagattcactcccgttcacgtgctcgtcgtatgaaggaagctaagagaaaaggaagacactctggatatggtaagcgtaagggtacctgc

SEQ ID NO: 3161 - DNA, 251 bp, Cicer arietinum
actcgagcctcaggagacaaggcctcgtgaaattagtgtcctaacaactccaacactttgtgttcagttaaatactttatattatgcgatcaatcatctgaataaattggaagataacatttgggagcaatggacaaataaaaggtcgcaggaaaaactcttaagaaaatcctttgatgataagtccaaaaaggatacctttgatggaagtagaaaaatattaaatgctgctatggaacgtatttgcgagt

SEQ ID NO: 3162 - DNA, 103 bp, Cicer arietinum
tcgagcggccgcccgggcaggtacttaaactaagacacggatcttatgatataagattaaggtccttaaatttgattagtgaaaattgagatctaaattgaag

SEQ ID NO: 3163 - DNA, 353 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgt

SEQ ID NO: 3164 - DNA, 437 bp, Cicer arietinum
ctaataaaccttttgaagatggatcttgaagagtgggaatcaatttctgatgatggctattttgatttcaatgaagatggtgagaaaaaaaaattcttagcaaaagggtcagaaaatattttagacatggaggattatttgtatccatcatcaccaccaagaaaacacaaccaacttgtccctttacaaattccattggaaataaaaattggtaacacttcaaatgatgttgttttgttgaaagacatgacaaagaatcaatcttttgaggttgatcaagaagaaagtgtgtcacaagttttttttaagattaaggaaaatgaatttgttgacatgaaaattgaatcaccaaagtcaaatagtggaaaaggggttactagttcaccaagaatgattattgagaaagatgtgtttggtgaaaaagaagaggaatcaag

SEQ ID NO: 3165 - DNA, 270 bp, Cicer arietinum
acctctctacctggagattctctatgtggaactcagaatcaagctttttgtcatattggtggtgaagataaggtgtttgatgaaatttctgactcacggaattgcgagagacacattcgagtgcctgcaggggaaggctttcctctgtggtcttattataatggtgtagttgactttgatgatcttacaagaggtttgaatgaaggatttgaggtgaattatagtgtgaataaggaatgttcaaagtgtttgggaagtgaaaaaggagat

SEQ ID NO: 3166 - DNA, 174 bp, Cicer arietinum
acgactctgtccatggtcgatggaagcattttgaccttaaggttaaggactctaaaacccttctctttggtgagaagaccgttactgtttttggaactaggaaccctgaggagattccatggggtgaggttggagctgattatgttgttgagtcaactggtgttttcactgaca

SEQ ID NO: 3167 - DNA, 133 bp, Cicer arietinum
acttcaatcctgaatcggatgacagtttgcgacctgctagaaactttgatcatgagcctgtttttgatgggatgctatcgaactcaaggagcagcgactatcttactggaaaaatagaagcatctgagagctt

SEQ ID NO: 3168 - DNA, 222 bp, Cicer arietinum
acataacattaagagttatgttcttgttatgagttctacagagaatttaacagacaaaccaatgagagcagatcatacagtatacatttgtgatgcctactgagtatgggaagtcagattcccgaaggtgttctcgccgctgtatgtaacatacataaacccatcttcatccttcttgtcggcgtaaatggcagacatgattgctcctgtaggaggaaggac

SEQ ID NO: 3169 - DNA, 398 bp, Cicer arietinum
actacaccccaccgtatacgaacccgcagtgaaatttttttgtcgtttgattgggagaaagtgggccccactacctgcgattgtcgctacttttagcgtgtcggctttgatgcacgaggttgttttttattacattaaaagggaaaagcgcacgtgggaggcttgggaaccctcgtggaacgcaacgtgcttttttatattacatggggtgtgtttggctgttcaagttgggattaaaaaagctgttggggagaagttgaagttgccgaggatgatgtcgtggctgctcacagtggtgtttgtgttgtatacggcgttgtggttgtttgttccagcacttgtgcggtgtcgcgtttatgataaggcttcgagagagttgactgctttgaccgactttg

SEQ ID NO: 3170 - DNA, 325 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcgccttccctgacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttt

SEQ ID NO: 3171 - DNA, 396 bp, Cicer arietinum
aaaaattctttcttggcacgcactgttagtgcactgttaggagcgggattttctacgggctactcggccacacaatactgcggggacgccatcgtctccctaacagcagttttcagagaaggaattttggagagttcaccttctctgacaacacctttgtcggatctaatggcggcacctcagaaccagaacgccttatatatcggaggacggtgcccgtggcatcggtagcgacatccttccgatcaacgacgccgattgcgatgggtttttcccctttgagggcaagccgcaccgccggcctctgattccttcccaaggtttttccctgccgccacgacatacgactacgagctacaacttggttactggagattgtggactgcgtcagcagat

SEQ ID NO: 3172 - DNA, 113 bp, Cicer arietinum
actgtgcaccagtgtgttactttgaatcagtgactaggtgtgaatttttttgacatgcttaatattgcagctagttttggggatataagtgtgtttttttatttattttgttt

SEQ ID NO: 3173 - DNA, 120 bp, Cicer arietinum
acatctctattgcgaagtaaaccgttaatggccaaaaggacagtgaaccaatcaggcccagaaagtcattgaagaatggaaatagcatagctatcaaagcagtgactacaacatatgttg

SEQ ID NO: 3174 - DNA, 434 bp, Cicer arietinum
aaaaattctttcttggcacccactgttagtgcggtgctaggagcgggattttctacgggctatgcgactacacaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaat

SEQ ID NO: 3175 - DNA, 322 bp, Cicer arietinum
acagagcttacctagaggccgtggaaagaggcgaccacctcgtccacagagcagcgttctagccgctttgggtttttctcctgcgagggttttccccaaggatgcacggttctaggttgcagctactggcaatcttaggggtcatggatttcttgccttagggtatggaaagctacttgatctatctgtgcaagagaattctaggctggagagggacgagttcccgctgacgggatgccctcttgaaagtaatgcgcctttgtgccgatgatatgctggatgaactagatgggagacgctgctgggaggaagctctgcgagg

SEQ ID NO: 3176 - DNA, 416 bp, Cicer arietinum; identical to SEQ ID NO: 296

SEQ ID NO: 3177 - DNA, 174 bp, Cicer arietinum
acctttgatacagcagaagaagctgctttggcttatgataaagcagcttttaagctccgtggtgactttgctaggcttaactttcctaacctgaaacacacaggttcatgtgttgttggtggtgaatttggtgagtataagcctcttccttcttctgttgatgctaaacttcaa

SEQ ID NO: 3178 - DNA, 346 bp, Cicer arietinum
actgtgcagattcttggtgctgagaaggctctctttagggcactgaagactaagcatgctactccaaagtatggtctcatataccatgcatccttgattggtcaggctgctccaaagttcaaagggaaaatttctcggtcacttgctgcgaagactgctttggctatcaggtgtgatgcactgggagatgggcaagataacaccatgggactggagaacagagccaagcttgaagcacgattaagggcactagaaggcaaagaactaggtcgctttgccggttccgctaaagggaagcctaagatagaagcatatgacaaggatcttaagaaaggagctggcgcac

SEQ ID NO: 3179 - DNA, 320 bp, Cicer arietinum
acaattggaggaataggcaaagttggtggaattgctattggtggtttcacaattggaggaataggcaaagttggtggaattgttattggtggtattgaaattggtagtttcacaattggtggaataggtaaagttggagggactgtgatgggtggagttggagttgtcactggtggtttcacaattggttttttaactggtttgtgttttttaggtggttttcctccaccacaatagccacaaccaagaattggtgtggctgaggagatgaatagcatgcgaatgattatgtaagcatggaattttggtgttgatgagga

SEQ ID NO: 3180 - DNA, 319 bp, Cicer arietinum
  misc_feature (315)..(315): n is a, c, g, or t
acaagggcactgtctgcagagtgtgtgaagtatgtgaaattggtaagcatggaagtggtttgaagctgttcgcctagactgggtagagcattgtcgaataagatttaatgacgggagcgcatagttggaattgggagtttcgagtcaacgatgcacaaaaaggagccaggtagacgaggtggaaagtctagggctttaaaaaggttggacttggacgactggttgatagaacgatggcaaaggagtcatgtctttgtagttgcaacttagcctgattatacgcgagaagcacaagatcaaggaatcacgtttaangact

SEQ ID NO: 3181 - DNA, 288 bp, Cicer arietinum
acagatcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaact

SEQ ID NO: 3182 - DNA, 423 bp, Cicer arietinum
accgagatatgtcctttgagcaactacgcgatacatcacttccgtatgctgaaatccgttttgatggacaagtgtgtgtagcaaaggctgaaggtagtggaggagttttgaatttcaatacatgtgctgaacagttactctatgagattggagaccccagtgcttatgtgactcctgatgtagtcattgactttcatgatgtttcattccttccattatcaagctgtaaagttctctgttttggggcaaaagcatctactatatcgtttcctgataaacttttgcagttgattccaaaggattgtggatggaaaggatggggagagatatcttatggaggctatgaatgtgttgaacgtgctaaagcagctgaatatctggttagatcatggatggaagaaacatttcctggtcttaatcacc

SEQ ID NO: 3183 - DNA, 428 bp, Cicer arietinum
acttggtaagatgggagcacctccaaagagtgatgttccaattattacaccaaatgagctcactgaagctgatggcttgttgtttggttttccaacaagatttggaatgatggctgcacaattcaaatcatttttggatgcaactggaggcctatggaacaaacagtcacttgcaggaaagcctgctggcatcttttacagcactggttctcaaggaggtggccaagagactacaccgttgacatctattactcaacttgttcaccatggaatgatatttgtgccagttggatacacatttggagctggcatgtttgagatggagaaggtgaaaggtggttcaccttatggttcaggaacatatgcaggggatggctcaagacagcctagtgagttagaattggctcaagcttttcatcaggagaagt

SEQ ID NO: 3184 - DNA, 352 bp, Cicer arietinum
accttcgctggtgctgacggttctcgacagccctctgccaaggagctcgagcttgctcagatccagggagagaacttctaccagaccgttgccaagttcactggttgactgcatggtagcagccaagccaaggctgcgcctgaggtggcatcgaacaccaatacgcctgccgaggctgaaaaggataccactgctcccaattatgagaacaagggacctcaagagctcaaggaggttaaggagggaccttgtggactgccagccaagtgcgtagtccaatagacgagttgaacgataatggaacgcaatgcttataatcaataacaaatacaaataaatattcttataatct

SEQ ID NO: 3185 - DNA, 190 bp, Cicer arietinum; identical to SEQ ID NO: 1999

SEQ ID NO: 3186 - DNA, 258 bp, Cicer arietinum
acctctatacttcatcaaaacaataacgatctctttcataaagatactaatcttttgtttaatgtatcaatttaatacgatataataatcaaattttttaaatatatcatgatgtctctattattattaattctatattttaacagttaattttttaatttaaaatataaaataatttaaatatattaattatttatatatcatcatcatataaaacaaacgcattaaaaaaaggttaaacatcattttccaattttg

SEQ ID NO: 3187 - DNA, 346 bp, Cicer arietinum
actggtgcacctcgtttttcttatgcttgtgtgtttccctgaacttattatgccaacaggtgtttctatacgtgtttgttatcgggatgtggaactggagattccgcccgagataccctcctcacatgaacaccagactctcttacacagacggagtgaccctagacgagcttgacgaagaattcgacacatttccttccgcaaagagccctgatatagtgcggtggaggtatgatcggttaagaagtgtggctggaagggttcaaagcgtcgttggagatttagctactcaaggggagaggatccaatcacttgtgagctggcgcgatccgcgcgcgagttccat

SEQ ID NO: 3188 - DNA, 384 bp, Cicer arietinum
accttagcgtggtcgcggccgaggtacaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctga

SEQ ID NO: 3189 - DNA, 232 bp, Cicer arietinum
acacagggccagcgagaccaacagaagaagtagcggaaggtccggcatgaaccagaacaagcctgaaagcagaactattgttgttgaaaaagtgatccagagtccatttcagagcgtatgcactgtgctcactctcatcgattgcaaccaacatcactggttgtggcttctctgactcatctgaattttttgaactcgccattccaaaaacccaattactctcttttctctt

SEQ ID NO: 3190 - DNA, 295 bp, Cicer arietinum
gcaacgatcaccaaccattacgaaggaagactccgaaacgatcgatcaactaatacctttgaaaattcaagaaaacatcactaaattgtcataatggagttcggtaacgctggagtattgaacgaggatggtatccatgttgatatggatcgcctgaagaagggagaggtcaacctgggaacctcgattatggcggttactttcaaggatggtgtcattcttggtgcggattcgcgaacaacgaccggtgcctatatcgcaaaccgagtgacagacaagttgacgagagtacctg

SEQ ID NO: 3191 - DNA, 145 bp, Cicer arietinum; identical to SEQ ID NO: 1660

SEQ ID NO: 3192 - DNA, 373 bp, Cicer arietinum
actattggtgttatgcagtgctttggagagttccatggcagaaagactccatgatctagcaaggaactccattgattctgtgggcgtatcaggcggggggcaagatgatgcaggcccatctgcaggaacattctcatcaatgttctctatttgatgagccgagcatttagagacagaggtgttggagctcattgtaaagatgaatgaatattccaagtccctaaagcttcaataaccaaagacttagttacatatgatgagagaactgaggaccaacagttagatatttaaaagaaaatgtgatgttgtttcaaagtgcttgttatttaaaatgatgaagaaaaaaattaacttcaagtattcatagtgatga

SEQ ID NO: 3193 - DNA, 356 bp, Cicer arietinum
tgttgatgggccatcagccaaggactggagaggtggaagagctgcctcatttaacatcattcctagcagtaccggagctgctaaggctgttggcaaagtgcttcctgttttgaatggaaaattgaccggaatggcattccgtgtcccaactgttgatgtctcagttgttgaccttacagtgaagcttgagaaggccgctacctacgacgaaatcaaggctgctatcaaggaggagtctgagggcaagttgaaaggcattctcggatacactgaagatgatgtggtctccaccgacttcattggtgatactaggtcaagtatctttgatgccaaggctggaattgccttaaatgacc

SEQ ID NO: 3194 - DNA, 272 bp, Cicer arietinum
agattattgaggcacacatagttttactagccatgggattccttggtcctgagtcgaatattgcagagaagttgggtgtggagcgagacaacaggtcaaacttcaaggctgattatggtcgcttctcgaccaatgtgaatggggtgtttgcagcaggtgattgtcgccgcggtcagtcgttagttgtatgggctatttcagagggaaggcaagctgccgcacaagtcgacagctacctcacggaataagaccaagaccataatattgatggg

SEQ ID NO: 3195 - DNA, 436 bp, Cicer arietinum; identical to SEQ ID NO: 1093

SEQ ID NO: 3196 - DNA, 319 bp, Cicer arietinum
caaggatgcacggtcctaggttgcagctactggcgatcttaggggatcatggacttcctgcctcagggtatggaaagctacttgatctatctgtgcaagagaattctgggctggagaggaatagatcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggctagctacgggtagagaggtgccttttgggggaatgagt

SEQ ID NO: 3197 - DNA, 435 bp, Cicer arietinum; identical to SEQ ID NO: 2894

SEQ ID NO: 3198 - DNA, 260 bp, Cicer arietinum
accagtgccaacaacatcaacaaataagctattccttgatcaaccgatgatccgtcgctggtaggagcaggtgcaggtgcaagagattgagagtgaacagcggcggggagtgaaagagcgaaaatgagagtggcgagcatggccacaactccgaatccgaatgaatgtttcggtgccgccattttgcgtagataagaacgtaatgtgttttgatagacttgattatatttctttctctgcggcgtctctgtgaattgcgg

SEQ ID NO: 3199 - DNA, 434 bp, Cicer arietinum
gactctctctcaggtagccaaatgcctcgtcatctaattagtgacgcgcatgaatggattaacgagattcccactgtccctgcctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacattgtcaggtggggagtttggctggggcggcacatctgttaaaagataacgcaggtgtcctaagatgagctcaacgagaacagatatctcgtgtg

SEQ ID NO: 3200 - DNA, 365 bp, Cicer arietinum
cagaaacttgagtcttctatacacaagtctttcttttttagaccaatctctacttttcaaacacattaaaaaatgggttttcgtttacctagtatcatcagaagggctgcaaaccaagcatcttctaaaggcgtggatgtgccaaagggatatcttgcagtgtatgtaggagagaaaatgaagcggtttgtaatcccaatatcatatttgaatcaaacttcattccaggaattgttgaaccaagctgaggaacaattcggatatgagcatccaacgggtggtctcacaattccttgcagagaagacgttttcttagatattacttctcgtttgaatgtttgctgatctcttcggaagaaggagct

SEQ ID NO: 3201 - DNA, 352 bp, Cicer arietinum
ccgctcgcgagcgacgatggcacgatccacaacaccgacatccttaggtggtccaagcttatggttgatgccgccaacaaaattggtcgctctattacagttgctcccgaattcaagtccatgcttaaggatgcaggtttcatcgacatagtggagatcaagaagaagattcccatgaaccgctggccgaagcattcacgatacaaagagttagggacctggagttgctacatgcttcacagtagccttgaaggaatctcaatgggattgctgacgagacttggattgactgtggacgaagtgcatgtccttctggccatggtcagaagggacctcctcagtacctgcccgg

SEQ ID NO: 3202 - DNA, 459 bp, Cicer arietinum
actattgacttccctgagtttcttaacctcatggcaaggaaaatgaaggacactgactctgaggaggagctgaaagaagcgtttcgggtttttgacgaggatcaaaatggtttcatttctgctgctgagcttcgccatgtgatgaccaaccttggtgagaagctcacggatgaagaggttgatgagatgattcgagaagctgatgttgatggtgacggccaaataaactatgaggaattcgttaaggtgatgatggccaagtgatttctctaagttgagggggacaatgtttacttgtataacagtgctttgtagtagtcattgacctttcttcctacatttttatttcacggttaaatgttgattagtggtaagtccctactattggtggttgtggttgaatggtgtcttcttagtttgtcttgtaattttatccttaaaaaagttgtaatgttaatg

SEQ ID NO: 3203 - DNA, 434 bp, Cicer arietinum
cgggaccccacgccgtggaactttgaagatataaagaaccatgttgagaaatctgaccagggcgatgtagtcctcatcgacgtccgagaaccagtcgagcttttcgagacgggcaagatccccggtgcgatcaatattcctatcacatcggcagctcagagcctccacatctccgacgaggattttgaggacatgtatggcttccagagaccggcaaagaacaaagagcttgtgttttattgcaaagcaggagtgcgtgcaagggcggctgcgcaactggctcatcatgctggctggaacaagatcggcgactatgcaggcagctggctggactgggaagctcagaaaggaccagttgagaaggttaagaaaccatattgaacagacagagcttgatgaagacatccattggcagaatggttggtcaaataaaa

SEQ ID NO: 3204 - DNA, 435 bp, Cicer arietinum
acctgatcggtgggaattttataacgattgttttaaaagaggcgagaaacggcttctctgtgatattcagcgacggaaaattgtttcagcatctccgttgccgttgactgcgatttcgacgatgaagaagatcgtatcgccgtcgaactcaggggaggagcaggtgatttcatcgaactcgtcgccgtcgattgcgccagcggatcttttggacgagaacgagaggctgagaaaggagaacatgcaattgaagaaggaactagatgcaatgaaatcgctttgcaacaaaatattaaatcttatgtcgagttatggaaaattccaatcggaagaaagaaaagagtgctgttccacggcgacgaagacgcttaatttgctgccggcgaagcggtgcaacggtgaagatgcggcggcggaagatagaaatccgaagct

SEQ ID NO: 3205 - DNA, 286 bp, Cicer arietinum
ctcatcaatattgttctttttgcaaattgtgttgtgagtgattttatctttgtcttttgagaatatgtctggctgcaactgtggaagtagctgcaactgtggtgatagctgcaaatgcaacaagaggtctagtggattgaactatgccgaaggcggcgaaaccacagagacggtggttttgggcgttggtccgacgaagattcagttctagggagctgaaatgagtgttgcagctgaagatggtggctgcaagtgtggatcaagctgcacatgtgacccttgcaac

SEQ ID NO: 3206 - DNA, 389 bp, Cicer arietinum
agaaaaaagttaaacatcattttccaattttgcccctgagcttaacaccaagaaccctctccatcttagccaaaacaccttgattaggcacagctttaccattctcatattcctgaacaacttgagcacgttcgttaatctgttttgccaactcagcttgactcattttcttatccaaacgcgctttttgaatcgtgtgtcccacttccccaccaacccgctccaacgctgctggttcagccgcttcatctaatttcctcgcgtttaaaaccgaaccggcggttttcttgttcgaaccggcgtcgaattttttaaccgttaaaatttcggctccggttcggagagcttggttcactgcttttggatttcgaaggtcttgtgctttgggt

SEQ ID NO: 3207 - DNA, 302 bp, Cicer arietinum
acagatcttacctggagaccgtggaacgaggcgactgcctcgtccacagagcagcgttctagccgccttgggtttttccctgcgaggggtttccccaaggatgtatggtcctaggttgcagctactggcgatcttaggggatcatggatttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggagacgctgc

SEQ ID NO: 3208 - DNA, 173 bp, Cicer arietinum
acaggataccccgcttccttcaccatccagcataccaaggcacaaaaggcgctgtattttctcgagcccgtcacccgtcagcgggttcgggggcatacagcgccttttgtgccttggtatgctggatggtgaaggaagcggggtatcctgtacctcggccgcgaccacgctag

SEQ ID NO: 3209 - DNA, 411 bp, Cicer arietinum
acagagcttacctggagaccgtggaacggggcgattgcctcgtctacagagcagcgttctggccgccttgggtttttcccctggaagggttttccccaaggatgcacggtcctagggttgtagctactggcgatcttagggatcatggttctcctgcctttgggcgtggaaagccacctgatctatctgtgcaagagaattctaggctggagagggatagttcccgctgacgggatgacctcttgaaaataaagcgcctttgtaccgatgatatgctggatgaactagaccgaagcgttgctggaggggaagctctgctgagatcaattgtattgatgtccacgggacgtgcttcaccgacaactactgtagagctggctacgagtagagaggtgcctcttggaggtaatg

SEQ ID NO: 3210 - DNA, 176 bp, Cicer arietinum
cggccgaggttgaccttcaacaatgtcgaagagaggtcgcggtggttccgcggggaacaaattcaggatgtcactgggtctaccagtggcggcgacagtgaactgcgccgataacaccggagctaagaacctttacatcatttcggtgaaaggtatcaagggaaggcttaaccgtt

SEQ ID NO: 3211 - DNA, 371 bp, Cicer arietinum
actaccttgatcaagaactctaagatcttggtaaggaagcccattcaaggacaacaaaacgttgtggtggcagattgctcatcccacaaggacgtgcacgttggaatagttctccaaaactgctccatcatgctagacattgagctatatccttattggtttacagtgaagacttacttggcaaggccatggaagattttttcaagggcggtcttcattaacaattcttttgatgattttattcaatgagatagatatatgatatggaaaattaatggaacaaacactgaaaacatactttgctgagtttggcaaaaatatgtcatttccaaagatgaagctattagattcaccgctaaatcatggcttaa

SEQ ID NO: 3212 - DNA, 431 bp, Cicer arietinum
tgcttcatcaagatgctttataaatcatctatgaagtcattgaaaatggtaatggctaatttgataacaatgtttttgctaatagaggtgattgcgtgcgggttcgggttcggattcggggcagatggtgggttaaacatgaactactacttgatgagttgtccttttgttgaacctgttgttaagaatgtagtcaatagagctttggacaatgatcccacccttgcagctgctcttattagaatgcacttccatgactgcttcatacagggatgtgatgggtcagttcttattgactccactaaggataatacagcagaaaaagattcaccagcaaatttgagcctaagaggatttggaatcatagatgatatcaaagaagagcttgaaagacaatgccctggtgtggtttcatgtgctgatattcttgc

SEQ ID NO: 3213 - DNA, 302 bp, Cicer arietinum
acaaagcttacctagaggccgtggaaagaggcgaccacctcgtccacagagcagcgttctagccgctttgggtttttctcctgcgagggttttccccaaggatgcacggttctaggttgcagctactggcaatcttaggggtcatggatttcttgccttagggtatggaaagctacttgatctatctgcgcaagagaattctaggctggagagggacgagttcccgctgacgggatgccctcttgaaagtaatgcgcctttgtgccgatgatatgctggatgaactagatgggagacgctgc

SEQ ID NO: 3214 - DNA, 435 bp, Cicer arietinum
acagagcttacctggagaccgtggaatgaggcgactacctcgtccacagagcagcgttctggccgctttggggttttctcctgcaagggttttccccaaggatgcacggtcctaggttgcagctactggcgatcttaggggatcatggacttcctgcctcagggtatggaaagctacttgatctatcagtgcaagagaattctaggctggagaggaatagttcccgctgacgggatgacctcttgaaagtaaagcgcctttgtgccgatgatatgctggatgaactagatagaagcgttgctggagggaagctctgctgagatcagctgtattgatgtccaatgggacgtgcttcaccgacaactactgtagagctggctacgagtagagaggtgcctcttggaggtaatgagtacctcggccgacctcggccgc

SEQ ID NO: 3215 - DNA, 107 bp, Cicer arietinum
actaggtttaatcactattgcgacactgtcatcagtagggtaaaactaacctgtctcacgacggtctaaccccagctcacgttccctattggtgggtgagcaatcca

SEQ ID NO: 3216 - DNA, 385 bp, Cicer arietinum
tccgcacccaaccaccgaccttccactttccggcagcattttccggcaacccggcaccgtccttccttctttctcaatcgtttagttctgaaaaggaacagaagtggtaattgtgttcatttcaccagatatgaactcagttgtcagacgtttatcaagcttattcagacagtcaggttgcgcaactgaaccttttaatgcgcagcatcatcaactgcagcagcttcagccatgcagaggcatactagtgcaggtctataatggaaacctggaagcggtattggcattgatgcagcgtaagatgacatcaagtggaatcgagaggatgataaagcgtgaacagagattccatataaaaaactctggagaagcgtgttttagcccg

SEQ ID NO: 3217 - DNA, 299 bp, Cicer arietinum
acttgtcaactggaaagtcttcagaaaagactgacgtttttggatatggcgtgatgcttcttgaactaataactggacaaagggcttttgatctagcacgtcttgccaatgatgatgatgtcatgttgcttgattgggttaaaggacttctcaaagacaagaagttggaaacactggtagatgcagaattaaagggagattatgatgatgatgaggtagagcagttaattcaagtaggtttactatgcacacaagggtcccctatggaaagaccaaatatgtccgaggtggtgagaatg

SEQ ID NO: 3218 - DNA, 237 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggataggaatagttcccgctgacgggat

SEQ ID NO: 3219 - DNA, 384 bp, Cicer arietinum
gatttcgaggcggcatcgagcggccgcccgggcttgtacccgtttggcaaatgactcaaaggctgcaaagaagggtggtgggaggcagtttgatggtttgattgatgtttacaagaaaaccctcaaatctgatggcattgctggcctttatcgtggattcaacatctcgtgcgttggaattatagtgtatcgtggtctttactttggaatgtatgattctctgaaaccagttgttttggttggtgggatgcaggatagtttctttgctagtttccttttgggatgggcaatcacaattggtgctggtttggcttcttatcccattgatactgtgcgtagaaggatgatgatgacttctggagaagctgtaaagtacctcggccg

SEQ ID NO: 3220 - DNA, 352 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtgg

SEQ ID NO: 3221 - DNA, 436 bp, Cicer arietinum
acaaatgcgtcaaacttttaagctccccaatttctggaggaattgcatcctgtagtttattccacctcaaatttagtatcttaagacgctttaaccgaccaatttgaggaggaataggccctgtcaacttgttattgtggagatccagccgtgtaagatccaacaagctagtaacagcagtaggaaaaggcccaacaattgaaaccgcatacacctcaagctcagtcacaacacgataatcaccgacagtagaacaagtaacaccagaccaaggaggaagatcaccatcaccacaaggatcatctccaacccaagcatatactactctccaaccaagagaagctttaatctcattcaaagccttaacatcacgcttaagggtcttgcagtgtgcaagatcgaaaattgatataacgaaaatgaaggtgaaggaaag

SEQ ID NO: 3222 - DNA, 436 bp, Cicer arietinum
accttccggattagtgcttgggatgagtggagcttgggaagatgcgaaggattcctcagttagagtggaggcagaggccgtcgtgggagctgaggatacagtggttggaccagggactggcagaaaggataagggctcgatgcccatggagtgagagattgtagggccatctaggcgggccgagtcagagcctcctcttcaagtgaatgatcctttaccgattgtcactaaagtagcagactgttttgaggtcccggcgccgccgaagccccctatctcgtgggtggatctgacttctaaagagagcgatccatctatggatgttgatgaggatgaggttacctcgaagatggatgttgcgtcagacggaacttgtggagtgtgtggaggtcacccatgttattgtagttgctagagtatgatcagattagttttg

SEQ ID NO: 3223 - DNA, 272 bp, Cicer arietinum
acatacatatacatacccatacagaagaaaagtatttttttttacagaaaaaacaaaagaagcaaattatatattgtcttctccagcggttgattttggtttcttcactatcaaaacagggcacttcacattctgtgcgcagtgattgctcacgcttccaaggaaagccctcttgatgacaccatagccgtgacttcccatgtattttaatatcaacacccaatttttgaaccgcatgacatatcacgtccctcggatcgccattctctatc

SEQ ID NO: 3224 - DNA, 435 bp, Cicer arietinum
actgcccatagaccctcttcttctttgcagcctcggccgccgcccggaacacgaccgggcttcgacaatttgtctcgctggctgagaccattagacaaaaccgctgggtcgaaatggtctttctttctgccgtgtcgtttgctgttattttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttcatacttccagtattgagctct

SEQ ID NO: 3225 - DNA, 196 bp, Cicer arietinum
acagagcttacctggagaccgtggaacggggcaattgcctcgtctacagagcagcgttctggccgccttgggtttttcccctgcaaggggtttccccaaggatgcatagtcctagggttgcagctactggcgagcttagggatcatggttctcctgcctttgggcgtggaaagccacctgatctatctgtgcaaga

SEQ ID NO: 3226 - DNA, 291 bp, Cicer arietinum; identical to SEQ ID NO: 3132

SEQ ID NO: 3227 - DNA, 340 bp, Cicer arietinum
gcttgtcccaacacaaaacaactaaaaacccaaattcaaagaccttgaattgaatagtcctcttttgatcataatcattagtattcatctatgatcgatttggattcggttcagtccatacccgagttataaaacacatcttcatcgaattgacaaatcgaaatcgatggggaatatattcgtcaagaaacccaaggtgacggatgtcgatcgtgcaattcttgcactcaagacccagagacgtaaacttgcccaatatcaacaaaagcttgatgctattattgaagcagaaaagcaagctgcacgagacttgattcgtgaaaagaagaaagatagggcc

SEQ ID NO: 3228 - DNA, 435 bp, Cicer arietinum
acttcagctcagatactaggaatccaggcatgtcgaatgaggccgaaaacttctcaacatcagctttgaggtcttctatagctttgttgttcaccaatcccttgttgaaatccttcaaaagttttccatattccttttgaatatctaaagtgagaaccactgcgcggtgaaggaactctgcgatctgctcaaagtccttctcaaccaaacccctagaagtcatagctggggcaccaatccttactcctccaggagccaaggcactgctatcaccaaaaacagcattcttgttcacagtgatgttacatagatcacaaagtttttccaccttattgccggtcaagccaagagggcgaagatcccacaagacaagatgattttcagttcctccagtgacaaggctgtatcccttgctgatcaagtaatttccaagtg

SEQ ID NO: 3229 - DNA, 434 bp, Cicer arietinum
acaatcagccccccccagccaccggttttccggtgaaccatcatggctataacaaccaccaccttaaagcccaccaagattggtccaccggtctctttgattgcttctccgacatccaaagctgttgcataacatgttggtgtccatgcatcacctttgggcgaattgctgagattgttgacaagggaacaacttcatgtggtgtaagcgggggcctatacacattgatatgttgtttcacaggatgtggttgtttatactcatgcatataccgttctaagatgagacacgaatacatgttgaaggacactccttgttgtgattgcttagttcattattgctgtgaatcatgcgcattatgtcaagaatatcgcgagcttcaaaaccgtggatttaacatgcccattgggtggcatggaaatgttgcgcaaggg

SEQ ID NO: 3230 - DNA, 151 bp, Cicer arietinum
cggccgatttactaggttgaattactattgcgacactgtcatcagtagggtaaaactaacctgtctcacgacggtctaatcccagctcacgttccctattggtgggtgaacaatccaacacttggtgaattctgcttcacaatgataggaa

SEQ ID NO: 3231 - DNA, 439 bp, Cicer arietinum
accagaaccaccaaagttggttcgtatggctaatctctgtgttgttggtggtcatgcagtgaatggggttgcagagatacatagtgaaattgtcaaggatgatgtgttcaatgcattttataagttgtggcctgagaaattccaaaacaaaacaaatggtgtgaccccaaggagatggatcaggttctgtaatccagatttgagtaaaataataactcagtggataggcacagaagattgggtcctaaatactgaaaaactagctgaactgcggaagtttgcagataatgaggatctacaaaagcaatggagggaagcaaaaaggaataacaaggtgaaagttgcagcattcctcagagaaaaaacaggatattctgtcagtcctgatgcaatgtttgacatccaggtgaagagaatccatgaatacaaacgacaacta

SEQ ID NO: 3232 - DNA, 230 bp, Cicer arietinum
ctaatttccctcaattcctcaccaaatggaggtcaggttgttatagcagcctctctaactaaagaacagttggggaaatctgtccatcttgttaatttggagctcagcataacacacggtggtagtggggtggcagaagcattgttgaacgagatgtttggaaataatgtgctagaatcagaagagggtattagcctacacatcagtagaaagttgctaaagcttatgaa

SEQ ID NO: 3233 - DNA, 432 bp, Cicer arietinum
acatgatcggtcaacatcccggttccgatgacaattctcgtccaccttttctccgtcgaacccgccgcaacggaggtgaccggtcacctttcaatccggtgatcgtcctacgcggaagtggatcaacggaggtaacagaaggtggtagcacaggagagagtcgtgggtttgagcttttctatgatgatggtgctggttctggtcttagacctttaccaccaagtatgtcagagtttcttttggggtctggatttgatagactgttagaacaactttctcagattgaaatcaacggtattggaagatatgaacatccaccagcttcaaaaacagccgttgattcattaccaactattgaaatcaatgggtgtcatttggatatggaatcacactgtgcagtttgcaaagaggcttttcagttaggtacctgcc

SEQ ID NO: 3234 - DNA, 184 bp, Cicer arietinum
actgcaatggatgcatttgagaaaaaccgctcacaagacctaatcttcttagatttcactggataaggctcttcctgattaatgttccatagatatacattagagtcctcgccagccgataaaatatgtttcccgtccgaagtaaacgatgcacaccttgggcttcctgtgtaaagacttttgt

SEQ ID NO: 3235 - DNA, 352 bp, Cicer arietinum
tggctcgcttccctctttgcagctcggaagctgcttgaccgatctctgcagtcgcgtactgcccagagaccctcttcttctttgcagccccggctgctgcccggaacacaaccgggcttcgacaatttgtctcactggctgagaccactagacaaaaccgctgggtcgaaatggtacagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagcta

SEQ ID NO: 3236 - DNA, 288 bp, Cicer arietinum
acaaaaacattagcttcactgtttgggatgtcgggggtcaagacaagattcgtcccttgtggaggcactacttccagaacacccagggtcttatatttgttgtagacagcaatgacagggatagagttgttgaagccagagatgagttacataggatgttgaatgaggatgaacttagagatgcagtattgcttgtgtttgccaacaaacaagatcttcccaatgcaatgaatgctgctgagattactgacaagctgggtctccactctctcagacagcgccactggt

SEQ ID NO: 3237 - DNA, 437 bp, Cicer arietinum
acttgttgggtatccaagtatctcaaccaaatcaaggaatgttttagtaaatcaggttctgttccatcagcccagcagggtccgtagatcactgccaagtttcatgtgatgccaacgcaaccaatcggcagccccaacttaaaagagtgacacactcctaaacgctggttccctcattcttaccggcgtgagcctcagaatcaatggtagtctcagggttgttggcatagtcatcctcaccactgagctcctcaagagtcttacgggcagtctcagggataaggagagtagtgaagataccgagaagcatgaagagagcatagatctcgaggacgtggtccatccagggggcctcgttcttgtcggtggcaccgtgggtgcggaggatggagatggcaccctggcctatgatggaaccaatctttcctgaggcagcg

SEQ ID NO: 3238 - DNA, 196 bp, Cicer arietinum
acccctttactaagcaaggttcaggttgcgaatgacctgagtaaatccctcaacaatctccttcatgggagtagcgtagtcgggacggtgagcaaagacaacatcgacgtaaggctgctcaagacgcttgagagagctcttgagaccctcgacgacgtgcttgcggctgatacctcaagtgttgggctccttgcgg

SEQ ID NO: 3239 - DNA, 145 bp, Cicer arietinum
accagaggagcaccactgctatttcagttgttgcacccatatgctatgcacacttagctgcaactcaattggggcagttcatgaaatttgaagacaaatctgagacatcctcaagccatggtgggctgagtgctgcaggagctgt

SEQ ID NO: 3240 - DNA, 438 bp, Cicer arietinum
gcagtccgaaacccagcaaatatgaagatcatcgcggcgtatttgctggccgttttgggcggtaaagcagcccctacctctgatgatatcaaacacatcctcacttcagttggaattgaggccgaggatgagaagattgagttgctcttgggtgaagtcaagggaaaagattttgccgagctaattgctagtggaagagaaaagttgtcttcagtgccatctggtggaggtgctgttgctgtttctgctgcacctggtggaggtgctgcagcagctgctgcacctgctgctgaagccaaggaagaaaagaaggttgaagaaaaagaagaatctgatgatgacatgggcttcagtttgttcgactaaaaggtctgatctttttgccggaaaatttgcaattcctgttagagttgtagttgaaacacaacattttgttaa

SEQ ID NO: 3241 - DNA, 274 bp, Cicer arietinum
gatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaagcgcctttgtgccgatgatatgctggatgaactagatagaagcgttgctggatggaagctctgctgagatcagctgtattgatgtccaatgggacgtgcttcaccgacaactactgtaga

SEQ ID NO: 3242 - DNA, 378 bp, Cicer arietinum
aaaaattctttcttggcacccactgttagtgcggtgctaggagcgggattttctacgggctatgcgactacacaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccacgacagtcgactacgagctacaacttggttactggagattg

SEQ ID NO: 3243 - DNA, 353 bp, Cicer arietinum
actaaatcttcaatctttaactccaacactcgggtgttaatctatgatctcttttggggtcttgacaatagttataagcgagttgatatctttgcacccatctcatagctctatattgttgtgaggttaacccaccagaaccatatggcgaggctgaaactggatggcaccaaagaggagcaaaggctgtgcaaccactagctttaaaatttgcataccttgcaacaaaaggttgatatttgtaatcagctttgtattttccatcttcagttgcccatgatgatgcatcccatattgaaccataaagccacattggtcttataggaaatgttgcatcactcttcctcgggtac

SEQ ID NO: 3244 - DNA, 290 bp, Cicer arietinum
accgcaaggagatggacgaggccgccgccatgcctctgcctggtgagctttccgacgacgatctgtaaatgactcgtgtggttacggaatacttttgttgagggggatgctgccaaacatccaaggaacgatgcatgggcagtatttgaggatggcacataggcagccgaaacgaccatttatgagatacagggcgaaagtcctggagtttacagtagcgtgattatggggcggcacaaaagacaggccgtcatgcctttctttggggctcaagggacggtacctgcccg

SEQ ID NO: 3245 - DNA, 386 bp, Cicer arietinum
acgtgctattggattatgctccaggaactagcaatgataaagttttgtatgggccaagtcttgttcgtgatggatataaatcacttgctaagacaatatttggaacatatggaatagattgttccttcgatactgaatacaacgaggcattcatattttatgaaaacctttgtgctcgcatagactatgctccacattccgacaaagacaaaataatttcaggtcctaagaaaatcgctgacatgtttccttttttcaaaggaaccgtgtttgaaaatggaatagatgctgcatttagatcaactaagggaaaagaagtttacttattcaaagaagacaagtatgctcgtatagattatggcacaaatcgtctcgttcaaaatatc

SEQ ID NO: 3246 - DNA, 189 bp, Cicer arietinum
gccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtacgcccccgaacccgctgacgggtgacgggctcgagaaaatac

SEQ ID NO: 3247 - DNA, 296 bp, Cicer arietinum
cccattcgcgaattcggaaaaggggcgtatggtattgtttgctctgctcacaattcggagacaaatgaacatgtcgccatcaagaagattgcaaatgcatttgacaacaaaattgatgccaagaggacccttcgtgaaatcaagctgcttcgccatatggatcatgaaaacgtgctcgcaatcagggatatagtgccaccacctcagagggaggcatttaatgatgtttacattgcatatgagctaatggacactgacctacaccaaattattcgatcaaatcaagcactatccga

SEQ ID NO: 3248 - DNA, 422 bp, Cicer arietinum
cctgctaagctttacaaagctatgtcaatagatattcataaccttttcccaaaaattgtgccaattattgacagtgttcagttgactgaaggaactggtgaagctggcaccatcaagatactcaacataaaagaaggggaccaaatcaagcaagtgctgcacagagtggatgaaattgatgaaataaaatttatatacaatttcagcataattggaggcactggtttagctgacacattggaaaaagtgtcattcaagagccaattgtttgatgacgaaaatggaggaacaattaggaaagtacatgttgagtattttaccaaaggtgattatcaactcactgaggaggagctcaaagctggtaaagataaggttgaaggccttattaagatttgtgaagcttacctcttggctaattccta

SEQ ID NO: 3249 - DNA, 393 bp, Cicer arietinum
ctttggtcgaacaaagcaggtaatcttgcagccaaacagcgctttaaatcaggagaaacagcatgttcaccaatcatagtctccaacactgccgatgaaactgccttgttctcaataactgcatcctccttttctgggatacttgcatctttagagaaactaagccctaatactccatcaggtgattgcctataaaaaacagaggcaccaggtggaaaattcacattcttgaaggcttcagcaaatttttgcatagcttcaacttcttcatcgccataagttccaatagatttcaagtgtgccacacaattctccattaccttccttgagtactcaggaccactcagttcccgaatcttagaccctcgaattaacttttcaaatgggcctgaa

SEQ ID NO: 3250 - DNA, 269 bp, Cicer arietinum
caaaggcctcgcctttcgtcctcgccattcaagatgcaggcatcaaggttctgccctccatcttcaacgccgtcatcaccatctccgtcttgtccgtcgccaactcgtgtacctttggttcaacccgtaccatgcaggctatggccatgcgtggccatgcccccaagttcctgaactacattgatggcaagggccgtcctatctactgtgtcatcattcagcttgctttcggtctgctggcttatgtcggagagtctaagaagggcggc

SEQ ID NO: 3251 - DNA, 431 bp, Cicer arietinum
tggtgaaggagaagatcgccatttgattctggagagatgtctaggggcaggggtaccttcaatccttgtcagtgatatcctatggaagtatgatgatgaacctcaatctttgattgcatcacaccaaatattaaggagaaaagaagcctctcctgtttcgcagacaaataccgcatccattcagcagacactagaggaaagaaaagcatcttatttagctgctcgtgagcggattttttctatgagtttggaagatgccaaagagccggacgaacaaaagccacgaagcgtgccagtagttgcccgccgaatgattgcgcatgcactaggtcaaagaatcaatacaaagaatccaaatgagccagttagtgatagtatcaaggaaagagggctcgccgatgaaccaaatgctaaagataagaacagcggaa

SEQ ID NO: 3252 - DNA, 146 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatct

SEQ ID NO: 3253 - DNA, 362 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggt

SEQ ID NO: 3254 - DNA, 177 bp, Cicer arietinum
gtaaaacctctttcttggcacgcactgttagtgcactgttaggagcgggattttctacgggctactcggccacgcaatactgcggggacgccatcggctccctaacagcagttttcagagaaggaattttggagagttcaccttctctgacaacacctttgtcggatctaatggcgg

SEQ ID NO: 3255 - DNA, 381 bp, Cicer arietinum
acaggatacccctcttccttcaccatccagcataccaaggcacaaaaggcagtgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgtcgtggcggcagggaaaaacctcgggaagggatcagaggccggcggtgcggcttgccttcaaaggagaaaaacccatcgcaatcggcgtcgttgatcgggaggatgtcgctaccgatgccataggcatcgtcctccgatatctaaggcgttctggttctgaggtgccgccattagatccgacaa

SEQ ID NO: 3256 - DNA, 319 bp, Cicer arietinum
acggtcctaggttgcagctactggcgatcttaggggatcatggacttcctgcctcagggtatggaaagctacttgatttatccgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctatgagtagagaggtgcctcttgggggtaatgagtacctgccc

SEQ ID NO: 3257 - DNA, 155 bp, Cicer arietinum
acaaagatgatactttatggagaacaacatcagaggagaagagagagctggagcgccttcagaaaccattatataattcagttcgtcgagcagcagaagttcatcgtcaggttcggaaatatatgaaaggcattataaagcctggaatgatgatg

SEQ ID NO: 3258 - DNA, 434 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccagcctctgattccttcccaaggtttttccctgccgccacgacatacgactacgagctacaacttggttactggagattgtggactgcgtcagcagatgtagcgatgcgtgagagaattctggtcggtggaaaaag

SEQ ID NO: 3259 - DNA, 416 bp, Cicer arietinum
actcattacctccaagaggcacctctctactcgtagcccgctctacagtagttgtcggtgaagcacgtcccatggacatcaatacagttgatctcagcagagattccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggtaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctccaggtaagctctgt

SEQ ID NO: 3260 - DNA, 441 bp, Cicer arietinum
acacctatcggtgactgcaatagcatttcagcttctcggtctgttcctccggggaaaggcattgagtctcctcgtgccaaaattgttatgatcattgcggctactgttggtggtgtttctctcattttgattttggttcttttatattttatgaaacaacctcgggaggccgttggttcctttgcggacactgaaaatccatcccaagattcagacatctatttgcctccaaaggatggtttcacatttcaagacctacttgaagctacgaaaagatttcatgaaagttatgttatcggtagcggagcatgtggaacagtttataaagcagtgatgaaatctggtaaaaccattgctgttaagaagttagcatctaacagggaagggaacaacattgagaatagtttcagagccgaaatatcgactctaggaaggataagg

SEQ ID NO: 3261 - DNA, 318 bp, Cicer arietinum
gattctcggatccggtgacgacgtattcggtcattaaaccggagttgtcctcctgggaagcagcggatcgcgcaagaccaaaatcgcaaaccttgagatcacagttggcgttgaggaggaggttggagggcttcaagtctcggtgcagcacgttggctgagtgcatggctttgagggcgcggagggtctggtagatgaagtactggcagtggtcgtcagaaaggtcctgggtgcggatgactcggtgcatatccgtctccatcagctcctggatcaagtagacttcattaaatgactcgcactttcggggcttctgga

SEQ ID NO: 3262 - DNA, 486 bp, Cicer arietinum
gattctcggatcccgttacaacgtattcggtcataaaatctgtttcagaggtaacacgagccagtccaaaatcacaaatctttaagtcacagttggcgttcaggagaaggttgctcggttttaagtccctatgcagaacatttgcagaatgtatgtacttcaacccacgaaggatttggtacagaaaatactgacagtgctcctcggatagtgcttgatttgatcgaataatttggtgtaggtcagtgtccattagctcatatgcaatgtaaacatcattaaatacctccctctgaggtggtggcactatatccctgattgcgaccacgttttcatgatccatatggcgaagcagcttgatttcacgaagggtcctcttggcatcaattttgttgtcaaatgcatttgcaatcttcttgatggcgacatgttcatttgtctccgaattgtgagcagagcaaacaataccatacgccccttttccga

SEQ ID NO: 3263 - DNA, 345 bp, Cicer arietinum
actggctcaccgagcgcaccttcggcgagttctctcgcagcttcaacttccccactcgtgtcgaccaggacaacgtctctgccaagtttaaggacggtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgtaggcctggcttggtcattcgctccttgtacct

SEQ ID NO: 3264 - DNA, 242 bp, Cicer arietinum
gattctcggatccggtgacgacgtattcggtcatgaaaccggagttgtcctcctgggaagcagcggatcgcgcaagaccaaaatcgcaaaccttgagatcacagttggcgttgaggaggaggttggagggcttcaagtctcggtgcagcacgttggctgagtgcatggctttgagggcgcggagggtctggcagatgaagtactggcagtggtcgtcagaaaggtcctgtgtgcggatgact

SEQ ID NO: 3265 - DNA, 297 bp, Cicer arietinum
tccaagtgtgctcaccataacaatctttactataacttctttcgatttcttatcacagatcaaacaaaaatcattctcaagcagtactgaatatccagaattgagtaattgacccacactcaacaaattttgagccaaatttggcacatactgcacatcatataagagcttagtgtttctttgctcaggtttgatcgcaatcgtgcctcttccttccacttcaagttgctttccatctccaagcctctccttgctctttaaagattcattcagttctctgaacatgaggcctatcaa

SEQ ID NO: 3266 - DNA, 429 bp, Cicer arietinum
tggagcaatgtggaaaacaagctggtggtgcgttgtgccccggtggattatgctgcagcaaatttggttggtgtggttcaaccagtgactattgcggtgatggttgccagagtcaatgtggaagcggtggtggtggtgttggtagcatcatatcgagggacaccttcaaccacatgctgaagcatcgagacgatagtggttgtgaggggaaaggattctacacctacgaagctttcattgcagctgctaagtatttccctgatttgggtaataacggagatactgcaactaagaaaagagagattgcggctttcttgggacaaacatctcacgaaacgacaggtggatggtcaagtgcacctgatggtccatacgcttggggatattgctttttgagagaacagaacccaagtacatactgtcaaccaa

SEQ ID NO: 3267 - DNA, 381 bp, Cicer arietinum
tctccaatggatcctcgttaagggatttagattgtactcattccaattaccagactcaatgagcccggtattgttatttattgtcactacctccccgtgttaggattgggtaatttgcgcgcctgctgccttccttggatgtggtagccgtttctcaggctccctctccggaatcgaaccctaattctccgtcacccgtcaccaccatggtaggccactatcctaccatcgaaagttgatagggcagaaatttgaatgatgcgtcgccggcacaagggccgtgcgatccgacgagttatcatgaatcatcaaagcaacaggcagagcctgcgtcgaccttttatctaataaatgcatcccttccagaagtcggggtttgtt

SEQ ID NO: 3268 - DNA, 282 bp, Cicer arietinum
ttgcagatcacagtatcaacttgcttgattgctttaacaagagcttcatgatcattcatatcaccttcaagtagaataactcctgcagctttgaaactctgaagaagctcttccttgctttcagggttagcagcagcgacaagggaaggtttgtttatatcaccaggtgttttcctaatcaaagcataggttggatttcctgctttaatacttgcccatactacgtgtcttcctatggcacctgttggtccaaggaccaagatcctgttttgtgaggccata

SEQ ID NO: 3269 - DNA, 427 bp, Cicer arietinum
tcatcttttcaggcttcaatgctaacttttcctctacttgatctagaattgctggtccacctggatgtgcaatccaaaatattgaattgtaatcagatatgttcaatggttggaaagcttcaatcaaagctttatcaatgttctttgagacaatcccaggaacatctttaagaaggtgaaatgtgagtcctgcttcacgaaggtgaccatcaatagcaccttcactatctggagcaattgtttgtgcagtccaaaccatctcaaatattggtttctcaatttcaggaattggatcagatccaacaatcaatgcagcagctccatctccaaacaaagcttgtccaacaagactatccaaatgagtatcactaggaccacgaaatgtgactgcagtgacttcagaacaaacaaccaacacacgtgcacc

SEQ ID NO: 3270 - DNA, 167 bp, Cicer arietinum
aacaaagcaggtaatcttgcagccaaacagcgctttaaatcaggagaaacagcatgttcaccaatcatagtctccaacactgccgatgaaactgccttgttctcaataactgcatcctccttttctgggatacttgcatctttagagaaactaagccctaatactcc

SEQ ID NO: 3271 - DNA, 266 bp, Cicer arietinum
ttattctgcctttgcaatccacatctgttggaaagtgctgagagatgccaaaatggagcctccaatccagacactgtatttcctctctggtggtgctacaaccttgattttcatgctgctgggtgccaatgctgtaatctctttgctcattctatcagcaattccggggaacatagtagaaccaccactcaagacaatgttaccatacagatccttcctaatgtcgacatcacacttcatgatggagttaaatgttgtctcatgga

SEQ ID NO: 3272 - DNA, 336 bp, Cicer arietinum
actattacttcttcctctgatgagctactgcccgccctcactttcattgttttcctcactctcgcagcagcattaacattccaattctgttgttgaagtttcacaccgccgccaaatcccctcacaccgatggcgatactgttagggttagggttcagagctctaattcttgcttctgcgacatttgatgacagtgaaaaaagcggtgttgttgtaacattgaatgaagcagccgccatcagaattacaatcactatccaccggatggatggatgaatactcagtcagtctattctcgcgcgaccggatgctcacctctgctctacctgcccgggc

SEQ ID NO: 3273 - DNA, 268 bp, Cicer arietinum
acccgaagctccggcttataagaagctgtagtgctttattggcaccggttattctaggtcgtttagaggaaacatttggggctccagttttggaagcttatgcaatgacggaggcttctcatttaatgtcttcgaatcctttgccagaagatgggccccacaaagctgggtcggttgggaaacccgtgggtcaagaaatggttatattggatgagtcgggtcgggttatggaagtggaagttaagggtgaggtttgtattaagggtga

SEQ ID NO: 3274 - DNA, 419 bp, Cicer arietinum
aaattgttaaggtttgaaatctgaatctgatgaaatgaattcgaagattgaagaacaagaagaaacgattcgaaacgtgaaaatctgaaaacgaatctatttgacccgttttctgagtcgggtttgggtcacacgtgtttaattcgttttattttatttactttccagattttattatatttatataaatagggaaaaaaatctttaggttaagatagattttaagagaggttgtttgtttgtgttttaacgttttagtgagagaggattgttaccaaagaaaaatgaagaatctgaattcgtatgtgtttgatcatgctttgatcatttcattgttttcttttactactaattgttgtttttcgttttattttgtttgaacttttcaatgataaattattattgtggtttttgattgg

SEQ ID NO: 3275 - DNA, 263 bp, Cicer arietinum
aaaagaaaaaaaaaaattttaacatatcatcactaaatgatgttatcaaaacttaaaatgtggaataaactaggagtctctcctttcacctatttacctttacatcacatatatattaatgaataataaatctagcaacataccttattcccacaagttacaaagaatattacaagcatatttctgaccaaactaggctatcttgaataaccattagccagaacagggatcctcactttgtgtcctctacttcccttcatcaa

SEQ ID NO: 3276 - DNA, 341 bp, Cicer arietinum
tgatcctgtgcagaagctttgctctggtggttgtgataatactgtgaaggtgtggaagctcaacaacggacactggaaaatggactgcttccctgcacttcagatgcatacagattgggttcgagatgttgcttgggcaccgaatttgggacttcctaaatctaccattgctagtgcatcacaggatggtaaagtcatcatatggactgtaggcaaagaaagggatcattgggatggcaaggttttgaatgatttcaagacacctgtttggagggtttcatggtcattgacaggaaatatactggctgtagctgatggaaacaacaatgtgacattatgga

SEQ ID NO: 3277 - DNA, 409 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccactttgt

SEQ ID NO: 3278 - DNA, 407 bp, Cicer arietinum
acatggaaactggaaagaaataacaagctttacctaggcgcagagaatctccaatgtaaaatgtatcgctgtcatcgccaatgattccatgaatcacatttacagtagcacacagcaaaacccccagccactgtcttttattaattaatccgaaaacggcgtcatacattaaattacattgcacagcaataattgacaataaagttcacacctcacagactaaccaacttaagagaattagccttttcctgcagggtatccaggaggctttcaaagctcttcttaaatgaatcaactccttcaagttcaagctgggaaccaacagatctccaatcaatgcccaacttctggagagcattgtaaattcctccagcttcagatgcgtttgagtctatcgttctggctac

SEQ ID NO: 3279 - DNA, 158 bp, Cicer arietinum
atttcccatcctgtgagaactcaaattgcaacccgcacagtcacaaatgttgctaaggaagtagaaacctacgtgatgacagctagaatgcaaccagcaattgccattgaagtgaaccctccagcaataaccatcaaagctggtgcatcacgtaggtt

SEQ ID NO: 3280 - DNA, 406 bp, Cicer arietinum
actggtgctagtctccaactacataatccatgttaattggacaaaatattgacactactcaacttgcttgctttcagtgacgggaaggtagacaccttcagctgccaaccagacattgtcagggcgcttttcgcgaacaccacaaacctcctgctgtcccccagcaatccgactgtatttcttatcatgactatgtagatagcctgaagtgtcaatatgctgaagccgaaccctctgatcctgcttccaagtcttcccacttccttctattaaaagcctccaatagtccccggtgtcagattcagattctccaccaaagcagctgacctcaagattgcctgatgtaggagaagcatgcagatggctgtgtagccactttcttgtcctcatgtgctgtaatctaatg

SEQ ID NO: 3281 - DNA, 414 bp, Cicer arietinum
aggtacacaccagggccaattccagcaccatacttcactccttcacggaagactgacagaagcttttcatcagaacgggagttctcaatggtgataacatcagcatccatgtcaatgatggaatgaatgatgtcgttgaagttagagtagcacatgtgagtgtggatctgagtggaatcctgaacaccaacattggtgattctgaaggagtgaacagcccagtccaagtagtgagcatgctctgacttccttagtggtagcccctctctcaaggcagcctcatcaatttggataacaccaataccacccttctcaaggtcttctacttcatccttgatagccaaagcaatttgatagcaggtttcggatctaggctggtcaactctaacgaaggaccagttgagaatggtgaca

SEQ ID NO: 3282 - DNA, 446 bp, Cicer arietinum
tcaaaatttacaagaaaatcagctttctattcttggtctaatcctaaatccatgcctcttttgccattgaatgaggatcacgatgacggcgacgatgattattatgattataacgatgaagaagaaaaggttagaaaagtaccatctgcttcatcgtcttcttcttcctcttcattggctgaggataagaaacaagaagatgatcaagtggagtttcgtcaatcctatgctgctgaaatgaggcttagattgagaagtttcaagtcaaggagtttttctcttgcagatctgcaagaacatgatgatgaggaagatcatgatcgttaattaataattaacattaacatagactttttcttttattcttttttttttttgttaaataaattttttagtattcactactaagttactactactgaatattgaataacttgtatctttct

SEQ ID NO: 3283 - DNA, 410 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagattgccagtagctgcaaccctagaaccgtgcatccttggggaaaacccttgcaggagaaaaccccaaagcggccagaacgctgctctgtggacgaggtagtcgcctcattccacggtctccaggtaa

SEQ ID NO: 3284 - DNA, 410 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattcccttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctccaggtaa

SEQ ID NO: 3285 - DNA, 325 bp, Cicer arietinum
acgttgtagacgagcaaaatcaactaaagttgcagattaatgctcaaaattgtttacattgcaaggcttgtgatatcaaagatccaaagcaaaatattgagtggacagtgccggaaggaggtggaggtccgggatactcagtcatgtagatccaggaatcagtcatactgtggtccctgaagttacgacttccggaatgtaaaataagttgctaaggttcctcatcttaaacaacaacaagcatcttacactgttctgttagaaattatgtctgttcagtgtttttcgcattttaaatattctgtgtcattgtacctcggcccga

SEQ ID NO: 3286 - DNA, 291 bp, Cicer arietinum
ctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttgttttacttattccgtgaatcggaggcggggcgctgcccctctttttggatccaaggctgacttcggttggcca

SEQ ID NO: 3287 - DNA, 409 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgcctcgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccactttgt

SEQ ID NO: 3288 - DNA, 203 bp, Cicer arietinum
aggaaacactacaacttaagcttgaagctgcagagaataaaatctatgtagatgttggtttttggggaggcctgatccctgaaaatgcacttaataccagtattcttgaaggtctcttaaatgctggtgttctcggtgtaaagtcttttatgtgcccttcaggaattgatgactttcctatgactactattgaccatatcaag

SEQ ID NO: 3289 - DNA, 405 bp, Cicer arietinum
atcgactaaagcaatgaactaatgaagaaaacaaacaagacataaaggtaaaagaacataggaaaagacaccaaataaagaaaatgaataggcgcgttaccctgcaaaaatatcagattgaaaatgacccctaacagctgaaagtttatacttcactcatacttatcaagtttgaacatcacaattcacacggcaaccaaaacaacacttgaagaattgcatatacctaatgccccaatgttcatcttcagtcaaccgtcaaacatatcattctgccaaatacatcatcctcttgcctatgcttcatactgaatagcaaagaatctgatgatgttccctatccaccctatacaaagtctaccattatatattttgcatccaaattgaacagtaacataataagta

SEQ ID NO: 3290 - DNA, 400 bp, Cicer arietinum
actaccgtgtcgcccgcatttcgtgcacttcaggcgactctcagactgttatgaccctagatatcaacatcgagctctttccctgtgctgtttccgacactctgcacgtagttctgtctactactctctctctggacggaagcaaggaggacgagaagggctggcgagacgttggcaagggtggtgatgcgccagcgacagctgccgacctttatgactacgtgtgccatggaaagatctacaagttcgaggagacattcgatggaaataccatcaatgcctactgctctttcggcggtcttcttatgtcgcttcaaggccctatcaagaaactggctcccctccgtgtcgacaacgtctatctactcgtcaagaaataatcagaagcgcctaaacttgt

SEQ ID NO: 3291 - DNA, 289 bp, Cicer arietinum
actaaatactaattcctttagaacggtatatattctatactaattatttataaacatacaataggaagaaattaaaagccaaaattaaagtaactttaatatgcagttactataactttctatagtatattagcaactaattaactacaacgtaacgtttcctagcttaattagctagctagacatacaatcgatccctcaaccaaaaaatacaatggttgatggggaattttcgatcaatcgatctcttgtgtttttaacaataataatcaacatgctgcagggggat

SEQ ID NO: 3292 - DNA, 403 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagattgccagtagctgcaaccctagaaccgtgcatccttggggaaaacccttgcaggagaaaaccccaaagcggccagaacgctgctctgtggacgaggtagtcgcctcattccacggtctc

SEQ ID NO: 3293 - DNA, 117 bp, Cicer arietinum
acaagcttttttttttttttttttttttttttttttttaactagaacaggggaatatatttatttggtttgtcagatggtatgttatgtatatttttcgtccggggggccaaaggcc

SEQ ID NO: 3294 - DNA, 403 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtcca

SEQ ID NO: 3295 - DNA, 409 bp, Cicer arietinum
actggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatccaaaaagaggggcagcgccccgcctccgattcacggaataagtaaaataacgttaaaagtagtggtatttcactttcgctgtttccggctcccacttatcctacacctctcaagtcatttcacaaagtcggactagagtcaagctcaacagggtcttctttccccgctgattccgccaagcccgttcccttggctgtggtttcgctggatagtagacagggacagtgggaatc

SEQ ID NO: 3296 - DNA, 373 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaacccctcgcagggaaaaacccaaggcggctagaacgctgctctgtgg

SEQ ID NO: 3297 - DNA, 346 bp, Cicer arietinum
ggatgagaaatagagggaatcttaacccataattaacgagttagcaaggaaccatctcccaagaaaaacaaagggaaagaaagatattaacacaaatgaaggatttggcaatagatacagcagagatgaaagatgaaagaacaacaacaaataaataagtaaagaagcatggtcaagattgaacattcaaaatttcaatgctatagcatcaaacctcataaccaggatttactttttgatgtatatctccataactttccaactcttccatgtcttccaaactccctaaaaagagaggaagtctttggtgcagtttaactggttgaagtgaaagaatcctactttt

SEQ ID NO: 3298 - DNA, 402 bp, Cicer arietinum
acttgtgagacaagtaagaagctcatgaaggttcatagctttgttgctagaagcatgttctgatatttttttcatgaattgagttacctcaaattttctaactgagtaatacattgagacacgttttacactaagaaaacggatgaatgagaattttttggtgtgtctccaatattctctatatggtgcaaatacttggtctaatccattatatgagaatttcatatggctggttaaagcgggtcggttacaaaattcgatatcgtgtgttttcattacttctttggccattttagctgatgaaacaacaagtgtttgtcttgaaccaagtttaaggaagactaaagagccatatttctttgagagttcatggaagtctacaccaagaactgaactgtcaag

SEQ ID NO: 3299 - DNA, 256 bp, Cicer arietinum
ctacatactaattcctttagaacgggatatattctatactaattatttataaacatacaataggaagaaattaaaagccaaaattaaagtaactttaatatgcagttactataactttctatagtatattagcaactaattaactacaacgtaacgtttcctagcttaattagctagctagacatacaatcgatccctcaaccaaaaaatacaatggttgatggggaattttcgatcaatcgatctcttgtgtttt

SEQ ID NO: 3300 - DNA, 453 bp, Cicer arietinum
acatggattgagaaatgcatagctattttgataaatttaactacttctgaagttggaagggaggaaatggtatcaactcctggattcattagcgctttggcttcaatattggacaccgatgagctccttgtgcaggagcaagctgtctattgtctcctaattttgtgcaacagtagtgagcaatgttctgacatggttcttcaagaaggggttataccagcgttggtatccatatcagtgaatgggaccccaagagggagagaaaaagctcagaaactcttgatgctgttccgacagcagcgacgagatgattcacctgttgaggaacatcaatgtcctcctgaaaccagtgatttgtctatgccgcctgctgaaatgaaacctccatgtaagtctatgtctagaagaaagactgggaaaggttttagcttattctggagaagcaaaagctat

SEQ ID NO: 3301 - DNA, 297 bp, Cicer arietinum
tgatcaggtgttcacgcgagtcgcttattgctatttccaacacttcaccagataagattctggattcaaattctgtgtccgagagcaagaaatcagatgggggtgtgttgccaaactgtgatcaggatgaacagtttaggtctgaactgatttcaatttcatattctgaatcacctgatgtcaagattggatcaatttcaatgggagtgtaggctacttctataattgtccctagtaattaatgtgtaactcttggattttaatttggttgaactttgtctatgtcagttttgccac

SEQ ID NO: 3302 - DNA, 351 bp, Cicer arietinum
  misc_feature (350)..(351): n is a, c, g, or t
actatcgatgggatttagttacctacaagctattgaggcatacagcatatttggggatgatgttgattctatggtttgttacctgttggaaactggcagcagtagtagacggaaaggaaaggctactgagtgacaagagaacaagttccgataaaataaaatttggaacgttagtattcaattgtcatccaagtcaaataaatcaatatcttgtatttacttgctctagtatattttcgtatctcacgtctttactaatgtggtagaaaacaaatttgagcaaatatatgatttagtttgctagtgcaatccgaagttgataaataatgagattttcgcaacatttttcnn

SEQ ID NO: 3303 - DNA, 120 bp, Cicer arietinum
acagacttcaaaataataattattcgggaggggaattctagaccttggattaatgtttaaaagtcatatgaaattctaacaattgatgacacattcggaagtataattttaaatatgatg

SEQ ID NO: 3304 - DNA, 407 bp, Cicer arietinum
  misc_feature (75)..(75): n is a, c, g, or t
gatttcgaggccggccgcccgggcaggtacaagtccgggctctcttatcctcgcatgcaaaacaacaacaccggngtgaacagcagatatgatatatgaagcctggggaatacaggcgtcacgacgtcatcaacttgtcgccagactctgccgcctctgtttgggggggtattatgtcacgaggtcggtggcgagtcggcttggtgtcgagtgagaggaggcatatgctacactcacttgatctcaagaagtttgacatcgaagatcaatgtgctattggcgggaatgccaggaaggccacgggagccgtaggcaagatgagcggggatagtgagacggcgctcaccaccaatagccatgccaataacaccaatgtcccagcccttgatcacttgtcccttgccagc

SEQ ID NO: 3305 - DNA, 460 bp, Cicer arietinum
ggtgctttctgccgcagcaagcgatcgcaaccaacggggagaggattctgcacagaaattcatcgtcacaatcatgggtaaggttcacggttcacttgctcgtgccggaaaagtgagaggccaaacaccaaaagtggccaagcaggacaagaagaagaagccacgtggccgtgctcacaagcgtatgcagtactaggactctctgtgtttatgatgaagccgaacgaggtgcatagtgactctgacacagagtcatttgagttactcaacgatattgactggactaatctatgtgatccaatgtcagcagtagatattgccggggatactagtgccagtcagtttatgcagaatggaggaagtattagcttctccggaacagtttgtgaagcgggatataatgctgccaagatgatcttgctcgagtttgcgagcttactagaagaggttgggaagtgga

SEQ ID NO: 3306 - DNA, 135 bp, Cicer arietinum
ggatgaggccacctcaattgtagctcctgctactctctacaaagctctagttacagatgctgacaaccttactccaaaggttattgatgccattaagagtgttgaaattgttgaaggaaatggtggccctggaac

SEQ ID NO: 3307 - DNA, 297 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtgggtatg

SEQ ID NO: 3308 - DNA, 364 bp, Cicer arietinum
acatatatggtggaaatcacaatggtcgttaccttagtgatcttcatgttttggatttgagaagttggacttggtcaaaggtcgaggctaaggctggagatgagtcccctacaactttgaacccttgtgctggccattctttgattgcatggggaaataagctcctgtcaattgctggtcacacaaaagatccttccgaaagtatccaagcaaaagagtttgatctacaaacagcaacatggtcaactctaaagacttatgggaaagctccgatatcacgaggaggccaatcattgacccttgttgggaatagcttattaatttttggtgggcaagatgcaaagaggactctattgaatgacct

SEQ ID NO: 3309 - DNA, 465 bp, Cicer arietinum
caggtatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacattgtcaggtggggagtttg

SEQ ID NO: 3310 - DNA, 208 bp, Cicer arietinum
tcgcatgctcccggttccccatggcggccgcgggaattcgattcacggaataagtaaaataacgttaaaagtagtggcatttcactttcgctgtttccagctcccacttatcctacacctctcaagtcatttcacaaagtcggactagagtcaagctcaacagggccttctttccccgctgattccgccaagcccgttcccttggctg

SEQ ID NO: 3311 - DNA, 367 bp, Cicer arietinum
accacagcctagggcaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacattgtcaggtggggagtttggctggggcggcacatctgttaaaagataacgcaggtgtcctaagatgagcctcacgagaacagaaatctcgtgtggaacaaaagggtacaagctcgtttgattct

SEQ ID NO: 3312 - DNA, 374 bp, Cicer arietinum
accttcaccacaaggggacttccttgtagtgatgttaagaactttagtaggcatcctgacaggtcccttaaccctaagatgcttgtccttggcaccgcgaaccaagtcagcacaaaccttctcgagatttttgacgtgtttcgaggagagggttatcctaatcttgtggatctgctcctgagactcttccaaaccaacctttgtgggtttcataccagcatacgccattgttcagatttcaacgattgtttgttacgagacgagaaacgatgcgatgcttccgtgctggaaactgccgtcagtggtggcgactcgtaacgaagctaagcaatccagaaagtttttccacagcaattgaaggttgtgttgggata

SEQ ID NO: 3313 - DNA, 316 bp, Cicer arietinum
acatgaaaggggagataccggggaggttgatgttctcacaaaaggagataacaactatggggatgacaggctactgtatgctcatggtcagctatggctgaatagacaccacattatgggtagagctgttgggttcttgccttatgttggctgggtgacaattatcatgactgaaaaacctatcatcaagtatattctcattggtgctttggggctgctggtgataacttcaaaagagtaaatgatgatgaatctaaatcaaactaaatgggtctggcctccaagagcactatgagcacatgtcatgctttttttg

SEQ ID NO: 3314 - DNA, 194 bp, Cicer arietinum
actcattacccccaagaggcacctctctactcgtagctcgccctacagtagttgtcggtgaagcacgtcccattggacatcaatacagttgatcctcgcagagcttccctccagcagcgtctcccatctagttcatccagcatatcatcggcacaaaggcgcatttactttcaagaggccatcccgtcagcggg

SEQ ID NO: 3315 - DNA, 297 bp, Cicer arietinum
tggtggtgatgttacgcttttgattcatgaaggtgttaaggctgaagagctttttgagaaaactggtgaggttcctgatccttcttctactgataacgctgagtttcagatcgtgcttagtattattagagagggtttgaaaactgatcctcaaaggtatcgtaagatgaagcaaaggcttgttggtgtttctgaagagacaactactggtgttaagaggctttatcagatgcaggctaatggaactcttttgttccctgctattaatgtcaacgactctgtcaccaagagcaagtt

SEQ ID NO: 3316 - DNA, 450 bp, Cicer arietinum
agaatggctacaagtgaaggaggcgatgaacacaaaaaccctgcttttgacccggatttggatacaccagaaaacccggatcacgagtttggtgagttcggtgcgggttgtttctggggtgtggaattggcctttcaacgagttgtgggagtggtgaaaacagaggttggatattcacaaggtcacacaccagatcctaactacaaactggtctgcaccggatccaccaaccacgtggaagtggttcgggttcaatttgacccgaaaatttgtccatacacaaatctcttggatctcttttggtcacgacatgaccccactaccctcaatcgtcagagagaagatgtgggtgcacaatatagatcaggagtatactacttcaatgaaacccaagctcgtttagcccaagaatcagaagaagctaaacaattggaacacaaggacaagatt

SEQ ID NO: 3317 - DNA, 302 bp, Cicer arietinum
actaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtacctcggcc

SEQ ID NO: 3318 - DNA, 459 bp, Cicer arietinum
caattacacaaaaaaactaatcgcacttcgaaaccatgacaggaaaagcgaagccaaagaagcatacggcgaaggagatccaggcaaaggtcgacgcagccacgacaaatcgcggcggcggaaaagccggtttgcttgatcgaacgggtcttgaaaaaggaggacacgccaagtgggagtgccctcactgcaaaacgacagcacctgatgtgaaatcgatgcagattcatcacgatgctcgtcatccaaagatcccttttgaggaagaaaagcttgttaatcgtcacgcttctcttgttcctgaatcttccaagcctcgtcctggtgttcgtggtagcctcaaaaaatgatctcgatcataatcatcatcgctccttcattcacggcttttactataagttctattttgtattttttttcttatcaagtgctctttttggagggttattgaataattgg

SEQ ID NO: 3319 - DNA, 307 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaaac

SEQ ID NO: 3320 - DNA, 232 bp, Cicer arietinum
accacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgg

SEQ ID NO: 3321 - DNA, 369 bp, Cicer arietinum
actattatttaacagcagaacagactgctttacaactgtcaaaataaataaaaagctaaaatacataacagcttaaagaaattagagaaaaaaaaacacaataacaatcttatcaccatataatagaaaaattaacgccttttctttcctgaagacaaaacgcggaaactttgcttcccttttttctctttcgatgtatcttccttccatcactttctttattttcatatattcttcataatctttcatagagagctatggtaataaaccactgttattgtttactatctaatagtggtaaggaggaggaggtgaggaatagaggtaaggcttcttggctggagttggtggtggagagtggtaaactgg

SEQ ID NO: 3322 - DNA, 342 bp, Cicer arietinum
  misc_feature (168)..(168): n is a, c, g, or t
  misc_feature (170)..(170): n is a, c, g, or t
acaaaatgacaccttcaagttcaaaaaaagcatgacatgtgctcatagtgctcttggaggccagacccatttagtttgatttagattcatcatcatttactcttttgaagttatcaccagcagccccaaagcaccaatgagaatatacttgatgataggtttttcagncntgataattgtcacccagccaacataaggcaagaacccaacagctctacccataatgtggtgtctattcagccatagctgaccatgagcatacagtagcctgtcatccccatagttgttatctccttttgtgagaacatcaacctccccggtatctcccctttcatgtacctc

SEQ ID NO: 3323 - DNA, 296 bp, Cicer arietinum
accaacctcatcttatagctccagaacaaggatatcgccgtctcattgaatccactctaattactatcaggggccctgccgaggcagctgttgatgcggttcattctctattaaaggacctggttcacaaagctgtcagtgagactctggacttgaagcaatatcctggtctccgagctgaggttggggctgcagctattgattcgcttgaaagaatgagagacgaaagcaaaaaggcaacactacaactggttgatatggagagtggctatctgactgttgatttctttcggaag

SEQ ID NO: 3324 - DNA, 150 bp, Cicer arietinum
acaatatttggtgttctatatattcttcttggaaagcgggtctggtttttccctaacatccttgccgaggaagcaacactgcgagagctgttcagattttggccaaagaaagatgaagaggaaagacctaagtggacgacgaggattttc

SEQ ID NO: 3325 - DNA, 404 bp, Cicer arietinum; identical to SEQ ID NO: 469

SEQ ID NO: 3326 - DNA, 372 bp, Cicer arietinum
caaattaaccctcctcatggtttgtgccttgagaaaattggtaatggatcttatctcaatatggttgctcatccagatggatcgaaccgcgcgtttttctctagtcaaatgggaaaagtttggttggcgagtataccggaagaaggatcgggaggacaattggagcttgatgaatcaagtccatttgttgatctgactgatcaagtttattttgatacacaatttggaatgatggggatgtcatttcatccaaatttcgcaaacaacggtcgattcttcgcttcgtttaactgtaataaagataaatggtctggatgcaatggtatatgttcttgtaattcaaatgttaattgtgatccatcaaaactaggt

SEQ ID NO: 3327 - DNA, 265 bp, Cicer arietinum
accataaccaaagaaacatggaaaacattataatctagtttcaatgctcaacaaaacaaccacgaagaaactaaacactgtcctttaaatggcccccctataaatagctagcagacccttcacaagggtgcaatgtgatgatgataaagaagaaactactctttcttggtgtagtttcggacaacaaaggctaaccccaatatcaggagaggcaccaggaattgcaaaatcttgatcacaaattccgaagtcttgtcgggattgt

SEQ ID NO: 3328 - DNA, 347 bp, Cicer arietinum
acggctgcgggggcgctgagcagcagagcctttctttggtggccttgctatcctcctggtggcgataaggattacatccttgccgctaaatttcttctcaagctccctaacaagcctgacgtgaattttgcggaaccctttcctcaaacggtaaggaacatgggcaaccacagccttacggcttccagaaacatcgatttgagctgctgaatttatgtataaatctttcagctcacttttcagctcatggttggtattttctaggtcaaaaagcgcctgtgcaactttttcctcaaattcggttggctcagcacccttgtctttactgattttcttccttgaagtgt

SEQ ID NO: 3329 - DNA, 337 bp, Cicer arietinum
acaaaatgacaccttcaagttcaaaaaaagcatgacatgtgctcatagtgctcttggaggccagacccatttagtttgatttagattcatcatcatttactcttttgaagttatcaccagcagccccaaagcaccaatgagaatatacttgatgataggtttttcagtcatgataattgtcacccagccaacataaggcaagaacccaacagctctacccataatgtggtgtctattcagccatagctgaccatgagcatacagtagcctgtcatccccatagttgttatctccttttgtgagaacatcaacctccccggtatctcccctttcatgt

SEQ ID NO: 3330 - DNA, 141 bp, Cicer arietinum
aatggcggtacctcagaaccagaacgccttagatatcggaggacaatgcctatggcatcggtagcgacatcctcccgatcaacgacgccgattgcgatgggtttttctcctttgaaggcaagccgcaccgccggcctctga

SEQ ID NO: 3331 - DNA, 376 bp, Cicer arietinum
acgacacaagaatcttcttagtctacgtggctattgtgctgaaggccaggaacggctaattgtatatgactatatgccaaacttgagcctgctctctcaccttcatggacagcactcggcagaaagcctccttgattggaatcgacggataaatattgcaattgggtctgccgaaggaattgtatatcttcacaaccaagcaacaccgcatatcatccacagggatgttaaggcaagcaatgtgttgttagattcagagttccaagcacgtgttgccgatttcggtttcgcaaagttgatccctgatggggcgacacgtgtgactacaagagttaagggcacccttggctacctcgcacctgaatatgctatgtta

SEQ ID NO: 3332 - DNA, 241 bp, Cicer arietinum
acctgaaatgtgctcaccagcaatgaagaatgcatggggagaagcttatgatcagttggctgatgcaatcaaaactgaaatgaaagcttcctcttaaactctctttcaactttatatagttcctttcttcccaaattgaataagattgacataaagtatgatttttgggtctgtattttttaattgtctgaatgcaatataatactgaatatatgtatttggtggtatgaatatgaacaat

SEQ ID NO: 3333 - DNA, 342 bp, Cicer arietinum
acgagcttgattcgttgacgaggaagcacgtgacgattgcgttgtgttacacaacgacgccggatagactccggcgaaggtttcctcacttggagtcgttgaagttgaaagggaaacctagggcggcgatgtttaacttgataccggagaattggggagggtttgttactccttgggtgaaagagatttccaagtattttgattgtttgaaatcgttgcactttcgtcgtatgattgtaactgattctgatcttcagattcttgctcgttcgcgatgtaatagtcttcatgctcttaagttagagaagtgttctggattctccactgatggactttactatg

SEQ ID NO: 3334 - DNA, 320 bp, Cicer arietinum
gcgggattttctacgggctactcggccacacaatactgcggggacgccatcggctccctaacagcagttttcagagaaggaattttggagagttcaccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaact

SEQ ID NO: 3335 - DNA, 349 bp, Cicer arietinum
acaaattgttggtgatgatctcttagttaccaaccccaagagggttcagaaggcaattgattcaaaagcatgcaatgctcttctgctcaaggtcaaccaaattggatctgtgactgagagtatcgaagccgtgaggatgtccaaaaaggctggatggggtgtcatgaccagccaccgaagtggagagactgaggataccttcattgctgatcttgctgttggtttggcaacgggccaaattaagacaggagctccatgcaggtcagagcgtctcgctaagtataaccagctcttgagaattgaggaggagcttggtgctgaagcagtgtatgctggaacaaacttccgt

SEQ ID NO: 3336 - DNA, 421 bp, Cicer arietinum
taccatggtcccgcccgaggtgctacttggtaataatatcttatttctcacactaacaatattcttaattcatcatcatgggtgttttcagttttgaggatgaagccacctcaattgtagctcctgctactctctacaaaactctagttacagatgctgacaaccttactccaaaggttattgatgccattaagagagttgaaattgttgaacgaaacggcggccctgcaaccatcaggaaattcactttcgactaagagggacaaaccaagtttgtgttgcacaaagtgggcgcaataaatgatgctaattggggttaccactacagcatatttggaggtgctgggcttccagacaccgttgatcaaatctcatttgaggctaaattgattgcaagcccaaatggaggatccattgcaaa

SEQ ID NO: 3337 - DNA, 274 bp, Cicer arietinum
ctcccggttcccatggcggacgagggaattcgatttcgagcggccgcccgggcaggtacacacttgactcccaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttga

SEQ ID NO: 3338 - DNA, 183 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgat

SEQ ID NO: 3339 - DNA, 325 bp, Cicer arietinum
acagagcttacctggagaccgtggaacgaggcgactgcctcgtccacagagcagcgttctagccgccttgggtttttccctgtgaggggtttccccaaggatgtatggttctagggttgcagctactggcgatcttaggggatcatggacttcctgcctcagggtatggaaagctacttgatctatctgtgcaggagaattctaggctggagaggaatagttcccgctgacgggatgacctcttgaaagtaaatgcgcctttgtgccgatgatatgctggatgaactagacggaatcgcagttgcatggggatatgtcctgaatc

SEQ ID NO: 3340 - DNA, 445 bp, Cicer arietinum
acatggattgagaaatgcatagctattttgataaatttaactacttctgaagttggaagggaggaaatggtatcaactcctggattcattagcgctttggcttcaatattggacaccgatgagctccttgtgcaggagcaagctgtctattgtctcctaattttgtgcaacagtagtgagcaatgttctgacatggttcttcaagaaggggttataccagcgttggtatccatatcagtgaatgggaccccaagagggagagaaaaagctcagaaactcttgatgctgttccgacagcagcgacgagatgattcacctgttgaggaacatcaatgtcctcctgaaaccagtgatttgtctatgccgcctgctgaaatgaaacctccatgtaagtctatgtctagaagaaagactgggaaaggttttagcttattctggagaagca

SEQ ID NO: 3341 - DNA, 400 bp, Cicer arietinum
  misc_feature (127)..(127): n is a, c, g, or t
  misc_feature (174)..(174): n is a, c, g, or t
  misc_feature (204)..(204): n is a, c, g, or t
  misc_feature (224)..(224): n is a, c, g, or t
attgaatccgactgtttaattaaaacaaagcattgcgatggtccctgcggatgttgacgcaatgtgatttctgcccagtgctctgaatgtcaaagtgaagaaattcaaccaagcgcggttaaacggngggagtaactatgactctcttaaggtagccaaatggctcgtcatctnattagtgacgcgcatgaatggattaatganattcccactgtccctgtctnctatccagggaaacacagccaagggaacgtgcttggcggaatcatcggggaaagaagaccctgttgagcttgactctagtccgactttgtgaaatgaactggagaggtgtaggtttagtgtgagctggaaaacagcgaaggtgaaataccactacttttaacgttagtttacttat

SEQ ID NO: 3342 - DNA, 399 bp, Cicer arietinum
acatcaacttgtaaataaaacaaggtatatcaattccacaaaattctcattatgaagtcacttattgattagtgtagtgacaattccaaatataactgttacacaacaacaacaacaacaacaaactcttttatttgagcatatacaccttcaaatccattcgagccagacccagaaaggaaagttttgcaacaggcctactggttgaatattgcaagtagcacaaatccttcaccaagaccagcaatgagtatagaagtgtctaagatgaaactgtgtcacgattgtgtctcagagaattttcaagttgagcattttttcttgcacattccaagattgttttatcagcagtgatgaagtatgctgcaatggatgcagcagatatgataagtgcctgag

SEQ ID NO: 3343 - DNA, 207 bp, Cicer arietinum
acggacaaggggaatccgactgtttaattaaaacaaaccattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggatta

SEQ ID NO: 3344 - DNA, 246 bp, Cicer arietinum
actaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattcc

SEQ ID NO: 3345 - DNA, 166 bp, Cicer arietinum; identical to SEQ ID NO: 1028

SEQ ID NO: 3346 - DNA, 131 bp, Cicer arietinum
ccccttgttactgcggcgctaggagtgggattttctacgggctatgcgactacacaaaactgcggggatgctatcggctccctaacagcagctttcggagaaggaattttggagagttcgccttctctgac

SEQ ID NO: 3347 - DNA, 227 bp, Cicer arietinum
actgactctatcagttggtgattacaaaagaagaagaggacttctttgaaatttgttgatgccgtgcgggtccaattgaggtaagtccacgatataatgatggaaagatggtttttattgactgtaatgttgttgtaaccttattatgtatgttgaacattttataagtggtcatgcttccacatgtctttatctagctttattcttgaacaataaagttgtgtggc

SEQ ID NO: 3348 - DNA, 120 bp, Cicer arietinum
accataccaattacacagtttttgctttcactcttcaaatgtcaaaacaaactaatgtaaaatatcacctaggcccacgagcatacctcctatctgggctaccatattggggataaggag

SEQ ID NO: 3349 - DNA, 294 bp, Cicer arietinum
acttagttttattcactccaagttacaaggatgctatgatgttggttggagaaagttacccttttgttaaaggaaactattacatgactattcttggtgaacaacaagaggattatattaaagaatttgcttcttttaaggaatctaaggttatcatagcacctaggacttggttggatttgaggattagagggtcacagttaagtcaaaattttaggaggaaatgtaagattggtccaaaagggttgtttgcttatgcagcagatgtgaatggaacaatgcattgggtttctg

SEQ ID NO: 3350 - DNA, 174 bp, Cicer arietinum
acttagttttattcactccaagttacaaggatgctatgatgttggttggagaaagttacccttttgttaaaggaaactattacatgactattcttggtgaacaacaagaggattatattaaagaatttgcttcttttaaggaatctaaggttatcatagcacctaggacttggt

SEQ ID NO: 3351 - DNA, 438 bp, Cicer arietinum
acttagttttattcactccaagttacaaggatgctatgatgttggttggagaaagttacccttttgttaaaggaaactattacatgactattcttggtgaacaacaagaggattatattaaagaatttgcttcttttaaggaatctaaggttatcatagcacctaggacttggttggatttgaggattagagggtcacagttaagtcaaaattttaggaggaaatgtaagattggtccaaaagggttgtttgcttatgcagcagatgtgaatggaacaatgcattgggtttctgaggcacatagaaactattggcatgttttgcttgatgcttcttccttggttgtgggaaaggataggttacatgttggacttcataggcctgattttttagtatgttgtcttgataacacacattcaaatccttcaagaatcactt

SEQ ID NO: 3352 - DNA, 446 bp, Cicer arietinum
acagctttggagttgtgcttctagagctcgtgacgggaagagagcctaacaatggaggcgacaatgcatgcagcctggttgattgggcatggcagcattatagtgaaggtaaatgcatcactgatgcctttgatgaggatatcagagaaacaagttatgcagcagagatgacaagtgtcttcaaattaggcctcatgtgcacaagcacgttaccctccactaggccttccacaaaggagattttgcaagttcttcgtcagtgttcttcaggttctacgtgtaacagattggcaactgagttcgatattactcctcttattgggaatacaacttacatttccagctacaaagatagtagaactgtaagtgaaaatgaagaaagttgcttatatagtgtataacggtagcattccatgctacaggtatttcaaaataatggtacctcg

SEQ ID NO: 3353 - DNA, 246 bp, Cicer arietinum
accatgcgaccatgtctctcaaatgctgtcaaagttcaggcagaagaattaaccaaagaggactttcagggctccaagtggttggtgttgagatatgcaatacttaatttggaagttattcaagcagccattcttttagccaaacaggaaggtctttttgtttccttggatttggctagttttgagatggttagaaatttcaaacagccacttctgaagctattggagtctggaaacatagacctt

SEQ ID NO: 3354 - DNA, 188 bp, Cicer arietinum
acccgacgaaaatcattcaccggaattcctcattcagaaaatggctttaggtggaggaggtccccaaagaggaagtgcagcagctaccgcaagcatgaggagaaggaaaacagcaggtggtggggcatctggcggagcagctggaactatgcttcaattttacactgatgatgcccctggactcaaaa

SEQ ID NO: 3355 - DNA, 256 bp, Cicer arietinum
acacaaaggggaaggaaggtaagattgctgtggtggtgggagccataactgacgatatccgtgtttatgaagttccagccataaaggttacagcactcaggtttacagagaccgctagggcaagaatcgaaaaggctggcggtgaatgcttgacttttgatcagttggctctcagggcccctcttggacagaacactgttcttcttagaggcccaaagaatgcccgtgaagctgtgaagcactttggtcctgctcc

SEQ ID NO: 3356 - DNA, 459 bp, Cicer arietinum
acggacaaggggaatccgactgtttattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgactt

SEQ ID NO: 3357 - DNA, 263 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgg

SEQ ID NO: 3358 - DNA, 388 bp, Cicer arietinum
actatatttgcccgatcactgtgcttctgagctgccatcagtttgacctgatgcgaccttcagagagcatggccgatttggaggggaagaaacgcaatcaacgtttactcggcccggtaattactcctctacttcgactcgcatagccccttggctggtcccagaccttcattgggtttcctgcataccctttcaactattggacctttttttcttggtttcatttcttggagttatacgtatatgccctcaagaagatcttgagatgaggagttgccaaattcttttcatcagcatcaggctctggtcaggggtgggcggtcctggaggtttggcgtgtttatttgcatttacgacgatctgttatgtttgggaggcctgtccaacc

SEQ ID NO: 3359 - DNA, 400 bp, Cicer arietinum
acgtcaattttcccggagggtcagttacagctggcatggcaatatttgatactatgaggcacattcgacctgatgtgtccactgtttgtgttggattagcagcaagtatgggtgcttttctgctaagtgcagggaccaaaggaaaaagattcagcttgccaaattcaaggataatgattcatcaaccgctcggtggttttcaaggagggcaatctgacttagatattcaggcaaatgaaatgctgcatcacaaggcaaacctgaatggatatctctcctatcaaactggccaaagtctagagaaaattaaccaggatacagaccgtgattattttatgagtgcaaaagaagccaaagaatatggactcattgatggtgtcattatgaatcctctcaaagc

SEQ ID NO: 3360 - DNA, 356 bp, Cicer arietinum; identical to SEQ ID NO: 1068

SEQ ID NO: 3361 - DNA, 448 bp, Cicer arietinum
acatggattgagaaatgcatagctattttgataaatttaactacttctgaagttggaagggaggaaatggtatcaactcctggattcattagcgctttggcttcaatattggacaccgatgagctccttgtgcaggagcaagctgtctattgtctcctaattttgtgcaacagtagtgagcaatgttctgacatggttcttcaagaaggggttataccagcgttggtatccatatcagtgaatgggaccccaagagggagagaaaaagctcagaaactcttgatgctgttccgacagcagcgacgagatgattcacctgttgaggaacatcaatgtcctcctgaaaccagtgatttgtctatgccgcctgctgaaatgaaacctccatgtaagtctatgtctagaagaaagactgggaaaggttttagcttattctggagaagcaaaa

SEQ ID NO: 3362 - DNA, 326 bp, Cicer arietinum
acgagcttgattcgttgacgaggaagcacgtgacgattgcgttgtgttacacaacgacgccggatagactccggcgaaggtttcctcacttggagtcgttgaagttgaaagggaaacctagggcggcgatgtttaacttgataccggagaattggggagggtttgttactccttgggtgaaagagatttccaagtattttgattgtttgaaatcgttgcactttcgtcgtatgattgtaactgattctgatcttcagattcttgctcgttcgcgatgtaatagtcttcatgctcttaagttagagaagtgttctggattctccact

SEQ ID NO: 3363 - DNA, 192 bp, Cicer arietinum
ctacggtttatccgactacacaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccg

SEQ ID NO: 3364 - DNA, 256 bp, Cicer arietinum
gaggaattttacttggcgcggttcatggaattgttgaatccttgtttaggaggtacactgaaaatgggatgagtgaagatctggcttataagaacactgttgagtccataacaggaattatatctaaaactatctcaactaagggtatgttggctgtatacaatgctttatctgaagatggaaaaagagattttgagaaagcatacagtgcttcctattatccctgcatggacattttgtatgaatgctatgagga

SEQ ID NO: 3365 - DNA, 288 bp, Cicer arietinum
ataatatcttatttctcacactagcaatattcttaattcatcatcatgggtgttttcagttttgaggatgaggtcacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttac

SEQ ID NO: 3366 - DNA, 292 bp, Cicer arietinum
actccgcactctgcacacaattttacaagagcagggttctctggacagttctaaggctgagagcatggttaagaacctacaaatgaatggcagatatttgcgtgatgtatggtgatgatgacctctgagtgtaacaaacggggtcgtggggttatgataaagcggccgtaaagagtagtagtggatatatagaagataagctattggaagggccttatttgtcgccatacactgatgccctcataaaagggataaggggttccttctgcttgtaacattatgccaattccct

SEQ ID NO: 3367 - DNA, 443 bp, Cicer arietinum
catggtatgtgttccttgttaattttcagtcttgtaattataaatttttatttcgttttgggtgatagaggtaaataaactacttctgctacagagttgcttacagggcagaattatttcttgctaaaactgtcaaatagaacatggatttttgagacaatttcatgagtagccaataattctattttgaacaatttatttaaatccaggtgggaattccttcagaccgtgaacaatatatacatcgtcttggaagaacaggacgagaaggtaaagatggggaaggcatattgttgattgcaccatgggaagagtattttttaaatgagatcaaagatctccctctagagaaattcccctcaccagatatagatccaaaggaacaacttaaggtatatttttctgacttcgtcatagctgctatctggaacatccatagttat

SEQ ID NO: 3368 - DNA, 395 bp, Cicer arietinum
  misc_feature (395)..(395): n is a, c, g, or t
gggtaaggtcttcctttctgccgtgtcgtttgctgttattttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttcatacttccagtattgagctctgtaattacgattatgactatgacaatatctcttattgtgtgacgtgttttattactgatgttagtaccn

SEQ ID NO: 3369 - DNA, 401 bp, Cicer arietinum
aatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacattgtcaggtggggagtttggctggggcggcacatctgttaaaagataacgcaggtgtcctaagatgagctcaacgagaaca

SEQ ID NO: 3370 - DNA, 249 bp, Cicer arietinum
tggaaagccaaagttctatctacaaattctaaatacaatgccaagagccacacatgttattacatgtaaagctgcaatatgcgtgggggaaaggaaagacagtgacggttgaagagatagaagtagatccaccaaaggcaacagaagttagagttaagatgttgtgtgcaagtctctgccacacagacatctcaagcattcaaggatttcctcataatcaatttcctctagcacttggacatgaaggaa

SEQ ID NO: 3371 - DNA, 172 bp, Cicer arietinum
acagagcttacctggagaccgtggaatgaggcgactacctcgtccacagagcagcgttctagccgccttggggttttctcctgcaagggttttccccaaggatgcacggttctagggttgcagctactggcgatcttaggggaccatggacttcctgcctcagggtatggaa

SEQ ID NO: 3372 - DNA, 262 bp, Cicer arietinum
acaatggccagttgtggaagttgagaagctaagagtaaatcttgtcaacttgccccccaaagttctcaagggaggtgaattgctgcaaattaacggtgtcacagcagcacaagctgatgttgaaatttcatttgaagtgaataacattggagaggctgaagttttggacaattggacagaccctcaaattctgtgtagccaaaagggttcatcagtaaaaagtggtttgggaccctttggtctattagtttttgcttcaaag

SEQ ID NO: 3373 - DNA, 432 bp, Cicer arietinum
  misc_feature (423)..(423): n is a, c, g, or t
tctgatgttgatcaaatcaaccaagtagctggtgttgaatggcatggggagactattgtttatgcttacagatcaggtgaggtgatacggctaccaaaaggggtttcgattccagtgacactaaaggttctggagtttgaacttttccatttctgtccaatccaagaaatagcaccaagtatatcatttgccgcaataggcctaatggatatgttcaacactggaggagctgtggaagaggttgaaatccataaagcctccgacaacaaacaagaactattcgacggcgaggttgtatctgaactgacaacttctctcagtcctaaccgaacgaaaacagcaactgttgctctaaaggtcagaggaagtggcaagtttggagtttactcttctcagcatccacttcaatgtgcagtcgatggnattgatacc

SEQ ID NO: 3374 - DNA, 404 bp, Cicer arietinum; identical to SEQ ID NO: 1198

SEQ ID NO: 3375 - DNA, 258 bp, Cicer arietinum
gccgtcagccgcagtgcaggtcatcaaacctccgctgaatcatggggaaccggtcgtgccgtttctcgtatccctcgtgttcccggtggtggtactcaccgtgccggacagggagccttcggaaacatgtgtcgcggcggaagaatgttcgctccaaccaagatctggcgccgctggcaccgtaagatcatcgttaactaaaaaccttatgctgtcgtatccgccctcgccgcctctgccatcccctcactcgtcctt

SEQ ID NO: 3376 - DNA, 136 bp, Cicer arietinum
tgctttccttgctaaaatccaatggtcccttgccatagttcgctccaagattcattctttcagagacctcaatgcgattctggtatatacaaatttctgcgaatattttttctcatttcatgaagaggctgggtat

SEQ ID NO: 3377 - DNA, 406 bp, Cicer arietinum
agaacataatacaatattattatttgagtaaactgttacatcattgaggagtgattattatgaacgaaggaagaacaagtaacataaaatggatttttggcacaaagcatgtgaagccatttaaaagaaaattaaaagaaatagtttgtcttattgaacatctcaaggatgacaaaaactgatttcttaaacgaattgatccaaatattcatcagcagtggtgtatttcacatcaggatataaatcataagcctcagcatctttagcagggtcaatctcatacactgcatctccctttatttgttgggagtgatacaaggccaatagatagttatgagggaatgtagatacattaatgtccttaagaactttttcttctgaaatataagatttctcaagagtcttc

SEQ ID NO: 3378 - DNA, 281 bp, Cicer arietinum
acagatcgttggtgatgatctccttgttaccaacccaaagcgtgtggagaaagctattaaggagaagtcttgcaatgcccttttattgaaggtgaatcaaattggtagtgtaactgaaagtattgaagctgtgagaatgtctaagaaagctggctggggtgtcatggctagtcaccgaagtggtgaaactgaggataccttcattgctgatctctcagttgggttagcaacaggtcagatcaagaccggagctccctgcagatccgaaaggcttgctaagt

SEQ ID NO: 3379 - DNA, 287 bp, Cicer arietinum
actgagctgaacaagaaaatttacaagcttggcaagtctggagaagagacccatgatgcccaaactgattatgataggactgagaaagacatcactccaatgggtggattcccccactatggtgttgtgaaggaggattatctgatgatcaagggaggtgttgttggtcccaagaaaagggttattactttgcgtcagtctctactcaagcagacttctcgcaatgccttggaggatatcaaacttaagtttatcgatacctcttcaaagtttgggcatggtcgctt

SEQ ID NO: 3380 - DNA, 337 bp, Cicer arietinum
accaaatcacttttggtgaagcttctcatctctctctctctctctctcaaacctcatttgttttcccttctctctcaatcaaccttccatttttgttcttccaccactcttcttagccttggtgtagctggttgatggatattgatcccttgtgggctcttggggggtggatttttctttcaaattgcatggcacaaccaaaaacttcttcacatcttttctcaaagtcaccaactttgtttcacttcctcacacttttcttcatccttctcctcatcatcaatttatcacaccaaccaacatccaccatggtctctaccaaatcaaccatgtctac

SEQ ID NO: 3381 - DNA, 304 bp, Cicer arietinum
aggggtgtcctgagatcacattcaacaatggttaaggctgtggcagttcttggtagcagtgacactgtgtctgggactattaacttcagtcaggagggagacggtccaaccactgtaactggaaatcttgctggtcttaagcctggtctccatggcttccatattcatgccttaggggacaccacaaatggctgcatatcaaccggaccacatttcaatcctaatgggaaagaacatggttcccctgaggacccgattcgacatgctggcgatttaggaaatatcaatgtcggtgatgatggaa

SEQ ID NO: 3382 - DNA, 440 bp, Cicer arietinum; identical to SEQ ID NO: 720

SEQ ID NO: 3383 - DNA, 366 bp, Cicer arietinum
acggcaaggctggccatcttgaccgtgccgaggaatattttgaagagatcaaattgcttggcgaacagttggacaaaagatcatacggttcaatgatcatggcctacatcagagccggaatgcctgaacaaggagagagtttacttgaagaaatggatgcacaagaaatatatgcaggcagtgaggtttacaaagcattacttagagcttactcgtggagtggtaatgcagaaggcgcgcaaagggtgtttgatgcgattcagcttgccggtatcaccccagatgataagatgtgtagtcttcttatttatgcttatggcatggcggggcaaagtcaaaaagctcagattgcctttgaaaatatga

SEQ ID NO: 3384 - DNA, 403 bp, Cicer arietinum
actggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggacagtg

SEQ ID NO: 3385 - DNA, 292 bp, Cicer arietinum
actaggttgaattactattgcgacactgtcatcagtagggtaaaactaacctgtctcacgacggtctaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacgcctctagcttcaaattccgaaggactaaaggatcgataggccacgctttcacggttcgtattcgt

SEQ ID NO: 3386 - DNA, 358 bp, Cicer arietinum
acaaataaagccaagctccacatttttttagatattcacgttttgaaaagacaaaacattaaccaagggagcagcaaaatattcctggaagcaagaaatatgtttatgaaggaacggccaaaccatctacataagatgatcaaatcattagcagaacttcctacataaatgttatcttagtccgagcttctactcgtcatcatcctcctcatcactgccatcatcatcatcatcattctcatcattcacctcagattctgatttctcggattcttcctcttcaacagcagctggaccttcagcctgtttcttgttataggccttcatgttcttctcatattctgccttccttttttct

SEQ ID NO: 3387 - DNA, 293 bp, Cicer arietinum
actaggttgaattactattgcgacactgtcatcagtagggtaaaactaacctgtctcacgacggtctaaacccagctcacgtcccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 3388 - DNA, 344 bp, Cicer arietinum
acggattttattctttttgagtaagtttatttattaatacatgatgtagttaacagtttggacccacaatcacatacacatacgtcttcaaatgaagatagattctctagagcagcttatttggtcctgaatggagctgaagtttctggcttggaacaacttgaagaacacctggttgctttgaaatttgagcaacctggtcaggagtaagcttagcagagaaaccactagcagccgacttgtaactatacaacaaagcctcctttgcagcctcctcactgccgagaaccgcggtgagggttcggatgtggtaggtctcaggctcctcttcatgtggctgctcg

SEQ ID NO: 3389 - DNA, 425 bp, Cicer arietinum
acagagaaatgattgagagtggtgtcattaagctaggcgataaacagagtgaaagcaaatgtgctctagtgtatggtcaaatgaacgaacccccgggtgctcgtgcccgtgttggtctaactggacttactgttgctgaacacttccgtgatgctgaaggacaggatgtgcttctttttgttgacaacattttccgctttacccattcaaactcagaggtgtctgctttacttggtcgtatcccatctgctgttggttaccaaccaacattgtctaccgatcttggaggtcttcaagagcgtattacaaccacaaagaagggttcaattacctctgtccaagctatctatgtgcctgctgatgatttgacagatcctgctcctgccaccacctttgctcacttggatgccacaacagtgttgtca

SEQ ID NO: 3390 - DNA, 421 bp, Cicer arietinum
actgagctgaacaagaaaatttacaagcttggcaagtctggagaagagacccatgatgcccaaactgattatgataggactgagaaagacatcactccaatgggtggattcccccactatggtgttgtgaaggaggattatctgatgatcaagggaggtgttgttggtcccaagaaaagggttattactttgcgtcagtctctactcaagcagacttctcgcaatgccttggaggatatcaaacttaagtttatcgatacctcttcaaagtttgggcatggtcgcttccagacaacacaagagaaacagaagttctatggacgcctcaaagcttagttatggctgctgctttgaaatgttggaaatcgttatttatgttatttttgttgccatccttttaaactctgttgtggtgtcttcc

SEQ ID NO: 3391 - DNA, 452 bp, Cicer arietinum
accaaagatgaaaagaaggaaagaaaatgtaatgttaggattttcagagaaggacttatgaagttccaattctcagggaaggactctccggccagttataaatagcaacgcttcaacacaacacttcaaattcatctttttctcttttctttcttattctctttcattttttctcaatactctctctcacaccctcaacatgactatcctcattgatcaacctgattattttggatctgatgtagaggcaaagacggtggcagttaatgagagagaacttgtgttggatggtgaatttgttatacctcatgccaactcatttggacacacttttagggattatgatgctgaaagtgaaaggcgagaaggagtggagaacttctacagaaaaaaccacatttatcaatcctttgattttgtgaagaaaatgagagaggaatatggaaaattga

SEQ ID NO: 3392 - DNA, 343 bp, Cicer arietinum
cgcactgttagtgcactgttaggagcgggattttctacgggctactcggccacacaatactgcggggacgccatcggctccctaacaacagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaac

SEQ ID NO: 3393 - DNA, 331 bp, Cicer arietinum
acccattttggaggtggcaaatcaaccggttttggtttgatttacgatacagttgagaatgctaagaagtatgagcccaaatacagacttaccaggaatggtcttgacaccaaaatagagaagtcaaggaagcaaatgaaggagagaaagaatagggccaagaagatccgtggtgtaaagaagaccaaggcctctgatgctgccaaggctggaaaaaagaaatgagtttttagttgtcgtgtttgtgctttaaggttgttttgctttccaagtttttttgatagctatgttatctcatgcatggtctacaaaatgagatattttggtacct

SEQ ID NO: 3394 - DNA, 316 bp, Cicer arietinum
ccttttgcttccaccttcgattcatcaaatccgaacgcgtttcttgaaaaggtgttcgacttcgtcgctaaggaaagtgattttctcgataaggatttttctgagaaggaggtggtgtccgcttttcgcgctgcgaaggtaaagaaagctaagattgttgctgctgagaaggcgaaggttgttgccgaagcgaaggcgaaggttgttgccgaagcgaaggcgaaggctgaaaagaaattgaaggaggagaaggcggcgaagagagataaggaggtagaatcgaaggaagatgagaagaagggtggtgaaagtggct

SEQ ID NO: 3395 - DNA, 147 bp, Cicer arietinum
acaggatacccctcttccttcaccatccagcataccaaggcacaaaaggcgctgtttttgtcaagcccgtcacccgtcagcgggttcggaggcaatttgtcgaatttttccaccgaccagaattctctcacgcatcgctacatctgc

SEQ ID NO: 3396 - DNA, 191 bp, Cicer arietinum
cggacgtaactttaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtggaggtggatatggcggaggaggtggtggtggttatggtg

SEQ ID NO: 3397 - DNA, 451 bp, Cicer arietinum
agaaagtgaaaaattattattctctcatcgtcggcgatctcctcctctgccttattcaaccctacttttcgatctacgtttccacactcaggtttgaattttgaaagaagaataagaagaagagcgtaagtaatcatgtttggtgttgtaaggcgaagggttgcttctggaggcacatcttcgttgcttggtcagtcagggctgaaaatccggtctggcactgctagagtttcttccgttgtggaaaaagaggttgcatttagctcaggaggatgtggcaatatccggaatttctgtcacacaacacctggacgctggattaattcaaaacctataagggacattttttatcaagaggcttccattcaaacacagaggcattcattttcttcggaaagtggagattctgttgatgctgtggtccctccattggctgaatccatcgaagatg

SEQ ID NO: 3398 - DNA, 379 bp, Cicer arietinum; identical to SEQ ID NO: 682

SEQ ID NO: 3399 - DNA, 406 bp, Cicer arietinum
acagagttttgtattgctgatgcgaacgttggagatgtgttgtccaatccaagcaagtaaaatccttgatttgctgtaatcccaattagtgctagaaaaaagaactggcagaggaagtttaaactaatcggaggtctatccttcttttccaaaaaataagcaaagggaagaaggagaagcaaagcaatgatgttcctataaacagggaaaacaaatttgctaactcccatgttaagggcagctcttgagacaacatggaaaccagcataaccaaactgcaaggccaacatggccacatggagttgaaatctttcaggaatgtaacaccacattctcttacaagatgctgaacttggatcagccattgtgaaaatactattatcgcactatataatataatttgaat

SEQ ID NO: 3400 - DNA, 397 bp, Cicer arietinum
ctcaaaccctagacaaagatggcctcaaaacggatcaacaaggaattgaaggatttgcagaaggatcctcctgcttcttgcagtgctggccctgtcgcggatgacatgttccattggcaagccacaattatgggcccagcagatagcccattttctggaggtgtgtttcttgtgcaaattcacttccctccagattatcctttcaaaccacccaaggtatcattccgcacaaaggttttccaccctaatatcaacagtaatggtagtatttgccttgacatcctcaaagagcaatggagccctgccctgacaatatccaaggttctactgtctatttgttctctgctgactgatcccaacccagatgatcctctggtccctgatattgctcaaatgt

SEQ ID NO: 3401 - DNA, 289 bp, Cicer arietinum
acgtgatggtgtttggcaagtgacatacactctctttgatagagattttgatgagagtgagtgtcaattgccacaaagatgtggaaaatttgggctttgtgaggaaaatcaatgtgttggttgtccattagaaaatggaatatttgggtggagcaataaatgtagtgctaagcctatagcaacatgcaaagaaagtgaatttcattactacaaaattgaaggagttgagcattatatgagcaaatacactaatggtgatagtgtaagtgaagctaattgtggaaataaa

SEQ ID NO: 3402 - DNA, 342 bp, Cicer arietinum
actaatccttcaacaaatcgaaacatcatggtaggacagttgagggcgacaaaaccaagtcgaagcgacgaggttttggacagcgaggaacaagtgaggatcacaaatcagatcaaagctcaattcgatgctttaaaacctaaacgacccattaaacccaacagaagcgaacctgaaactcaaaaccccgttgactcaacactctcttcacacaacataccagagcttcaaaaacttcaatctcttcaatctattaattctctcgctatactttcctcagagaatttggtggatccgcaagatgagtttgtggagactcactattacaaggagttgttgtcc

SEQ ID NO: 3403 - DNA, 235 bp, Cicer arietinum
acagtgtcgccaagaccaacacctctgcggcggcactcttcagagcttccttttatgtttgaacaacatagatgacttaaagacaacgggcctggggtgtgacagtttcacattgacttttgttcttggaaagacggaggatgatagtgacaccagatatcgtcacgggggcacatttattcggcatggcagaggaggaaacagattatttgaagtgcattcaggcgcaaggagt

SEQ ID NO: 3404 - DNA, 263 bp, Cicer arietinum
acttagcaagcctttcggatctgcagggagctccggtcttgatctgacctgttgctaacccaactgagagatcagcaatgaaggtatcctcagtttcaccacttcggtgactagccatgacaccccagccagctttcttagacattctcacagcttcaatactttcagttacactaccaatttgattcaccttcaataaaagggcattgcaagacttctccttaatagctttctccacacgctttgggttggtaacaaggaga

SEQ ID NO: 3405 - DNA, 286 bp, Cicer arietinum
acccttaaggcatggtctggaaaaggagagaatgtgaagaatgcacaagatgctttgttgacaagggctaaggctaattcagaagctactcttggaacttacaagggtaactctcaacttggtgaaggtgcctcagagagtctccatgttaaggactacaagtattgatcaaagttggtgcatcccttaaagagggtaggtttggcatttaagggtataacaactgaacattgtgagggttgaattttcttgttattgagtattgtggaataattgcttggagttt

SEQ ID NO: 3406 - DNA, 440 bp, Cicer arietinum
agagattctattttctttggccttgctcgtttatcactctcatggtgtagcaagaacatgaacaacttggtcctatctcttgttcctaagtttgcaaaattgcaaactctaatccttcgtcaagataagcctcaactagacgataatgctgtagggactatttcaaatttctgccatgaactgcagattctagacctcagtaaaagcttcaagctcactgataggtcactgtatgcaatagcgcatggttgtcacgatcttacaaaacttaacatcagtggatgttcagcatttagtgataatgctctgacttaccttgccggtttctgtagaaaactcaaagttcttaatctctgtggatgtgttagagcagcatctgatactgcactacaggctattggacactactgcaatcagttgcagtctctgaaccttggatg

SEQ ID NO: 3407 - DNA, 443 bp, Cicer arietinum
acagttgccttctctgctggtttgcacggttgggcatttactctgaccaactttgcaaaaatgtatgcctcaaagtttggcgttgatgaatccaagatgatggagaggctctggggtgaaaacttctttgatccagccacaaagaaatggaccacaaagaatactggttcaccttcttgcaagcgtggatttgttcaattctgttacgagcctatcaagcagattattaacacttgtatgaatgaccagaaggacaagttgtggcctatgctaacaaagctaggagtcaccatgaaatctgaagagaaagacttgatgggtaaggcattgatgaaacgtgtcatgcagacttggctcccagctagcagcgcactattggaaatgatgatctttcatcttccctctccatcaactgctcagaggtatcgtgttgagaatttgta

SEQ ID NO: 3408 - DNA, 180 bp, Cicer arietinum
tagcgtggtccggccgaggggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatc

SEQ ID NO: 3409 - DNA, 436 bp, Cicer arietinum
acttttgtttgtgttctataattctaccaagaacaagaatgtgacttgaaaaataacttttaattactagatgctgtagtgtttttttaacttgcaccaattcatgttcacaggacactatttccctgcatcagaattcttctgagttcactagcaattccttgcatcaaaaccggttttcggattaccccattaacaccaatctccatgcacttttcccacaaatcttcttcggcacttgcggtcaatgcaacaattattggcctatttccgcttttaaacttccgaatccttgcggcgacttcgaagccgtctatatcaggcatttggagatccaaaagcacaacttgaatggaagatccagcaggtccaatgaaggtaaggcattcgaatccggaagaagcagaagtcacggcacaacctagtttctgaagca

SEQ ID NO: 3410 - DNA, 232 bp, Cicer arietinum
acagagcttacctggagaccgtggaatgaggcgactacctcgtccacagagcagcgttctggccgctttggggttttctcctgcaagggttttctccaaggatgcacggttctagggttgcagctactggcgatctttggggatcatggacttcctgcctcagggtatggaaagctacttgatctatctgtgcaagagaattctaggctggagaggaatagttcccgctgac

SEQ ID NO: 3411 - DNA, 418 bp, Cicer arietinum
accaccaaacaccaagcaataaacaaagatctaggtgctctcgctcctattcggcttcgtagacacgaaaatcagatgttgatcaaggttgggaacccagtcatttgtagcaggattacttttatatcctctgaattgaatttcaccaacatcaacatagcttgcaggtaacttaatctcatatccatcttcaccaccttctctcaccgcttttataaacccacttcccgtcgcatgatgctgtttatcaatggacaacaactccttgtaatagtgagtctccacaaactcatcttgcggatccaccaaattctctgaggaaagtatagcgagagaattaatagattgaagagattgaagtttttgaagctctggtatgttgtgtgaagagagtgttgagtcaacggggttttgagtt

SEQ ID NO: 3412 - DNA, 281 bp, Cicer arietinum; identical to SEQ ID NO: 2453

SEQ ID NO: 3413 - DNA, 425 bp, Cicer arietinum
tagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgtcaacatccgcagggaccatcgcaatgctttgtt

SEQ ID NO: 3414 - DNA, 397 bp, Cicer arietinum
actataaagaattcagctacattggctgggtcattgttcactttgcatgcctctcaagttcgtattgaattacctacccttacagagaaagacaaggaggttataagcacctggggtgttaagaacaaaattgattttctgtcattgtcatatacccggcatgccgaagacgtccgtgaggctcgtgagttcctttcaaagttaggcgaccttagtcagactcaaatttttgcaaagattgaaaatgttgagggattgacccattttgatgagattctgcaagaagctgatggtattatcctttcccgtgggaatttgggcattgatcttccaccagagaaggtttttctgtttcaaaaatctgccctatacaagtgtaatatggccgggaagcctg

SEQ ID NO: 3415 - DNA, 432 bp, Cicer arietinum
acttgcaatgtcattagcaccaaaggatgaacatgaagctcaggttcaatttgctctcgagagggggattcctgctatatctgctgtaatgggcacaaagaggcttcccttccctgggagagtatttgatgtagtccattgtgcacgatgtagagttccatggcacatagaaggtggtaaacttctactggagttgaacagagtattgcgtcctggtggtttttttgtatggtctgctactcctgtttatcagaagctttctgaagatgttgaaatatggaatgccatgaaagcactaacaaaagcaatatgctgggaacttgtggcgatcagcaaggatcaagttaatggagttggtgtggccatatacaagaagccactatccaatgagtgttatgagaatcgattaaagaatgagcctccgctgtgtca

SEQ ID NO: 3416 - DNA, 445 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttgg

SEQ ID NO: 3417 - DNA, 292 bp, Cicer arietinum
gcaactaaattcattattattatttctggtaagaaaacgaaagagaaaacagcagaaactcagatttaaccagtgttttgcaatccagcagcaatacccttcatggtgagaatgagagtatcttccaaaccaggtgcatactcacttgttgggttcagtgttacaagttcatcagcagctttacttatctctatagactctttagagatgtgagggcgtagcttcacattatagtttggatctcggatacgtttcaatgtgtaagcttggcacacatttagggtagtaatgt

SEQ ID NO: 3418 - DNA, 199 bp, Cicer arietinum
ctcataatatttgacttaccggtttgatatagggtttggaccacttggaacttcatgagcatcacttccaaattgatctcttgcagctttttgatccttttgagagttttttgttttgtgaggagggtgcaagtttgttgtagacatggttgatttggtagagaccatggtggatgttggttggtgtgataaattgatg

SEQ ID NO: 3419 - DNA, 402 bp, Cicer arietinum
catctacaacagcatcttctcgcctcacaccaacttactcaacgcacgagttcttactcaatcgacacaaccaacccacactttttccaacctcttcatctttcgaaatggctcccaaggctgctgacaagaagcccgcctccaaggctcccgctactgcctccaaggctcctgagaagaaggatgctggcaagaagactgccgcctctggtgacaagaagaagcgctccaagacccgcaaggagacctactcttcttacatctacaaggtcctcaagcaggtccaccctgacactggtatctccaaccgtgccatgtccatcctgaactcttttgtcaacgacatcttcgagcgcgtcgcttctgaggcttccaagcttgccgcctacaacaagaagtcca

SEQ ID NO: 3420 - DNA, 372 bp, Cicer arietinum
aaacaacgtaatctcattgagagaaggtcctgccttatccaattttagggtttctattcttcgctaatcaccccactgctttacgcatcgaaaccctaaactaagatcaggtctgagctatctggttggtgggaccttctgttttggagattaagtttcatgtctgaattagacgcacaaattcctactaccttcgatccttttgctgaggcaaatgctgaggattccggtgctgggacaaaagagtatgtgcatattcgtatacagcagcgaaatggtagaaaaagcttgacaactgtgcagggattgaagaaagaattcagttacaacaagattcttaaagaccttaagaaggagttttgttgttatggt

SEQ ID NO: 3421 - DNA, 459 bp, Cicer arietinum
acacattgttaagactgatcaggttgaagacattgctgggaagatgcttgggcagatactagttaccaaacagtctggtcctcagggaaaaattgttagcaaggtttacctgtgtgaaaagctgtcacttgtaaatgagatgtattttgctataacactggatcgtaaaactgctggtccacttattattgcttgtaaaaagggaggaaccagcattgaagaccttgcagagaaatttccagacatgattataaaggttcctattgatgtttttgaaggaattaccgatgaagatgctgcaaaggttgttgatggtttggctcccaaagttgccgacagaaatgaatcaattgaacaagtgaagaatttgtataaactttttgttgaaagtgactgcacccttttggaaatcaaccccatggcggagacagctgataaacaactagtggctgctgatgc

SEQ ID NO: 3422 - DNA, 311 bp, Cicer arietinum
actaggttgaattactattgcgacactgtcatcagtagggtaaaactaacctgtctcacgacggtctaaacccagctcacgttccctattggtaggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgcaccagtcatactcataat

SEQ ID NO: 3423 - DNA, 364 bp, Cicer arietinum
ataacaacagcgaagtcgagcagcagttcaacgactacaaccaacactcccaaaatcaggaacaccacgccaaactttcccatgaaataatcggtggtgccgctgcctatgaggcagccaaggcatacgaggatcatgttgccaagaatggcaagccagatagccatgcccaggccaaggaattcattgtcggagctgttggtgctttcgttgaacgagagtttgagaccaagggtctggacttctttgacaaggaggaggccaagcgccgaggtgaacatcgagcagaaagggagcttgagcgtcaatactagatctgtatcagggttctttgggagcaaataaatatgatgaataatgaacc

SEQ ID NO: 3424 - DNA, 344 bp, Cicer arietinum
acgaaatcctcaagggtttggtggcgtgtccaaatgtttatgaaagaaatttgttagcggacacaactaagatcattgagaagaacaaaacattgtgtaaacgcaaagataataattgcagaaagattgttactgatggattattggctcttggttacgaggcttcaatttgcaaatctcgctgggaaaaatccactttctgtctcgccggggaatatgaatacattgatgtgataatgggaaaggagagggtgatagttgacgttgacttcagatcacaatttgagattgctagatccaccaaggcttacaaagcgattcttcaaacccttccttatgtattt

SEQ ID NO: 3425 - DNA, 431 bp, Cicer arietinum
ggtgtcctgagatcacattcaacaatggttaaggctgtggcagttcttggtagcagtgacactgtgtctgggactattaacttcagtcaggagggagacggtccaaccactgtaactggaaatcttgctggtcttaagcctggtctccatggcttccatattcatgccttaggggacaccacaaatggctgcatatcaaccggaccacatttcaatcctaatgggaaagaacatggttcccctgaggacccgattcgacatgctggcgatttaggaaatatcaatgtcggtgatgatggaactgtaagcttctctattactgacaatcagatccctctcactggaccaaactccatcataggaagggctgttgttgttcatgctgatcctgatgatcttgggaaaggtggtcacgagcttagcaaaactac

SEQ ID NO: 3426 - DNA, 370 bp, Cicer arietinum
actagctctgaagatctagacaccatcacataatggttgtaatttagagaaaaataagtgaataaaaggaaaatagacatttcctaaattggcaatattctttcatttgcagctccctccaatatcatatctgacgaaccccattaactctggacctgtaagtcttgggttgttcttgaaactttgttgagagaagttggagaaggatccgtatgttgggaagatgccacagagatcattgtttgacaggtctaggattttgaggttagttagtttagtgagttcccttggtattcttcctgtcagcttgttgttgttgagtcgcaagaatttgatattagagaggctggagagggtggaagggatggag

SEQ ID NO: 3427 - DNA, 117 bp, Cicer arietinum
ccggccatcataccagaggttcccgcacagatatataccggaaaacgctgctccgcagctctggatgtgcttcttagcacattcaattcatgtttcaccacgtgaatcgcttcactt

SEQ ID NO: 3428 - DNA, 336 bp, Cicer arietinum
tttcctaccttgaagttcttccccaagagcaataaagccggtgaagattacggaggtggaagagacttagatgattttgtagcttttatcaatgagaaatctggaacaagtcgagatgctaaaggacagcttacttctgaggctggcatagtagaaaatttggacgtcttggtaaaagagtttgtagctgctagtgacgaagaaaagaagaccgtctttgcccgaatggaagaggaagttgggaagcttaagggatctgcttcaagatacgggaagatttacttgaaagctgccaagaattacagggagaaaggttctgattatgctaagaatgaa

SEQ ID NO: 3429 - DNA, 161 bp, Cicer arietinum
acatacctttagcattgcaggaacgaagaatactattggccagtatgagagccacgctgcttttactcttcctgggctctacagggttgttcatggcattgatgtctttgatcccaagttcaatattgtctctcctggagcagatatgacaatatatttcc

SEQ ID NO: 3430 - DNA, 293 bp, Cicer arietinum
acgaatacgaaccgtgaaagcgtggcctatcgatcctttagtccttcggaatttgaagctagaggtgtcagaaaagttaccaccgggataactggcttgtggcagccaagcgttcatagcgacgttgctttttgatccttcgatgtcggctcttcctatcattgtgaagcagaattcaccaagtgttggattgttcacccaccaataggggacgtgagctgggtttagaccgtcgtgagacaggttagttttaccctactgatgacagtgtcgcaatagtaattcaacctagt

SEQ ID NO: 3431 - DNA, 316 bp, Cicer arietinum
acattagtgatgggtttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaat

SEQ ID NO: 3432 - DNA, 262 bp, Cicer arietinum
cgcatgctcccggttcccatggcggccgcgggaattcgatttcgagcggccgcccgggcaggtactaatccttcaacaaatcgaaacatcatggtaggacagttgagggcgacaaaaccaagtcgaagcgacgaggttttggacagcgaggaacaagtgaggatcacaaatcagatcaaagctcaattcgatgctttaaaacctaaacgacccattaaacccaacagaagcgaacttgaaactcaaaaccccgttgactcaa

SEQ ID NO: 3433 - DNA, 254 bp, Cicer arietinum
agtttctctcacttgttgtggactttgtgaaaggagaaatcgagattatcaatcatcatcatcatgtggccgttcagcaagaaaggagtttctgggttttcatggagttcaactgctgaacaagttacccatggaatcgatgccactggtctcactgctattgtcactggagcatccagcggcattggggctgagactactcgtgtccttgctttgcgtggtgttcatgtgattatgggtgtgaggaatttggt

SEQ ID NO: 3434 - DNA, 167 bp, Cicer arietinum
caactagtctcaggaggagaaaaatgtctcataggaagttcgagcacccaaggcacggatcattgggatttctcccaaggaagcgtgctgctcgtcacagaggaaaagtgaaggcattccctaaggatgacccaacaaaggcacccaagcttactgccttcttgggt

SEQ ID NO: 3435 - DNA, 405 bp, Cicer arietinum
taaacttccaaagctaacaggcccactccagcccacaattgccaaactaacaaacctcaagttcctccgtatcagtaataccaacttatcgggctcggttccttctttcttggcccaactcacaaacctcacatttttggatctatctttcaacaacctcaccggttcaatccccggttcactctctcaacttcccaacctcaacgccctccacttggaccgtaaccacttaaccggttcgatcccttcttcgttcggttcgtttaagtccaacccagatatctacctttcccacaacaacctcactgggcccatcccacccacattagggaacctcaatttaactaccatcgacttgtcgcggaacaagctcgagggagacgcgtcttcgattttcgggcccaa

SEQ ID NO: 3436 - DNA, 411 bp, Cicer arietinum
acaccacgagcagtttgatagtgttcatcacccaaaataagtggggaaagcatacgagatgtggagtccaatgggtcgacagcaggatagataccaagctcagagatctgtcgtgacaacactgttgtggcatccaagtgagcaaaggtggtggcaggagcaggatctgtcaaatcatcagcaggcacatagatagcttggacagaggtaattgaacccttctttgtggttgtaatacgctcttgaagacctccaagatcggtagacaatgttggttggtaaccaacagcagatgggatacgaccaagtaaagcagacacctctgagtttgcttgggtaaagcggaaaatgttgtcaacaaaaagaagcacatcctgtccttcagcatcacggaagtgttcagcaacagta

SEQ ID NO: 3437 - DNA, 222 bp, Cicer arietinum
gctacattcactggcataattcgagctctaaaggagaaggaacaaaaactaaaagaagcaaatatgcacatctatgtgaggagaggaggtcctaactaccaaaggggtcttgcaaaaatgagggcacttggagaagaaattggcattcctattgaggtttatggacctgaagcaacaatgactggtatatgcaaacaagcaattcaatgcatcactgtttct

SEQ ID NO: 3438 - DNA, 355 bp, Cicer arietinum
gagttgacctaaataaaaaattatcaattctattttaaaaaaatagaacaatattttattgctacaatttaaattaatttaatcgattaattaattgttaattcggtggctaatgatggtgatattgttaactaaacaggggtagaaacggtgatccttgacggtgacaaggatttggcaacagtgaaaggaacaatggatccgaaggagttggtagaatatttgaaggagaagctgaagcgaaacgttgatgtagttgcccctaagaaagatgaagagaagaaagagaaagacggtggaggtgaaaagaaagaagagaaaaaggaagaaaaagagaaaaaggacggtggtgatg

SEQ ID NO: 3439 - DNA, 185 bp, Cicer arietinum
acaaaccaaaaacatttaaataaataagaaactgatcttggtccagtccagaacagaaactattagagagatagtggaacagagagaagggggttactactctttacactgtaaattaaatttaataccaaaaaatgacttgtagaataaagctgaagcaacccctctctctaacacagttttga

SEQ ID NO: 3440 - DNA, 447 bp, Cicer arietinum
acaactctaccagattttggtttgactgagaaagaggatgcaaaatacacttctttccacagtgaaacaacaattgatgctgtaacagcatatggtgaaagtatagttgagtctgaaacaatagaatcagcagagcaagagacaaatgtatctcctgatttatcgctgtcaaagaactcttccaaagatgacaaacacaaaccttcaaacattccttgcggagcttggtggaagcgaagagctgcttccatatatgctcatgcaaaggaggcaaatacattatggtccgttttcattgcagctacagtgatgggcctggtaatgcttggtcaacgctggcaacaggaaaaagctttacaacttaagtggcaaatcagtataactgatgaggccaggagcagggtgcttgctcccatgattcgactcaaagatgtgattattggtggc

SEQ ID NO: 3441 - DNA, 273 bp, Cicer arietinum
tgcaaaagattctacccgccgctcaataggaattgcgtttcaaggtgtcccgcaaggctcatccgccttacgaggtccaccaacgacacgtgcctctggggggccaaggccccctactgctggtcggcaagcgaacgacgggcacacgcatcgcttctagcccggattctgacttagaggcgttcagtcataatccaacgcacggtagcttcgcgccactggcttttcaaccaagcgcgatgaccaattgtgcgaatcaacggttcctctcgt

SEQ ID NO: 3442 - DNA, 403 bp, Cicer arietinum
acaagctttttacacacactcttgagaaagagggagtttcttattccttctagaaacaaaaacgcttctttcggaaacggagatttagggttttcatttatcggcgatcgaaaaaagcgagatttgaaattgtgagaagaaatggcagagcatcacgaacacgacgaatcaaagggtgaatctttgttagacaagatttcagggaaaatccacgaccacgattcttcgtcttcatcggattccgataacgagaaaaagaatccatccccttctactctcaagtcaaaggttttcaggcttttcggaagggaaaaaccacttcacaatgttcttggtggaggaaaacctgctgatgtttttttatggagaaataataagatatcagcaacggtgcttggagtgg

SEQ ID NO: 3443 - DNA, 416 bp, Cicer arietinum
cgttctagccgccttggggttttctcctgcaagggttttccccaaggatgcacggttctagggttgcagctactggcgatcttaggggatcatggacttcctgcctcagggtatggaaagctacttgatctatccgtgcaggagaattctaggctggagaggaatagttcccgctgacgggatgacctcttgaaagtaatgcgccttcgtgccgatgatatgctggatgaactagacggaatcgcagttgcatggggatatgtcctgaatcacctgctttgacatccaagatgatgtgcttgaacctaccgtagggctggctacgagtaggaaggtgccctcgggggaaggagctcgagaggctctccgttgatgctagtggacatggcgggtattctaggaggagtccagcgcga

SEQ ID NO: 3444 - DNA, 451 bp, Cicer arietinum
cccaaaaaagaagaaggaaacctcgattttactttgaaaatgagacctgctgtagccgctcttattttcctcttccttttcttgtttgcagctacaatagaatcgagaaatgatctaaaggagtattggaaaactattatgaaagatgaagagatgccagtgggaattgaagggcttcttcaactgaaacctgagatagaacctgtgaagaactacaagatcaaagaagaacatgctaaaggtaaatgtgatcagcatcccataacaaacaccttaaatatcatagagaaaaaggtgatcactgaagaatttgaatcaaagcccactatttcaacttctggtgatgatggcaagattgaagattttgagccaagaccaagtgctacaagttatgatggtgatctaaaaagtgagtttgaacccagaccaagtgttacaaaatatgacggtg

SEQ ID NO: 3445 - DNA, 344 bp, Cicer arietinum
accaaaggccgacgatgcttatctctctgctctggtattatgttttagtcggatttttcccgcaatactaaatgctgctgttgatctcaatttgtttgatatcatagctaaaacacaaagttcacatggttcaagcttatatgcatctgaaattgcttctcagcttcctaatcaacaccctgaattgactgataggctcgagcgcatgttgcctgtgttggccagttactctcttcttaattgctccattcgtattaatggagagggtaagagagaaagagtttatgctcttacaccaattggtcaatactttgcccttgataaagatggaggctctttgggtc

SEQ ID NO: 3446 - DNA, 335 bp, Cicer arietinum
acagtggaaccttgaagtagaggtcaaagaagtagcaaaactcagacaaaaaattgcatcaaaagagtctgttcatgaagagctcagaaggagcataaggaatcctcatcaaactgaagcttcacgaaatcaactagcttcaaaaggagttgagtttgaacgagaaattcttgaggcagagcactcttttattaacgataaagttgcacaattgcaggaaaaggcaaggaaaatggaagctgacattgaaatgacaaggaaggagatagaagagccaacagaagttgaagttgagctcaagcgaaggcttcatcaaatgactgatcatttaatac

SEQ ID NO: 3447 - DNA, 300 bp, Cicer arietinum
caggtaatcgacacagtaactgaactcaataccaaagagagagcaagatggccgagcaaactttcatcatgatcaagcccgatggtgttcaaagaggcctcgttggtgaggttattagcaggtttgagaagaagggtttctacttgaaaggtttgaaactccaaaatgtggagcgtgcttttgccgagaagcattattctgatttgtctgcaaagcctttctttagtggattggtggattacattgtctctggccctgttgttgccatgatttgggagggcaagaatgttgtgctcactg

SEQ ID NO: 3448 - DNA, 438 bp, Cicer arietinum
acgagcttggtcgccagccagctaacaccaagctatcaagcaacaaaactgttagacgcattcgtgttagaggtggcaatgtgaagtggagagctctcagattggatactggaaatttctcatggggaagcgaagctgtcactcgtaaaacccgtttgctcgatgtggtttacaatgcttccaacaatgagcttgtgcgaactcagacccttgtgaagagtgctatcgtgcaggttgatgctgctcctttcaagcagtggtatcttcaacactacggtgttgaaattggaaggaaaaagaaaactgcttccaaaaaagatacaccagaggaggccgaagctgttacagaagaagccaaaaagagtaaccatgtccaaagaaaattagagacccgccagaaagaacgccagcttgattcccacattgaagagcagtttg

SEQ ID NO: 3449 - DNA, 408 bp, Cicer arietinum
acaatgatatcgcctgcacgaacaacagtcttggatccatcagccaaaaccatctctaactccccctcaaacacaattccatagtcaagcgatgcagtcctatgattgtgccctgaggaatttggtggaaagtcgacgactcgaattagtgagccgggcgtatagattactggatcggtgccgacaggatctttgtcaacgagctcagctgggtgcttgtcgtttctccagatagtgactgcattgctgccaaagccggaggtgagtttgagctcttcatctgataggattgcagagttctggcccttgtggtgggtgacaacccttctcagaggactaccagcgttgagacccatggtgtctgaaactgaggttttgtgaatagttcttgtcaatcttccttgtaag

SEQ ID NO: 3450 - DNA, 196 bp, Cicer arietinum
actgtgatggacaatttatgccgccgccaaacattgttcaagaaagtgtggttggtgatttacggagcttcgattgataatgatatataactggttttcaaagcttcttccgtgaacacataatttttcaattctaatgatttggtttatctctctctgtttttgccttaggatggatgaaattgtaaatttgggt

SEQ ID NO: 3451 - DNA, 424 bp, Cicer arietinum
tggtttcgaatcagtcgatggttctagaaagcaggtttctggaacaaacaaactacgttctggaaattattgggaaggagcgccaattatttgagacttcacaacaacaatgccagtataacttacaagaaaaaataaatcaacagtccatattatacaacaaattgacaactcaaatcgaaggacaaaataaagacatacaagaaatcaaacaatttttaaaattattggtccctagaatagttggaatcgaagcatcctataaagtactttcaactgaaaatccgataatggaaagccaacaaaaaccaagaccaataaaacggaaaaaacaaagctagagctccttgccttttcgggaatgtgaaagcgattttaagtttctgcctttgctcacatgacggaatctaaaatttgtgtgttg

SEQ ID NO: 3452 - DNA, 341 bp, Cicer arietinum
tggcggcacctcataaccagaacgccttatatatcggaggacgatgcctatggcatcggtagcgacatcctcccgatcaacgacgccgattgcgatgggtttttctcctttgaaggcaagccgcaccgccggcctctgatcccttcccgaggtttttccctgccgccacgacagtcgactacgagctacaacttggttactggagattgtggactgcgtcagcagatgtagcgatgcgtgggagaattctggtcggtggaaaaattcgacaaattgcctccgaacccgctgacgggtgacgggcttgacaaaaacagcgccttttgtgccttggtatgctg

SEQ ID NO: 3453 - DNA, 342 bp, Cicer arietinum
tggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccacgacagtcgactacgagctacaacttggttactggagattgtggactgcgtcagcagatgtagcgatgcgtgggagaattctggtcggtggaaaaattcgacaaattgcctccgaacccgctgacgggtgacgggcttgacaaaaacagcgccttttgtgccttggtatgctgg

SEQ ID NO: 3454 - DNA, 191 bp, Cicer arietinum
tgatcccatcatggacaagttctggggcaaccgtgtcaacgtttccgaaacttccgccatcgtcactgagacacccagcatctccgctaccactaccagccgtgaccctcctctgggcaccaacgtctttgagccttcatccgctcctcgctggtctggcatctccatccctgctggccgacaatagatga

SEQ ID NO: 3455 - DNA, 433 bp, Cicer arietinum
tcttctcaaagctatggttctcgatcttcaaggttttcgaacttccgcgctcgaatctcttgacgcggcgttgtctccgcttgcggctggttctttagccgaaggtgaacgaggtgacgcgctttataagagagccgagttgaaactcgcgacgagtgaacgcggacgagttgactcggcgctgaaggatttgactgagtcggttattttgagttctaagaacgcgaaagcttggtctgcgttgggagagtgctatgaaggaaagaaaatggaagaggaagctaagaaggcttataaggaggctcttgagttggagccacatttttctgtgccgctagaagcacttaacagtaataatggaacaaaagtcgaagatctgtcttgaacttcttttggggaagaatgtctgttggaggagaggtgtttcattagc

SEQ ID NO: 3456 - DNA, 417 bp, Cicer arietinum
attctcatcctctcttcacacacacaacgcaacccaataggattattatcgaatcgaaaaatggcggcatcggattcatctcgcgaagagaatgtttacatggcgaaattagcggaacaagccgaacgatacgaagagatggttgaattcatggaaaaagttgcaaaaacagttgaggttgatgaactaacagttgaagaaaggaatcttctttcagttgcttacaaaaatgtgataggtgcaagaagagcttcgtggagaataatttcttcaatcgaacagaaagaagagagtagaggaaatgaggatcatgttgctgttataaaggaatataggtctaaaattgagactgaacttagcaaaatttgtgatggaattttgagcctacttgaatctaatcttgttccttcagctggt

SEQ ID NO: 3457 - DNA, 433 bp, Cicer arietinum
gttgacgcaatgtgatttctgcccagtgctctgaatgtcaaagtgaagaaattcaaccaagcgcgggtaaacggcgggagtaactacgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacattgtcag

SEQ ID NO: 3458 - DNA, 320 bp, Cicer arietinum
acttcaacttttttctgtgaaattgttgccaccaaaatgcaccttgaccatctatggtcccattttcccctgtgacaataacatcggtgaggttagttccaaatatgaggctggtgtatcttcctgctggtgcgtctctccctctaccgtatgatggtaaaggttcaatcacaggccactcagttatatcctgagaagcaaggagaatagcatctttatccaaatagagagtgaaatgactagtaaggctgaaactaccagtaagccattttcctgcaggaacatacagctgagaaccaccttcattaccatactgactc

SEQ ID NO: 3459 - DNA, 416 bp, Cicer arietinum
gggaagatgggagcacctccaaagagtgatgttccaattattacaccaaatgagctcactgaagctgatggtttgttgtttggttttccaacaagatttggaatgatggctgcacaattcaaatcatttttggatgcaactggaggcctatggaacaaacagtcacttgcaggaaagcctgctggcatcttttacagcactggttctcaaggaggtggccaagagactacaccgttgacatctattactcaacttgttcaccatggaatgatatttgtgccagttggatacacatttggagctggcatgtttgagatggagaaggtgaaaggtggttcaccttatggttcaggaacatatgcaggggatggctcaagacagcctagtgagttagaattggctcaagcttttcatca

SEQ ID NO: 3460 - DNA, 205 bp, Cicer arietinum
ctttcttatttcttcttcaaattagtgcagcagaaaaagaagatgatgaggttgaagttgaagtatttggctatgaagatgttgttggagccatggccaaataaatgatggcgcaagaattatacatatatatgccttctaggcaagtctgatgcttggcttttcatctctgtttgttggtttagtttttgtgagaatcaaatca

SEQ ID NO: 3461 - DNA, 428 bp, Cicer arietinum
actccgcactctgcacacaattttacaagagcagggttctctggacagttctaaggctgagagcatggttaagaacctacaaatgaatggcagatatttgcgtgatgtatggtgatgatgacctctgagtgtaacaaacggggtcgtggggttatgataaagcggccgtaaagagtagtagtggatatatagaagataagctattggaagggccttatttgtcgccatacactgatgccctcataagagggataaggggttccttctgcttgtaacattatgccaattcctatgattcttttttactatattttcaaatgtattcttttttgttcgtgtaacttatacttagttaatacatagactatgtattttagctttcttgtattgtatgaacctacaaagagggttcggaggcacatataatt

SEQ ID NO: 3462 - DNA, 467 bp, Cicer arietinum
gagaaaaaaaagaaagaaaaaaagaagaaaagatagagagactaataaagagacaaattcaaagaagaagaagaagggtttcgttgaaaaacacgatgcagagtgaaagcaacaacaataaccagttggtagttcagaattctggaagtttaagcttcagtagtcacttgtctaaggaagatgaagagatgtcaaaatctgctctttcaactttcagagctaaagaagaagaaattgaaaagaagaagatggaagtcagagaaaaggttcagcttcagttgggtcgtgttgaagaagaaaccaaacgtcttgctaccattcgtgaggagcttgaagcccttgcagatccaatgaggaaagatgtttcaattgtccgaaagaagattgattcaataaacaaagaattaaagccacttggtcatacctgccagaagaaggagaaagaatacaaagatgcccttgaagct

SEQ ID NO: 3463 - DNA, 297 bp, Cicer arietinum
gcgaatacgaaccgtgaaagcgtggcctatcgatcctttagtccttcggaatttgaagctagaggtgtcagaaaagttaccacagggataactggcttgtggcagccaagcgttcatagcgacgttgctttttgatccttcgatgtcggctcttcctatcgttgtgaagcagaattcaccaagtgttggattgttcacccaccaatagggaacatgagctgggattagaccgtcgtgagacaggttagttttaccctactgatgacagtgtcgcaatagtaattcaacctagcacct

SEQ ID NO: 3464 - DNA, 201 bp, Cicer arietinum
accctttggataaggatcaactattgggactgggacttctgggacgacataattagatttcaccatagttaatgaaatgagattgagacataaaattagtgaaatattaatgctagcaacattaaccttacaagccatttaaaaaaaaaatctgattagtatagctaggatatactaattgtttgtgaatagtagcttatt

SEQ ID NO: 3465 - DNA, 383 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttggcggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtggaggtggatatggcggaggaggtggtggt

SEQ ID NO: 3466 - DNA, 350 bp, Cicer arietinum
actcattacctccaagaggcacctctctactcgtagccagctctacagtagttgtcggtgaagcacgtcccattggacatcaatacagctgatctcagcagagcttccctccagcaacgcttctatctagttcatccagcatatcatcggcacaaaggcgctttactttcaagaggtcatcccgtcagcgggaactattcctctccagcctagaattctcttgcactgatagatcaagtagctttccataccctgaggcaggaagtccatgatcccctaagatcgccagtagctgcaacctaggaccgtaccatagaatttgaagggtaatatggtatttgattttttaa

SEQ ID NO: 3467 - DNA, 245 bp, Cicer arietinum
gaggtacaagaagaatatgtcaaaagtccatccatccaaacacatatctgacatccctccagaatctctcataagtcagaagtccagcgccgtcctctcgctatgcgttttcacacacaggtcatataccatgatcgtgaatcagcacgagtcacccactcaataaccacagcacaaacagctactatccttcatcgtcgaagagcgaatctagtagtgaggagcctggtaggtaggagccttgt

SEQ ID NO: 3468 - DNA, 200 bp, Cicer arietinum; identical to SEQ ID NO: 506

SEQ ID NO: 3469 - DNA, 272 bp, Cicer arietinum
acttcagtgctttgaattacaggtagcaggaccaaatggacaaatattgaaaggtgctgatgctaaggttagcatggatgaaagacctggtctcactgttccaagagcacataatctcgtttgtgttccacttgcaagacctggtgctgctgctaaactcctttcctcctaaaacatacattcaaacacttaattcgtccatgtccgtttataaactaaataatcattttcaataaggtatcattgagagagtccacaatgtgtgctagtga

SEQ ID NO: 3470 - DNA, 351 bp, Cicer arietinum
acaaacaatgatggatgtgaaaacacaataaataggaaattaaattattgaaaaccctctcctctcttctcatctcggtatacagcaaaagaaatagcactagttatataaagctactttaagcctaattaacaagacaattaacaagtcataactcaatcttaacgtggtgaacatgtccctcttttggcaaatgatctatagcaaaactcagcaacccagaatcattgtcatactcgaaatcaacaacactatcttccaacaaacaccttgttggtctaaccgaacaatgagcaccaaacttgccacaccccttaatctccaaatgaactccaaccaacccatcctcgt

SEQ ID NO: 3471 - DNA, 429 bp, Cicer arietinum
acattagtgatgggtttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagttaataattaatgtaataaatgtgtgctgtaatatatatgtggtcgcggtttgcttgggttcttaatgaaataa

SEQ ID NO: 3472 - DNA, 305 bp, Cicer arietinum
gctcccggtccccatggcggaggagggaattcgattagcgtggtcgcggccgaggtactcaagagagccccataatcccaccaagtcatgcaaggctagaggcgctgatcttagagttcatttcaagaacactagggaaactgccttttcaatcaggaaattgcctttgacaaaggccaagagttacttggaggatgttcttgcacacaaacaggccattccattcaggcgtttctgtcgtggtgctgggagggccagctcaggccaagaatagacactctaatggacaaggaaggtggcctgcc

SEQ ID NO: 3473 - DNA, 303 bp, Cicer arietinum
taaggtctttctttctgccgtgtcgtttgctgttattttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttca

SEQ ID NO: 3474 - DNA, 446 bp, Cicer arietinum; identical to SEQ ID NO: 402

SEQ ID NO: 3475 - DNA, 407 bp, Cicer arietinum
gatgaaccggtccgcgagtcatgaatcatcgctaagccaccagtctgaggcggtaaatgcggcggcggtggatggagagagtaaagagagtgatgaaagtatggcttcggttgaaacggctgagacttcgatgaacttatttagagatgaaccggagtcaaccagagatttgaaacgggtggaccgaaccggtgaaagtggagaggaaaatgttggtttagaattgactcttgggtttgaaccggtttcacgtgttcatcacgtggttcctgtgaagaaaagaagagttgaattgaaagattgtggtggcggctcatggaagattgagctggggcttccataaacggcttaaggggctttgtggtccggttcagttttgacttaatcggctttctatcatttgtacc

SEQ ID NO: 3476 - DNA, 429 bp, Cicer arietinum
acacacatgtaaggagagtattgaagaagttgatgaacaaaacaagaaaatcacttacaagctatttggtggagatattgatgagcactataagatctttaaatttatcctcgaaatatttgataagaacgatggaagtgcagtagttaagtggagtgttgaatatgagaagatcaatgaggatattcatcctccaaatggctatattgaataccttaacaaatgcactagagagattgatgcttatcttgttaaagcataactccataagtcataaataaaataatcaataaggagtaataatggcttaatggtgttggctatgtggatacgagtgatcatttaataattagtgtgatataattgtaatggcatgtgttaacgttgcctaaagatatgcatatatgcattggctttgatcctttgttt

SEQ ID NO: 3477 - DNA, 437 bp, Cicer arietinum
ggctctgattgcaccagatgttcccggtttagaccgaaacaagtgcataaaaatggctattgttcatgacattgcagaagcaatgataggggacataacccccatggatggaatttcaaaagcagaaaagagtcaacgagaacaagcagcacttgagtatatgtgcaaaataattggagaaggatcaagaggaaaggaaataactgagttgtggacaggctatgaagcaaattcttctccagaagcaaaatttgtcaaggaccttgacaaggtagagatgatacttcaagccctggaatatgaagacgagcaaggaaaggatttggatgaatttttccagtcaactgccgggaagttccaaactgaaattggcaaagcttgggcatcagagattgtatcgagaaggaataaaaactaaatccccttgtcattctgac

SEQ ID NO: 3478 - DNA, 428 bp, Cicer arietinum
acactcagaatcatacttgaatagtttgaaggaaagttcgaatgttgccaagataattgaggtccctcctgtggcattttttcccaattgtcttgtgcaacataaagttcttttcccatttaggaaacaggttggaggaactatattggctgcaaaacttgcaaaggagagaggatgggccattaatgtgggaggtggttttcatcactgctctgcagaaaagggaggtggattttgtgcctacgcagatatttctctatgcatccactttgcttttgttcagttgaatatatcaagggtgatgattattgatcttgatgcacatcaaggaaatggtcatgaaatggacttcgccgatgatagccgagtctatattctggatatgtataaccctggaatttatcctttggattatgaagcaagaaatt

SEQ ID NO: 3479 - DNA, 210 bp, Cicer arietinum
tggactcataggcaatggagtcgaccttatcatctctttgaagatagcaccgtagtccagggatgattctgcttcaatacaaatgcgagccatgattttcacagcaagttcaggataagctccggcagcactttcaccactaagcatgacacaatctgttccatcaagaactgcattagctacatcagttgcttcagctcgggttggccg

SEQ ID NO: 3480 - DNA, 335 bp, Cicer arietinum
acggatggggctggggccgatacggaaacttgggattgggagatagaaatgatcgttgtattccggagaaagtttctgttgattgtgacaagatggtcatggttgcttgtggctggcggcatacaatatctgcttcatcttctggtggtctatacacatatggatggagcaaatacggccaactaggacatggagataacgaggattatcttgtgcctcacaagcttcaagccttgagtgataaactaatttctcaggtagcaggtggttggaggcatactatggcactcacgactggtggactactttatggatggggctggaataagtttgga

SEQ ID NO: 3481 - DNA, 402 bp, Cicer arietinum
acaaggaacagaaggatcaattttggtcacctaagcttgccttctcttaaatccatcaccctttccttcaaggtcttttctcttctcccaccccaaaaagacaggagttaggagaagactaatgataaaatctatgatctttgaatccaagatggtcaagttatggactataacatcataattcagaagccatctttcttaagcaacacttatgatgttatctccatttttgttgaaacatggcattgcatataaagctgaatgtgctgatgatgttttcctttgatcagatgagaaggacagtccaagggaaagtgttggagggtcagtagatgaatcactagaactagaggtaatatcagatacagtggaagcttttggatctgaaacaacaaaaggaat

SEQ ID NO: 3482 - DNA, 260 bp, Cicer arietinum
acaatcaagcggcacccttgcccttcttcctctggagtttcttcatgtaaaattcaagctcttttccttcaagaatgtaaccatcagccctgccgcattgaccaggtcgagatgaaatgcatgcaagcaaacgcccaccaccaaactgctcttcaatgtgggaatcaagctggcgttctttctggcgggtctctaattttctttggacatggttactctttttggcttcttctgtaacagcttcggcctcctctggtgta

SEQ ID NO: 3483 - DNA, 189 bp, Cicer arietinum; identical to SEQ ID NO: 378

SEQ ID NO: 3484 - DNA, 318 bp, Cicer arietinum
ctcctctcagtctctcactctcgcggtgctctctgtctcgtctctctctttaccttcgtattatcgaattctgacttcaagttgaagacatgaatgcgttcaaggcatacaaggcatgtgccccaattgcttggagccccaatctctatataactctggtgaggggcattccagggaccagaaagcaacataggcgcactttggaagcactacgcctgggcaaatgcaaccgaactgtcatgcgatggaacacacctactgttaggggaatgatccaacaggtcaagaggttagttgttgttgagacagaggagatgt

SEQ ID NO: 3485 - DNA, 367 bp, Cicer arietinum
  misc_feature (44)..(44): n is a, c, g, or t
acggacaaggggaatccgactgtttaattaaaacaaagcattgncgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccaccgtccctgtctactatccagcgaaaccacagccaagggaacgggcttggcggaatcagtggggaaagaagaccctgttgagcttgactctagtccgactttgtgaaatgacttgagaggtgtaggataagtgggagctggaaacag

SEQ ID NO: 3486 - DNA, 437 bp, Cicer arietinum; identical to SEQ ID NO: 333

SEQ ID NO: 3487 - DNA, 425 bp, Cicer arietinum
gccacgtttcctaactcggttactttgactcggaacgattctctaaatttgagtaactcggagcgattttctctttttttcctttcgattttccccttcttcgttcgtcatgccgaaggctaaagctgattccaaacccgctgataacaggttaaagcgcaaaggcgcaggaaccggaacgaagcagtcgaagaaagctgctaaggatcctaacaagccaaagaggcctccgagtgctttcttcgttttcatgtctgacttcagagaacaatataagaaggatcatcctaataacaaatccgtcgccgctgtcggtaaagcttgcggagaagaatggaaatcgttgtctgatgctgataaggctccctatgttgctagggcattgaagaagaaagcagagtatgagaaaaatgttcaggcttaca

SEQ ID NO: 3488 - DNA, 355 bp, Cicer arietinum
acttctttgcaagtttcttcaccaatttcttatttttgtttagcttcttcaaagcttcaacatccatccagtccaatcctattttctctgcctcctcaacatgctgagcgtctccaagcatacagattttcatcttgggacgaggaatgtgaggcaatttaacagaaccactgaaacgcttatccttttgtggatcatagtttttaagaccaatctggagttcaatagtctccacaaatttcctgtttttctccttggaatcagccgtgattcctgagatggcttctctcagagcatcactctgaagcttactcatattggatagttggcctctggaaacgccaatcgatctgag

SEQ ID NO: 3489 - DNA, 272 bp, Cicer arietinum
acattaataaattattgatcacaaagagtgattgatttattgatagtagataggttgtaatatagaaattaatcaccgcaattaacaaaggtatagttaacagtaaggtgaccctgttggttgccctgtccattagtatcaagttgattgaagacattaacatccaagtccaaaccaccattggagcactgatcaactattctcactgctacctgacttccagttgcggtattcgtcaccctcaagcacttgccacaagaatctctgccttg

SEQ ID NO: 3490 - DNA, 406 bp, Cicer arietinum
actggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggacagtggga

SEQ ID NO: 3491 - DNA, 399 bp, Cicer arietinum
actattgctcagaaggtgggctttcttctgcttcaatcccttcatcttcttgatctgagtgtgggccagaacacggataacagttgcatacttcttcagtttctcaagctgggtctgaatgttcttctttccttcatcggtttcacactgctttgaatacttagtgaaagccttcttcttggacttgcaccaattcttgtagaacctacgcttgatttcttcactcaaatgctgagtccaaacagtattcaaagtccgaagaccgcggggagttttcacataaccaacaacaccaacaacaatcattggaggggtctcaatgattgtaactggctcacaggtctccttcttgtgaagcttggatcctggtttctcgacttctctgacaatgtgtgtcat

SEQ ID NO: 3492 - DNA, 178 bp, Cicer arietinum
tgcaaaagattctacccgccgctcaataggaattgcgtttcaaggtgtcccgcaaggctcatccgccatacgaggtccaccaacgacacgtgtctctggggggccaaggccccctactgctggtcggcaagcgaacgacgggcacacgcatcgcttctagcccggattctgacttaga

SEQ ID NO: 3493 - DNA, 84 bp, Cicer arietinum
acttcgttcaggcttgtattgattaaaggttgtcgtagaactaaggaactattgacatccatcgccccggcaactcagtcatgt

SEQ ID NO: 3494 - DNA, 293 bp, Cicer arietinum; identical to SEQ ID NO: 671

SEQ ID NO: 3495 - DNA, 436 bp, Cicer arietinum
ccatttcattgttgccgcggtaggggtagaactaaattattcgggatgggtagggttatcagggcacaacgtaagggtgcgggatcagtcttcaaatcccacacccaccaccgtaagggaccagccagattccgcagtctcgatttcggtgaaagaaacggttacctcaagggagtaatcaccgatatcatccatgaccctggtcgtggtgcacccctcgctaaggtctctttccgtcatccttttaggtataagaaacagagtgagcttttcgttgctgctgaaggaatctacactggacagtttatttactgtggaaagaaagctactcttgttgttggtaatgttttgcctctcagatctatccctgaaggagctgttatttgcaatgttgaactccatgttggtgaccgtggtgctttcgctaggtgttctg

SEQ ID NO: 3496 - DNA, 121 bp, Cicer arietinum
acagagcttacctggagaccgtggaatgaggcgactacctcgtctacagagcagcgttctggccaccttgggtttttcccctgcgaggggtttccctaaggatgcatagttctagggttgc

SEQ ID NO: 3497 - DNA, 132 bp, Cicer arietinum
aaaacataatacaatattattatttgagtaaactgttacatcattgaggagtgattattatgaacgaaggaagaacaagtaacataaaatggatttttggcacaaagcatgtgaagccatttaaaagaaaat

SEQ ID NO: 3498 - DNA, 222 bp, Cicer arietinum
gttgtctccgctgctcttcaatcggaaggaggtttacaaaaaagagaagagaaaatgagtcgaagtggtgcagctggagccaagggaaagaagaagggtgcaacattcaccattgactgttctaagccagtggaagacaagatcatggacattgcatctcttgagaagtttcttccagagaggatcaaagtcggtggcaaagctggtgcccttggggattct

SEQ ID NO: 3499 - DNA, 197 bp, Cicer arietinum
gcatgctcccggctcccatggcggccgagggaattcgatttcgagcggccgcccgggtaggtcttagatatcggcggacgatgcctatggcatcggtagcgacatcctcccgatcaacgacgccgattgcgatgggtttttctcctttgaaggcaagccgcaccgccggcctctgatcccttcccgaggtttttccc

SEQ ID NO: 3500 - DNA, 402 bp, Cicer arietinum
acttaagatgataacagtataatttatgcgtaaccaaatcaataacattaaagcaaaaccattaatgaacaacaagaaaaagcaaaactaggttcggattggatttatcagactgaatatgtttcaacagaaacaacataactggaaatcctaaccaacgcacaaaactctaatgaagttccagcaatggataaaaataggcgaatttcacaatcaacgtgaagtttatatctttactcgtagatccaagagtggaggctgctttgccagttggcagggccctcagggaaccacaatgcaatttccttggttgcactttcaacagaatcgcttccatggataacgttccttccaatgtcaatggcaaaatcaccacgaatagttcctggctcagattgagca

SEQ ID NO: 3501 - DNA, 306 bp, Cicer arietinum
cggtgtgttcaaagaggcctcgttggtgaggttattagcaggtttgagaagaagggttcctacttgaaaggtttgaaactccaaaatgtggagcgtgcttttgccgagaagcattattctgatttgtctgcaaagcctttctttagtggattggtggattacattgtctctggccctgttgttgccatgatttgggagggcaagaatgttgtgctcactggccgaaagattattggtgccactaaccctgctcaatctgagccaggaactattcgtggtgattttgccattgacattggaaggaac

SEQ ID NO: 3502 - DNA, 436 bp, Cicer arietinum; identical to SEQ ID NO: 386

SEQ ID NO: 3503 - DNA, 320 bp, Cicer arietinum
acacggtgcttgagcgtctcaaacatgagctgcggctcgtgctgcatcactcggaggacatctgcacacgacggtccagaaacagcccgcgtcacccgcaaaccgtgtggaccgtcgctctgtaacacccctacaacactagggccaccaaacaggttgtggaacccaccaagcgcctcctcattagccccgccccagaacattcccagatagtatcctccaccattttgtccttccaattcatgaagtggccagcttgactccacaccaatgaacttgtttatctttccatcactgtcacaagttaagtcagaataaat

SEQ ID NO: 3504 - DNA, 299 bp, Cicer arietinum
tgcagcttcaaccctaacacctgcagagaatagatatcgcgacgcagccatgggaaggagacctgccaggtgttacagacaaattaaaaacaagccataccctaagtcacggttttgccgtggtgttcctgatcccaagatcagaatttatgatgtcggtatgaagaagaagggagttgatgagtttcccttctgtgttcatctggttagttgggagaaggaaaatgtttctagtgaggcactcgaagctgctaggattgcttgcaacaagtatatgtctaaatttgccggaaaggata

SEQ ID NO: 3505 - DNA, 400 bp, Cicer arietinum; identical to SEQ ID NO: 491

SEQ ID NO: 3506 - DNA, 429 bp, Cicer arietinum
acagcctctcatcaaactttacaagaaaaaaatgactgattattagtcattgattcatgccacaaaaatggcaattctagcatttgttgggatctaaaaaaagccttctacacaacggcttcaaattaaaaaagaaaagaagaaaaaaaaacattcttgttttttttttttcttcttcttcttccatattaaacactaggacaaaaaagagacacatgacgaaaatgtttaatgaaagcctcctccagttgctgacacagacttggccaaatctggtggtggagatggaagtaaaattatggataatatgccacttgctagagccgccaccgcgcccaccacgaatgccggcaagttaccacctccaaacagagcatcccatggtccactcagaacagacacaaacatctgtggtatgacaattgcaag

SEQ ID NO: 3507 - DNA, 247 bp, Cicer arietinum
acactggagctcatgctattgctggaaggcacactcctggaaccttcaccaatcagctacaaacttccttcagtgaacctaggttgcttatcctcaccgatccaagaacagatcaccagccaatcaaggaagctgctcttggaaatattcccaccattgctttctgtgacaccgattctccaatgaattatgttgacattggaattcctgctaacaacaagggaaagcataccattggttgtctctt

SEQ ID NO: 3508 - DNA, 263 bp, Cicer arietinum
acaataaaacttatcatacttttatttcattaagaacccaagcaaaccgcgaccacatatatattacagcacacatttattacattaattattaactagcgaaaagcaaacatcaacaacaacattctttatttattcgcgttatgatgatattattattttaaaagggttataattaatcttgtgcagcttttccagcacgatggtcataaccatgaaccccaagattaattattttgagggattatgccacgaaagagatg

SEQ ID NO: 3509 - DNA, 433 bp, Cicer arietinum
ctcagtaactcatggagttcatgctgtaaggcttggaaatgaagcttcaatttcacaaactataaaagtcaaacctggtcaacgttatgctttaatccttggcgcatcaaggacttgtgcacaagatgaggttttgagaatctctgtgccaccacaaactggtgatgttcctttgcaaacattgtatagtctcaatggtgatgttattgcttgggggtttaaagctacttctgatgttgctaaagtgacttttcataaccctggtgttcaagaagatccagcttgtgggcctcttcttgatgcaattgctattagagagttttaccctccaatgcctactagagccaatttggtgaaaaatccaagctttgaagaaggtccattcccaattttcaacacaacaaatggtgttttactcccaccacaacaagaa

SEQ ID NO: 3510 - DNA, 394 bp, Cicer arietinum
acaagaagattgccaaaagggctgatgcatttttgcagggacttattgaggaacatcaaagtggaaatcaaagtaatggagatactatgattgatcaccttttgaatttaaggaagtcacaacctgagtattattctgatcacatgatcaaaggtcttatccaggctatgcttcttgcgggaacagacacgtcagctgtgacaatagaatgggtgatgtctgaattattgaaccatccagatgttttgaacaaagcaaaagaagaaatagaaactcaaattggaaaagacaaattaatagaagaacatgatttatcaaaactcccatacctacaaaacataatcaatgagacacttcgattgcatccaccagctccactatcattgccacatta

SEQ ID NO: 3511 - DNA, 240 bp, Cicer arietinum
acccttcgctcgatgcagacgttagctcgtgtgcaatctcagattcgttctaggagggtcagaatgttagaggagaatcaggctctgcagaaacagctcttacagaagcatgcaagggagcttgagaccatgcggattggggaggaatgggatgatagcctacaatcaagagaacaaattgaagccaaattactgagcaagtatgaggctactatgagaagagaaagggcactggcttat

SEQ ID NO: 3512 - DNA, 373 bp, Cicer arietinum
caaacaacgcaatctcattgagagaaggtcctgccttatccaattttagggtttctattcttcgctaatcaccccactgctttacgcatcgaaaccctaaactaagatcaggtctgagctatctggttggtgggaccttctgttttggagattaagtttcatgtctgaattagacgcacaaattcctactaccttcgatccttttgctgaggcaaatgctgaggattccggtgctgggacaaaagagtatgtgcatattcgtatacagcagcgaaatggtagaaaaagcttgacaactgtgcagggattgaagaaagaattcagttacaacaagattcttaaagaccttaagaaggagttttgttgtaatggt

SEQ ID NO: 3513 - DNA, 227 bp, Cicer arietinum
gtggaaaggcagaagtaacagggaagaatgtgaagagtatatcttctaattcatctgctactgagcaagacttggatacatttcttcttggagatcttgaagacagtgatgaagctccagatgatggtgatggcagctttgatgatgattttgacaagattggcaattctgatgttgaagatgagaagcatgcaaagaaagcatctgctacaacagtttaggatacg

SEQ ID NO: 3514 - DNA, 196 bp, Cicer arietinum; identical to SEQ ID NO: 445

SEQ ID NO: 3515 - DNA, 313 bp, Cicer arietinum; identical to SEQ ID NO: 536

SEQ ID NO: 3516 - DNA, 294 bp, Cicer arietinum
acctttattaatgcaatgaagaaaaaatgttcaaatacattgaattaaatttaggggacgctgaattatttggcacattgcaagttacaacaaagaaaaactaaactttttctctccccttaaattccttgtttgaacttccaaagcaaaccactcttaatttattggcaaacaaatttattaaccacaaaaagaatctagtcactccttgcgaattcctttgtttacatgtttcctccgtataacatgcactgtttgcgacttggtgttcaattaaagcacagaacaatcagt

SEQ ID NO: 3517 - DNA, 118 bp, Cicer arietinum
actgaagctgttaccttttttagctcagctgtttccaaacatgtcttttccgatgttgttgttccgcctaatatggatttgggtatccacaaaaggttgtgtcatcttgttaagggtt

SEQ ID NO: 3518 - DNA, 397 bp, Cicer arietinum
  misc_feature (114)..(114): n is a, c, g, or t
acttgctaatgcaagttagttgcttatcttattgatagtttcatgattcacatatccacccatgtcctacaaattctaaattgaaaaccatactgaaaccaggcaaactgactncaatagaaaaaaatgcaaactgactcgaaatagatgacaatattttatttatatgaccccttcagcatgcttggctattgtcgattgcagcttctccttctgagcaccacaaccttgtccactagttttcccttctttcagaacaagaatgttggcatagcttcaacaccccactcctcagcaacagtcttcaattcatccacgtcaaccttaaggaaggtgacattcggcagctttttagcaatctctgctagaattggagcaatgaaacggcatgggccgc

SEQ ID NO: 3519 - DNA, 344 bp, Cicer arietinum; identical to SEQ ID NO: 3445

SEQ ID NO: 3520 - DNA, 112 bp, Cicer arietinum
aaataaaaaggtcgaagagaggcactgccggaagggaacaaccaccgtctttcaattttccggcgatctcctcgtttcttccacctgcgatctaatatcccaacaatcaaac

SEQ ID NO: 3521 - DNA, 212 bp, Cicer arietinum
accatacaaggaagagacctgaaccattaacactagaagaagagagtgatcttgaacttgctaataagagattccttgagctatgtcaaaagtgtgttcaagccaatattcctttgttggttgatgcagagcatacatcagttcaacctgcaattgattactttacttactcatctgctatattgcataacaaaggtgaaaaccctattgtg

SEQ ID NO: 3522 - DNA, 250 bp, Cicer arietinum; identical to SEQ ID NO: 505

SEQ ID NO: 3523 - DNA, 408 bp, Cicer arietinum
acacagagacatcaaagccaaaaatatacttattgatcgaaattttactcctaaacttgcagactttggtttggccaaattaatgagagatgaaacatcttacattagcactagagttgcagggacattgggttatttggctccagagtatgctagttctggacaactaagaagaaaatcagatgtttatagctttggagtgttgcttttacaaattatcagtggtttggcggttgtagatgcctatacagatatcgaacgtttcattgtagaaaaggcgtggacagcttatgaggcaaatgatctattaagaatggtagatcctgtgcttaatacagactatttagaagaagaagccataaaattcctcaaagtgggtttactttgtgttcaagaaaccgcaaaact

SEQ ID NO: 3524 - DNA, 140 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggattgtga

SEQ ID NO: 3525 - DNA, 328 bp, Cicer arietinum
gtggaaaggcagaagtaacagggaagaatgtgaagagtatatcttctaattcatctgctactgagcaagacttggatacatttcttcttggagatcttgaagacagtgatgaagctccagatgatggtgatggcagctttgatgatgattttgacaagattggcaattctgatgttgaagatgagaagcatgcaaagaaagcatctgctacaacagtttaggatacgtaattaccttttaagacagttgaaattgaagtttgctgcttgcaactagcagagatatccgccagagacgaatggttgtagcagtctcaaacggtggctgt

SEQ ID NO: 3526 - DNA, 230 bp, Cicer arietinum
ttaccagcttaaatatccagcacctggagctccaaagttagctaaaagggtgaaggagctactcaacaaatccggcttcaaccgtgtcgccgaagacgaaaaacgaggactcgatcacggtgcttgggttccactcatgttaatgtatccagaagctgacattccagtttgtcaattgtctgttcaatctaacaaagatggaacttaccattataacttgggaaaagcat

SEQ ID NO: 3527 - DNA, 390 bp, Cicer arietinum; identical to SEQ ID NO: 560

SEQ ID NO: 3528 - DNA, 406 bp, Cicer arietinum
aaaaaagaagaaggaaacctcgattttactttgaaaatgagacctgctgtagccgctcttattttcctcttccttttcttgtttgcagctacaatagaatcgagaaatgatctaaaggagtattggaaaactattatgaaagatgaagagatgccagtgggaattgaagggcttcttcaactgaaacctgagatagaacctgtgaagaaccacaagatcaaagaagaacatgctaaaggtaaatgtgatcagcatcccataacaaacaccttaaatatcatagagaaaaaggtgatcactgaagaatttgaatcaaagcccactatttcaacttctggtgatgatggcaagattgaagattttgagccaagaccaagtgctacaagttatgatggtgatctaaaaa

SEQ ID NO: 3529 - DNA, 175 bp, Cicer arietinum; identical to SEQ ID NO: 1367

SEQ ID NO: 3530 - DNA, 278 bp, Cicer arietinum; identical to SEQ ID NO: 576

SEQ ID NO: 3531 - DNA, 435 bp, Cicer arietinum
cagcgcgtggatcaacgaaatggcgaggattaaggtgtatgagctgaggaacaaaaccaaggcggatttgttgaaccagttgaaagatctgaaggcggaactcgctttgctacgagtggcgaaagtcaccggcggtgcgcctaacaagctctccaaaataaaagttgtgaggctttcaatagcacaagtgttgacagtgatttcacagaagcagaaagctgcactcagagaggtttataagaataagaagtatttgccacttgacctacgtcctaagaagacccgtgccattcgaagacgccttaccaaacaccaggcatcattgaagacagaacgagagaagaagaaggagatatactttccattaagaaagtatgcaatcaaagcttaggctaggattgctttctagcttccggttgtagaccagttatttga

SEQ ID NO: 3532 - DNA, 408 bp, Cicer arietinum
acaaacagcgccttcttgaaatagactccatgatcagcacatgtttccatcaggcgaggaagaagcaactgaggatctcggacagtcaaacagttgaacagcaatatcatagcggattttctctggaatcctctttccacatgttgcatcttcactacttcatgcgaggatttaggattattcggttgctgacgaaacaatgtttggttcgggttgttttctttgatagcaagagaaaaccaccttgcacaaacttccatgctttcaagactatgagcgccatctaaaaagaaaacaagttcatttaattgttcactcttgaagtgcctgtcggtaacaatctgagcccttccttgcaaacttgcatttgttaacccttttacgaactgttccggcaaagcaacggtt

SEQ ID NO: 3533 - DNA, 281 bp, Cicer arietinum
aacaataatagtggtttattaccatagctctctatgaaagattatgaagaatatatgaaaataaagaaagtgatggaaggaagatacatcgaaagagaaaaaagggaagcaaagtttccgcgttttgtcttcaggaaagaaaaggcgttaatttttctattatatggtgataagattgttattgtgttttttttctctaatttctttaagctgttatgtattttagctttttatttattttgacagttgtaaagcagtctgttctgctgttaattaatagt

SEQ ID NO: 3534 - DNA, 294 bp, Cicer arietinum
tgctcttctggagcacgagacacttacaggaagtcagataattgatttacttgcaaaggtcaaatcccagccgcagcaaccgcagcagtcacataaagttgaagcacagggatttgacacttacaggaagtcagataattgatttacttgcaaaggtcaaatcccagccgcagcaaccgcagcagtcacataaagttgaagcacagggaagttcacggtctaatccagcagcttctgcggctgccacagctgctgcagctgccgcttctgctgctgcaaaggctcaaggagttg

SEQ ID NO: 3535 - DNA, 182 bp, Cicer arietinum
acctttctcccaggccctgggtggaagaaacgactacagaactgcaatggagaaattggataaacttcagtttgagaacccattggagcgacttggtttatttatcaaggatgattacatcgcagatgatgatgatgaggttctgaacggaggagtctgggaggaaggggaaattttttgat

SEQ ID NO: 3536 - DNA, 280 bp, Cicer arietinum; identical to SEQ ID NO: 573

SEQ ID NO: 3537 - DNA, 407 bp, Cicer arietinum
actccaattccacctcagtgtcaaagcgagctttgcaggtgaaagattttccggtatcagttgtgacagtgacatcttggccaggctttatctcgctgattttatctggaaggtcaattgtataacgttcgcggccagtcaatcccaaggtgtcagcatcctcgccggatttgaagcaaaggggaataatacccattcctaccaaattactgcgatgaattctctcaaaacttttggctatcacagctttgactcccaataacatgggacccttggcggcccaatccctggaacttccactaccatattcagctccggccaggacaatggtgtcgtgccctgcagccttgtatctctctgctgcatcaaaaacataaagcttctctcctgttggaacatgcactgtc

SEQ ID NO: 3538 - DNA, 391 bp, Cicer arietinum
cttgttaataatatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccatt

SEQ ID NO: 3539 - DNA, 427 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccgtcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccactttgtgcaacacaaacttggttt

SEQ ID NO: 3540 - DNA, 291 bp, Cicer arietinum; identical to SEQ ID NO: 581

SEQ ID NO: 3541 - DNA, 325 bp, Cicer arietinum
acactgcttttattactaaaggcagaaggagttgctgtgccaatcacttatgttcaaagtgcagtggcaaaaggagctgtttgtttggatggaagtccaccagcttaccactttgataaaggagttggagctggaattgacaattggattgttcactttgagggaggaggatggtgcaacaatgtctctacttgcctcgatcgtagggacactcgtttaggatcatcgaagaaaatggataagcaactttcattttctggatttttcagtaacggcaaaaagtttaatccagatttctatgattggaacagaatcaaggttaggt

SEQ ID NO: 3542 - DNA, 401 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgccgttgatcggaaggatgtcgctaccgatgccacgggcaccgtcctccgatatctaaggcgttctggttctgaggtgccgccattagatccgacaaaggtgttgtcagagaaggt

SEQ ID NO: 3543 - DNA, 326 bp, Cicer arietinum
acattaaatctggtgttgaaaatggtgctacacttgaaactggaggagaaaggcttggcagcaagggcttctatattcagcctactgtcttctcaaatgttcaggatgaccatctgattgcaaaggaggagatatttggtccagtgcaatccatattaaaattcaaggaccttggtgaggtaattcaaagagcaaacaatacagagtatggtcttgcagccggcatcttcacaaagaacatagacactgctaatactttgacaagagcattgaaagttggatcagtttgggtgaattgctttgatatacttgatgctgcaattcct

SEQ ID NO: 3544 - DNA, 320 bp, Cicer arietinum
atagaaggcacaatcagatcacaaaatttaacagcaaacacattatatgcagcttatcttgtaatgaaagtctctgatggagcgtatggacttgactcaggtccttcagatgtaacaattgagatgggaaacaaagtgaaaagagggaaagcatatttgtgcaataaagatgagaacaagtgtaatatggagacactattttatgggaatagaagaaacagagtggttcaagcacaagaagatagagggaatattcatgtgccagctaagagattagatggctggatggagattgagattggagagttttttagtggtga

SEQ ID NO: 3545 - DNA, 420 bp, Cicer arietinum
ctctatgctctaatgttaatcaacatgcctacaaccaaaggagagagtaaaacccaaagtcaagacaagcagcttgatgctgagggagaagatggcaacgaggatgaagacgacgaagaagatgatgatggagatggtgcatttggagaaggagaagaggaattgtcatctgaagatggaggtggatatggcaacaattccaacaataagagcaactcaaagaaggctcctgaaggtggtgctggtggggcagatgaaaatggagaagaggaagacgatgaagatggtgaaggtgatgaccatgatgaagatgacgatgaggacgaggatgacgaagaagaggatgaggtcggagaagaggacgaagaagatggtgttgaagaagagaatgaagaggaagaagaagacgaagatgaggaa

SEQ ID NO: 3546 - DNA, 185 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacacatttgtcggatctaatggcggcacctcagaa

SEQ ID NO: 3547 - DNA, 381 bp, Cicer arietinum
acttaattcttccatatggaaaaaaatcacacacactacacaaagaaatactctaaatccaaacactatagattcacgtatatcagactagaggaaattacaaaagttacatcccttcggtcatcaacgtatgaactaaccacaaaacctaacttgattatttcttctatcacgaactgaacactgaaacaacaaaccttcacttgactttcaactttcaacgcttcttcatgcgttcgcaccctacggcaaatcctcttgaaaaaataaaggatgcacgttagggaccatacgaacaaacagacaaacaaccaccaattttcatcgtctacttcggaagacagtaatcaaaacacctaacaaacgaaatcaattaatcat

SEQ ID NO: 3548 - DNA, 437 bp, Cicer arietinum; identical to SEQ ID NO: 538

SEQ ID NO: 3549 - DNA, 430 bp, Cicer arietinum
agcctcgccgactacaatatccagaaggaatctacccttcatctcgtcctccgtcttcgtggaggtatgcagatctttgtgaagaccctcaccggtaagaccatcactctcgaagttgaaagctctgacaccatcgacaacgtgaaggctaagatccaagacaaggaaggaatcccaccagaccagcagagactcatcttcgccggaaagcagcttgaagatggccgcaccttagctgactacaacatccagaaggagtcaacccttcaccttgtgttgcgtcttcgtggtggtatgcaaatcttcgtgaagaccctcactggtaaaactattacccttgaggtggagagttctgacacaatcgacaacgttaaggccaagatccaggataaggaaggtattcccccagatcagcagaggttgatcttcg

SEQ ID NO: 3550 - DNA, 408 bp, Cicer arietinum
agcctcgccgactacaatatccagaaggaatctacccttcatctcgtcctccgtcttcgtggaggtatgcagatctttgtgaagaccctcaccggtaagaccatcactctcgaagttgaaagctctgacaccatcgacaacgtgaaggctaagatccaagacaaggaaggaatcccaccagaccagcagagactcatcttcgccggaaagcagcttgaagatggccgcaccttagctgactacaacatccagaaggagtcaacccttcaccttgtgttgcgtcttcgtggtggtatgcaaatcttcgtgaagaccctcactggtaaaactattacccttgaggtggagagttctgacacaatcgacaacgttaaggccaagatccaggataaggaaggtattccccca

SEQ ID NO: 3551 - DNA, 230 bp, Cicer arietinum
actgttaggcgtgatgctcctcctggacagaaggttggtctcattgctgccaagaggactggtcgtcttaggggacaagctgccgcaactgctgctaaggctgataagaccacttgaagagactcttagggttttatttcattgcaagtttttgaaattttgtttgtttccttgtttgttccaaactgcttggatattgttttgagaaccctttgccccatttatatgaa

SEQ ID NO: 3552 - DNA, 343 bp, Cicer arietinum
acggattcgcctaggttttgaggtgagtcacggctacggtttaacggaaaccggcgggttagtggtttcctgctcgtggaaaaacaaatggaaccgtctcccggcgacggagagagcgcgattgaagtcacgccagggagtgagaacaatcggaatgactaatgttgacgtggtggatcccaacggagatagcgtaaaacgcgacggagcaacgctcggcgaagttgttatgagaggcggttgcgttatgttagggtatttgaaggatcctgaaggaacagcgagttgtttaaggaacggttggttttacaccggcgacgttggtgtgatgcatgaagacggt

SEQ ID NO: 3553 - DNA, 280 bp, Cicer arietinum; identical to SEQ ID NO: 588

SEQ ID NO: 3554 - DNA, 443 bp, Cicer arietinum; identical to SEQ ID NO: 569

SEQ ID NO: 3555 - DNA, 481 bp, Cicer arietinum
gatttctagcggccgcctgggcaggtttcggcggcaccatcttcttcaacaaggaacacaaaaagtagagggttttggattgaaatccacaatcaaatatgtctggtgaagaaggtgttgttgcagtcgaaccagttgttgctgctgcggctgctattcctggtgagccaatggataccatgactgctgttcagcttgtgctgagaaagtcccgggcttatggtggccttgctcgaggtcttcatgaaagcgcaaaggtgattgagaagcacgctggtgcaggtctgtgttctagctgaagactgtgaccaacctgattatgtcaagttggtgaaagccctttgcgcagagcacaatgttagcttattgactgttccaaatgcaaagacccttggagagtgggctggtttgtgtaagattgattcagagggtaaagctaggaaggtaactggctgctcctgcgtggttgtcaaggattttg

SEQ ID NO: 3556 - DNA, 312 bp, Cicer arietinum
acatcctgataaaaatatgggtaatgaaaaggctgtagaagcctttaagaaacttcaaaatgcatatgagattctaatggattccttgaagcgaaaagcttatgatgatgagctaaggagagaagagcttcttagtgtatttaacagatttcataatgctccccgcaggaatagtaggcatggatttttttcttctggatttgcgcagccagatgtagatggtgaggacccatttggtgattcaaggcgaatagcttgcaagagatgtggtggctttcatctctggatacacaccaagaaacaaaagtctcg

SEQ ID NO: 3557 - DNA, 261 bp, Cicer arietinum
ctgcaaaagattctacccgccgctcaataggaattgcgtttcaaggtgtcccgcaaggctcatccgccttacgaggtccaccaacgacacgtgcctctggggggccaaggccccctactgctggtcggcaagcgaacgacgggcacacgcatcgcttctagcccggattctgacttataggcgttcagtcataatccaacgcacggtagcttcgcgccactggcttttcaaccaagcgcgatgaccaattgtgcgaatcaa

SEQ ID NO: 3558 - DNA, 356 bp, Cicer arietinum
cgtacacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacc

SEQ ID NO: 3559 - DNA, 337 bp, Cicer arietinum
  misc_feature (336)..(336): n is a, c, g, or t
caataactcgtccgcgttgaatctcatgactgacggttgggacaatcacaatagtcctccgatgggatcgtcgcccaccggagtcctacaaaagacagcatttggatcactttcaaatagtagtgctggtagtagtccaagggcagagaataacaagacacaagaaagtgcaagtttgtgcaatgatcttctaggttcaactcttggggggaatgcttcctttactccataaaggaagaataaaaaaaaggagaaatgaagagacaaaacaatttcaatttatgagttatgagtttttttcatatatataatatttatattatatggttattttcnc

SEQ ID NO: 3560 - DNA, 214 bp, Cicer arietinum; identical to SEQ ID NO: 521

SEQ ID NO: 3561 - DNA, 189 bp, Cicer arietinum
gcatggaagcaagaccgttggaagatgggcttgcagaggccattgatgaaggcacaattggaccaagggatgaccccaaaatccgttctaaaatcttgtcagagcagtatggttgggataaggatcttgctaagaagatttggtgttttggacctgagaccactggacccaacatggtggttgatatgt

SEQ ID NO: 3562 - DNA, 311 bp, Cicer arietinum
actcattacccccaagaggcacctctctactcatagctcgccctacagtagttgtcggtgaagcacgtcccattggacatcaatacagttgatcctcgcagagcttccctccagcagcgtctcccatctagttcatccagcatatcatcggcacaaaggcgcatttactttcaagaggtcatcccgtcagcgggatctattcctctccagcctagaattctcttgcacggataaatcaagtagctttccataccctgaggcaggaagtccatgatcccctaagatcgccagtagctgcaacctaggaccgt

SEQ ID NO: 3563 - DNA, 462 bp, Cicer arietinum
accttttacatgacattaatacgggcacagttggagttgttgatccttccgaagctttgcctgtcatagatgcattgagtaagaaaaatcgaaatttgacttacatactcaacacacaccatcatcatgatcacactggtggaaatgcagaattaaaagcaagatatggggcaaaggtgattggttcaggaactgacaaggaaaggattcccggcattgatatccatttgaatgacggtgataagtggatgtttgcaggccatgaggtgcatgtaatggacacacctggtcacactagaggccacataagcttctactttccgggatccgcagcaatttttacaggagacactttgttcagcttatcatgcggcaaactctttgaaggaagccctgaagagatgctatcttctcttagaaagatcacatctttaccagacaatacagatatttattgtggac

SEQ ID NO: 3564 - DNA, 255 bp, Cicer arietinum
acagaggaagagctgatagaagcaatagcaacagctagtggagcagagaaagattcactatgttttatagaagtttttgcacacaaggatgacaccagcaaagagttgctagaatggggatctcgtgttgctgctgctaacagccgtcctccaaatccccaatagaaaataaattcctaattattgcatatcaaaagaattattacaatatgtatatttttgtgtgcttacttggaataaatgatcatttttctg

SEQ ID NO: 3565 - DNA, 321 bp, Cicer arietinum
  misc_feature (1)..(1): n is a, c, g, or t
naccaaaggccttccatgcttatctctctgctctggtattatgttttaggcggatttttcccgcaatactaaatgctgctgttgatctcaatttgtttgatatcatagctaaaacacaaagttcacatggttcaagcttatatgcatctgaaattgcttctcagcttcctaatcaacaccctgaattgactgataggctcgagcgcatgttgcctgtgttggccagttactctcttcttaattgctccattcgtattaatggagagggtaagagagaaagagtttatgctcttacaccaattggtcaatactttgcccttg

SEQ ID NO: 3566 - DNA, 346 bp, Cicer arietinum
caaactcctagaattccaaattactgaaaggtcaagactacttattctttgttcaccatctaacccaacaggatcggtctatcctaaggagttacttgaacagatagcccagattgtagcaaagcacccaaggcttctggttatctctgatgaaatttatgaacacataatttatgcaccagcaacacatacaagctttgcatctttaccgggaatgtgggacagaactctaaccgtgaatggattttctaaggcctttgcgatgaccggttggcggcttggttatattgctggcccaaaacatttcattgcagcatgtggaaagattcaaagtcagttcacttca

SEQ ID NO: 3567 - DNA, 375 bp, Cicer arietinum
gttaggagaagaagaaaggagagaaatggtgaacttgaagagggtgagcagagtgttgtttttcttgatactttgcttgattttgctgaggatgagaccatggagatcaaaattaccaaggaacaaatcaagggtcttgttgtggatttcttctctgcaggaacagattcaaccgctgtggcaacagattggtgtttatcagagctgatcaacaacccaagagtgatgaagaaagctcgagaggaggttgactctgttgttggaaaagatagactagtcgacgaatcagatattcaaaatcttccatacattagggccgtcgtgaaagagacattccgcatgcacccaccactacctgttgtgaaaagaaaatgt

SEQ ID NO: 3568 - DNA, 297 bp, Cicer arietinum
acaaagcattcgcggcggattatcctgatcccgaacacttcaggatcaagatcaacctagggtggcagaagctcaacaaatactacacaattctcgacgagacaccaatatattacgtggcgttggctctccaccctgcgtatcgatggggttggttcgaagaacactggggaaaacatccggattggatcgcaactgcgaaagatatggttcaggaagtatgggagaccgaatatcgcaacctcgaggtggtattgagcccaggaaatgagcccgttgctaaacggcgaaggaagt

SEQ ID NO: 3569 - DNA, 420 bp, Cicer arietinum
tacttcatgggattcacttcgaaaacgggcgagaaaactctaagctcaattggatgagcagatgaatgcttatcgtaaattagtttcttctaatatttcgacaaaagctgatgccgcagagagtgatctagagtcttggattgagcggttaataaaataactccatcaagtaaactcacagatgcaagcttgggtatcctctggtggttcagatatggtttctcatactttgactagacaccaagaagttcttcaagatatcacgcaggggttttatcgtcttcgctcaagtcttcgagctaagaaagaacatgcttcacttttagatgattttaaagaatttgattggacgagattagacttggaagagggtgccgaatctgaacagcatacacttctaaaagagcatgcttctatcag

SEQ ID NO: 3570 - DNA, 411 bp, Cicer arietinum
  misc_feature (375)..(375): n is a, c, g, or t
gagaaagaagttccaagaaagaagaaagagatggcaggtcgcagtatctcatacattacagggtcgcagcttctctctctcagacgccaaccaaccatcgccatagtcgatgtcagagacgacgagaggactcacgatggacacatatccggttctcttcattacgcaagcgatggtttcaccgataacatctctaagcttattcacgaagttaaaggctaagacaccctcgtctttcactgcgctctaagtcaggttcgaggcccaagttgtgctaggaagcttgtcaattatcttgaaaacagcaaggaagatgttgggataaagaacattatggacttagaacgtggcttcaatggttgggaagcttctggnagacccgtttgccgctgcaagaacgttccttgtaag

SEQ ID NO: 3571 - DNA, 235 bp, Cicer arietinum
tgcggatttcttctctgcaggaacagattcaaccgctgtggcaacagattggtgtttatcagagctgatcaacaacccaagagtgatgaagaaagctcgagaggaggttgactctgttgttggaaaagatagactagtcgacgaatcagatattcaaaatcttccatacattagagccgtcgtgaaagagacattccgcatgcacccaccactacctgttgtgaaaagaaaatgt

SEQ ID NO: 3572 - DNA, 427 bp, Cicer arietinum
actttggcgagcagttgtcaggatttgcctttactgctaatgggtgggtgcaatcctatggatctcgttgcgtcaagcccccaatcatctacggtgatgtgagccgcccaaagccaatgactgtcttctggtcatctcttgctcagagctttaccaagcgtccaatgaagggaatgcttactggccctgtcaccattctcaactggtccttcgttagagttgaccagcctagatccgaaacctgctatcaaattgctttggctatcaaggatgaagtagaagaccttgagaagggtggtattggtgttatccaaattgatgaggctgccttgagagaggggctaccactaaggaagtcagagcatgctcactacttggactgggctgttcactccttcagaatcaccaatgttggtgttcaggattc

SEQ ID NO: 3573 - DNA, 114 bp, Cicer arietinum
gccgcccttcttagactctccgacataagccagcagaccgaaagcaagctgaatgatgacacagtagataggacggccctggccatcaatgtagttcaggaacttgggggcatg

SEQ ID NO: 3574 - DNA, 408 bp, Cicer arietinum
cgcaaaaacgacatcgtcgttaagacgaaaatcacggtttgtgaagcgcgtgaggaagatggattctccgacggtgatgtcttaatttttcctgaaatgatcaaatacaagggtttggaggaatcaaatgttgatagctttttcaatgatgtggtggtgagtggtaattcatggggtggtggagtgcagggtgtgataacaggttcatatatttttgtgtgtgctcatggaagtcgcgacgtgaggtgtggtgtttgcgggcctgttctcattaacaagctcaacaaagaaattcaactccggggattgaaggaccaaatatctgtcatggcatgttctcatgttggtggccataaatatgctgggaatttaatcacatttagtcctggctcagatggaaaaattatg

SEQ ID NO: 3575 - DNA, 285 bp, Cicer arietinum
  misc_feature (1)..(1): n is a, c, g, or t
nacttcaactttttcctgtgaaattgttaccaccaaaatgcaccttgaccgtctatgggcccattttcccctgtgacaataacatcggtgaggttagttccaaatatgaggctggtgtatcttcctgctggtgcgtctctccctctaccgtatgatggtaaaggttcaatcacaggccactcagttatatcctgagaagcaaggagaatagcatctttattcaaatagagagtgaaatgactagtaaggctgaaactaccggtaagccattttcctgcaggaaca

SEQ ID NO: 3576 - DNA, 426 bp, Cicer arietinum
tggtaaaaattctttcttggcacgcactgttagtgcactgttaggagcgggattttctacgggctactcggccacacaatactgcggggacgccatcggctccctaacagcagttttcagagaaggaattttggagagttcaccttctctgacaacacccttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggt

SEQ ID NO: 3577 - DNA, 372 bp, Cicer arietinum; identical to SEQ ID NO: 3326

SEQ ID NO: 3578 - DNA, 124 bp, Cicer arietinum
acttggatgagaagactatctttcaccttaacccttctggccgatttgtcattggaggtccccatggtgatgccggtctgaccggaagaaagattatcattgacacttatggtggatggggtgc

SEQ ID NO: 3579 - DNA, 400 bp, Cicer arietinum
  misc_feature (311)..(311): n is a, c, g, or t
tggaaaagaagagaatgtgaagaatgcgcgagagggtttgttgacaagggctaaggctaattcagaagctactcttggaacttacaagggtaactctcaacttggtgaaggtgcctcagagagtctccatgttaaggactacaagtattgatcaaagttggtgtatcccttaaagagggtaggtttggcatttaagggtataacaactgaacattgtgagggttgaattttcttgttattgagtattgtggaataattgcttggagtttttctttttgttttctctctgtttgtttgatcatagctttagnctatttggtcaaaacccgagcaaaagggtggacataagacactattctaagtcaggttatttgtttattttgcacttatctttgttgcg

SEQ ID NO: 3580 - DNA, 376 bp, Cicer arietinum
tggtcccggccgaggtgttagtagaagaagaaaggagagaaatggtgaacttgaagagggtgagcagagtgttgtttttcttgatactttgcttgattttgctgaggatgagaccatggagatcaaaattaccaaggaacaaatcaagggtcttgttgtggatttcttctctgcacgaacagattcaaccgctgtggcaacagattggcgtttatcatagctgatcaacaacccaagagtgatgaagaaagctcgagaggaggttgactctgttgttggaaaagatagactagtcgacgaatcagatattcaaaatcttccatacattagggccgtcgtgaaagagacattccgcatgcacccaccactacctgtt

SEQ ID NO: 3581 - DNA, 243 bp, Cicer arietinum
tgctccttcccgccatggcgaaagcgggaattcgatttcgagcggccgcccgggcaggtacaacgctaagcgtcgtcactggcgccgcaccaagcttgggttctgaggttctttagttacttggttttgtttttattttacttttgaaatcagacaacaacttttgtttcggaattttaaatgttgggattgagatcagttttatttatgtaaggaattggtttgtggttttgaaccacaact

SEQ ID NO: 3582 - DNA, 231 bp, Cicer arietinum
actagtgattaccggtcatttaaggcaattccagccttggcatcaaagatacttgacctagtatcaccaatgaagtcggtggagaccacatcatcttcagtgtatccgagaatgcctttcaacttgccctcagactcctccttgatagcagccttgatttcgtcgtaggtagcggccttctcaagcttcactgtaaggtttacaactgagacatcaacagttgggacacgg

SEQ ID NO: 3583 - DNA, 186 bp, Cicer arietinum
acacacttgacttacaatctcacacttccacaacaaaatgaaaagaagaagagagcatgacatttggcaaccaaattaagcacactaaatataataaaatgtgtcacaaaacaacacaccaggtataataaaagcacttaattgtaattaggattggccaaacaataaccctcaagtgccttgaaa

SEQ ID NO: 3584 - DNA, 429 bp, Cicer arietinum
gaacaacataaccaagatgttaactctttgggtttgatttcatctagaaaaacaaatgaggctattgagatcttaaagttgatgtcttcaactttcttgattgcactttgtcaagcaattgatttgaggcatttggaggagaatttgaagaacactgtgaagaacactgtgagtcaagttgcgaagaggacgctaacgactggcgtgaatggtgaactacatccatccagattttgtgagaaagatttgctcaaagttgttgatagggagtatgtttttgcatatgttgatgatccttgtctctctacataccctttgatgcaaaagttgagacaagtgcttgtagatcatgcattggtgaatgttgatggtgagaagaatttgaacacatcaatatttcaaaagattgcaacttttgaggatgagttg

SEQ ID NO: 3585 - DNA, 406 bp, Cicer arietinum
gaacaacataaccaagatgttaactctttgggtttgatttcatctagaaaaacaaatgaggctattgagatcttaaagttgatgtcttcaactttcttgattgcactttgtcaagcaattgatttgaggcatttggaggagaatttgaagaacactgtgaagaacactgtgagtcaagttgcgaagaggacgctaacgactgttttgaatggtgaactacatccatccagattttgtgagaaagatttgctcaaagttgttgatagggagtatgtttttgcatatgttgatgatccttgtctctctacataccctttgatgcaaaagttgagacaagtgcttgtagatcatgcattggtgaatgttgatggtgagaagaatttgaacacatcaatatttcaaaaga

SEQ ID NO: 3586 - DNA, 394 bp, Cicer arietinum
acatatccaattttcgaggggtcgtatcttggagacgattttaagtgtgaggttcttcttgtttcagtatggcgttgtgtataagctacatcttactggaaatgacacatcacttgcgatatatggattctcatgggttggattggttggaattgtcttgatatttaagatctttacctacagcccaaaaaaatctgctgattttcagcttgtattgatattttcacagggagttgtatccataggccttgttgcagctgtgtgtcttgttgttgtctttactcaacttacgatacctgacctttttgcgagcattcttgcttttatccctaccggatggggaatattatctttagcaattacatggaagagtatagttaggagccttggcttg

SEQ ID NO: 3587 - DNA, 427 bp, Cicer arietinum
acaatgaactctctccaaatggtgagtttgaggtcgtttttatcacagctgatgaggatgatgaagcctttaaaagctacttttccaagatgccgtggttggctatcccgttttctgattcagatacacgcaatcgccttgatgaactgtttcatgtaaatggaattcctcatcttgcattgcttgatgaaactggcaaagttgtcgccgaagatggagttgacattatccgtgaatatggacccgaagcattccctttcacatcggaaaggatccaagagttaaaagatcaagaagaggaagctaagaggaatcagtccttgagatctattttgggctctcgttcccgtgattttgtgatatcatccgatggaaaaaatatacctatctctgagcttgagggaaagacagttggtctgtatttctg

SEQ ID NO: 3588 - DNA, 466 bp, Cicer arietinum
gggaattcgattagcgtggtcgcggccgcccgggcaggtacaatccaccggtagagaagccaccagtttacaaacctccagttgagaaaccaccgatttacaaaccaccagtagagaagccacctgtatacaaaccaccaattgagaagccccctgtctacacaccacctgtagagaaacctccggtatacaagccaccaattgaagagcctccagtttataagcccccagttgagaaaccaccggtttacgggcctccatatgagaagccacctcactacccagggtatcctccatatgagaagccacctcaccacccagggtatcctcctgccgatgatgacaatcgtttctaaaacttgttatattaagaaaatgtgaaaaataagaggtatatatagttttcgaagcaaggattatatattattggcatcttcatttaaatcctttgtttacaatcctattg

SEQ ID NO: 3589 - DNA, 419 bp, Cicer arietinum
gccgaggtacatatccaatctccgaggggtcgtatcttggagacgattttaagtgtgaggttcttcttgtttcagtatggcgttgtgtataagctacatcttactggaaatgacacatcacttgcgatatatggattctcatgggatgtattggttggaattgtcttgatatttaagatctttacctacagcccaaaaaaatctgctgattttcagcttgtattgagattttcacagggagttgtatccataggccttgttgcagctgtgtgtcttgttgttgtctttactcaacttacgatacctgacctttttgcgagcattcttgcttttatccctaccggatggggaatattatctttagcaattacatggaagagtatagttaggagccttggcttgtgggattctgtccgtga

SEQ ID NO: 3590 - DNA, 435 bp, Cicer arietinum
accaaaggatttccctggtgacagcgtgacggctgagaacttatatgctgttattcttggggacaagagtaaagtaaagggtggaagtggcaaggtgattaatagcaaagctgaggataggatatttatctattactccgatcatggaggcccgggagttcttggaatgccaaatatgccgtatctatatgcaatggattttatcaatgttttgaagaagaaacatgcatctagaggttacaaaaagatggtaatatatgtggaagcttgtgaaagtggtagcatttttgagggtataatgccaaataatttgaatatttatgtgacaactgcatccaatgcacaagagaatagttggggaacttattgtcctgggttggatcctgctccacctcctgagttcatcacttgccttggggatttgtatagtgttgc

SEQ ID NO: 3591 - DNA, 423 bp, Cicer arietinum
catggtatgtgttccttgttaattttcagtcttgtaattataaatttttatttcgttttgggtgatagaggtaaataaactacttctgctacagagttgcttacagggcagaattatttcttgctaaaactgtcaaatagaacatggatttttgagacaatttcatgagtagccaataattctattttgaacaatttatttaaatccaggtgggaattccttcagaccgtgaacaatatatacatcgtcttggaagaacaggacgagaaggtaaagatggggaaggcatattgttgattgcaccatgggaagagtattttttaaatgagatcaaagatctccctctagagaaattcccctcaccagatatagatccaaaggaacaacttaaggtatatttttctgacttcgtcatagctgcta

SEQ ID NO: 3592 - DNA, 374 bp, Cicer arietinum
acttggctaatcaagaaaatttccacaaagaggctgacaaaaattactggaaagcaattggggagataattcctcgagaggttgccaacattgagaagaaaagaggcaaaaaggatcaggataagaacccatcaatcactgttctccaaggccctaagccaggcaaacccactgatctttataggatgcggcaaatattgttaaagttgaaacatacaccaccaactcacatgattcctcctccacctgcacctgttaaagactccaaagatgggaaggatggaaaagaagcagcaactaaaccaaatggatcagcaccagaaagtgcacctggatcacaagattcactaccaactgatgctgccaataatggt

SEQ ID NO: 3593 - DNA, 362 bp, Cicer arietinum; identical to SEQ ID NO: 3253

SEQ ID NO: 3594 - DNA, 428 bp, Cicer arietinum
acgacactgttcatggtcaatggaagcattttgaccttaaggttaaggactctaaaacccttctctttggtgagaagaccgttactgtttttggaactaggaaccctgaggagattccatggggtgaggttggagctgattatgttgttgagtcaactggtgttttcactgacaaggataaagctgctgctcacttgaagggtggtgccaagaaggttgtcatttcagccccaagcaaagatgcacccatgtttgttgttggtgttaacgaaaatgaatacaagccagagcttaacattgtttccaatactagctgcacaaccaattgccttgctccccttgccaaggttcttaatgaccgatttggaatcgtcgagggtcttatgaccactgtccactccatcacagctacccagaagactgttgac

SEQ ID NO: 3595 - DNA, 428 bp, Cicer arietinum; identical to SEQ ID NO: 982

SEQ ID NO: 3596 - DNA, 432 bp, Cicer arietinum
gccaatttcagtgaagaagaaggaaaagaagaaggtagtggaagaggagggttcagttgaagttgaaaaagtagaagttgtggatgtaacagcagcacaaccaacagaggaaaagaagggtttccttgagaaaataaaggacaagttaccaggacacaagaaaacagaggaaccacctgttgttgttgtatcagagacaacaagtcttgatgaaagtgaagatgcagtgaaggagaagaaaggtattttggaaaagatcaaagagaaacttcctggttatcatcctaagactactactgaacttgatgacaaagatcatcacaaggatggcacaacaacctctcattgagaatactcaatcgtctttcttatcttggattgtgttgttttatggatgtgtctgtttattgggtattttgctttctttcatta

SEQ ID NO: 3597 - DNA, 424 bp, Cicer arietinum
accttgatcctgaatattatagaaactatcagttgactgataaaagtgatgtttatagttttggcgttgttttgcttgagcttttgacgtctcagaaggctattgattttaatagggcttccgatgatgtgaatttggcggtttatgtgcagaggatggtggaagaagagaagttgttggatgttgttgatcctgttttgaagaatggagctagtaatatagaggttgagacaatgaaggcgttggtgtttttggccttgagttgtttggaagagaagagacagaatcgaccttcgatgaaagaggtttcggaggagattgagtatatcattagtattgcctctgcaaagggagtggagaagtagtttacttgtatgatgctgttttttatgattttgtctacactatacatgaactttgatta

SEQ ID NO: 3598 - DNA, 425 bp, Cicer arietinum
acaagtttctccacttcattgttgggagacacgacttgcccttttattacccagagtcagctgagctacatctgtccttcttcaactcctttctaaaagacgacgatacggatggctggaaatctggcaagcagccacgggttcgtcttaggttgcgaaagggagaggctggtgttgatgaccctgagcgcgaacgagggttctcttttagagatgaggcagattggccattgcctgggaccaactacacaaagttctacctgacttctgacaacgcattgagcacgaaaccgtcgccgccaatcagcacaatccagtataatgcgctgaatggcgagcccattagatttgcttacaagacctcttctattttggaaatcaccggtcactatcgtcgcccatttaactgtagcggcaacccgaaa

SEQ ID NO: 3599 - DNA, 352 bp, Cicer arietinum
acaaaaacgagaaccacagtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacgtgagtagcgagaaccaccatcaccaccaccatatccacgatctctgctaccaccataaccaccaccacctcctccgccatatccacctccaccaccatatcctccaccgccacctctgttatatccaccttcacgacgtccaccaccatatccaccgcctccaccatatccaccgcca

SEQ ID NO: 3600 - DNA, 381 bp, Cicer arietinum
ttgaagatataaagaaccatgttgagaaagctgaccagggcgatgtagtcctcatcgacgtccgagaaccagtctagcttttcgagacgggcaagatccccggtgcgatcaatattcctatcacatcggcagctcagagcctccacatctccgacgaggattttgaggacatgtatggcttcctgagaccggccaagaacaaagagcttgagttttattgcaaagcaggagtgcgtgcaagggcggctgctcaactggctcatcatgctggctggaacaagatcggcgactatgcaggcagctggctggactgggaagctcagaaaggaccagttgagaaggttaagaaaccatattgaacagacagagcttgatgaagac

SEQ ID NO: 3601 - DNA, 427 bp, Cicer arietinum
actccaagaaggccttgggctaccgaaacttatatttttgctatgtttgatgagaatcaaaagagtccggaattagaaaaacattttggagtgtttaatcctaataaacaaaagaaatatccgtttggatttggtggagaaagaaggaatggagaaattgtcaacgatgacttcaatgcaactacggtttctcttaagagtgatatgtaagacgaaatagcgttttaaaatatgagtaatttttatctataaaataaatttaaaaaaattatcatgttagtatgtatgttcatttatccttcaattttagtcgtaaaaattgttgggttgttggatcttttttattttatatatctatgtatctcgtagtaaaaaaatatcaatgtatattatttgagttgatcaataaattgatatacctttctcg

SEQ ID NO: 3602 - DNA, 399 bp, Cicer arietinum
  misc_feature (397)..(397): n is a, c, g, or t
gagagccgagttgaaactcgcgacgagtgaacgcggacgagttgactcggcgctgaaggatttgactgagtcggttattttgagtcctaagaacgcgaaagcttggtctgcgttgggagagtgctatgaaggaaagaaaatggaagaggaagctaagaaggcttataaggaggctcttgagttggagccacatttttctgtgccgctagaggcacttaacagtaataatggaacaaaagtcgaagatctgtcttgaacttcttttggggaagaatgtctgttggaggagaggtgtttcattagctgtgtaaccacattttatctcaatggtcatgactttggcagggtggaaggagcaaatgaggtggtgctcagtaaaggctcaatcagtagtacntg

SEQ ID NO: 3603 - DNA, 430 bp, Cicer arietinum
acgtctatgaacaccttctctgtgacatcgaaggtaaccacctcacttctgctgctatcctcggtcaagacggtagcgtttgggctcagagtcacaatttccctcagttcaagcctgaggaaattactggtatcatgaatgattttgctgagcctggaacacttgctccaactggattatatattggtggcacaaaatatatggtgatccaaggtgaaccaggagctgtcattcgagggaagaagggtcctggtggtgttactgttaagaagaccaatcaggccttggtcattggcatttatgatgaaccaatgactcctggtcaatgcaacatggtagttgaaaggctcggtgattatctcgttgaacagggtctttaatcctctccgtatgtctattttattatagttcatatttcattggcttctgt

SEQ ID NO: 3604 - DNA, 254 bp, Cicer arietinum
tcttatgctattggtgttccagagcctttgtctgtctttgttgattcttatggaactggaaagatacctgataaggaaattcttcagattgtgaaggagaattttgattttaggcctggaatgatctctattaaccttgatcttttaagaggtggaaataaaaggtttttgaagactgctgcttatggacattttggtagagatgatgctgatttcacatgggaggttgtgaaaccacttaagtcagagaaggt

SEQ ID NO: 3605 - DNA, 419 bp, Cicer arietinum
actcatgaaggcgtgattgctggattcaaggctgcttccgttgcatgcgttgtcagtgctgtgcctacattgactgctgttcgcaagattccatgggcaaaggcaaacctcaattatactgctcaggcacttatcatatctgctgcatccattgcagcatacttcatcactgctgataaaacaatcttggaatgtgcaagaaaaaatgctcaacttgaaaattctctgagacacaatcgtgacacagtttcatcttagacacttctatactcattgctggtcttggtgaaggatttgtgctacttgcaatattcaaccagtaggcctgttgcaaaactttcctttctgggtctggctcgaatggatttgaaggtgtatatgctcaaataaaagagtttgttgttgttgttgttgttgtg

SEQ ID NO: 3606 - DNA, 430 bp, Cicer arietinum
actcaacgaaccatagagaaaaactcttcactgagccgaaaaccgtcgctgaaaatctctctccccaagaaaaccgagtggatcaaattcggaaactcggatccgaaaccggaggtgattgttcagaaaccagaaccggaacctgttgagaaaaagcactacagaggagttagacaaagaccgtggggaaaattcgccgccgagattcgcgatccgaacaaacgcggctcaagagtttggctcggaacgtttgatacggctattgaagccgctaaagcctacgatcgagccgctttcaggcttcgcggatccaaagcaattcttaactttccacttgaagtcaacgaagttattgcggcggtggaggagacttccggcgacggtgagaggaaacgttgccgtgaagaggaagaggtggaggagaaaccgg

SEQ ID NO: 3607 - DNA, 339 bp, Cicer arietinum
accggccctgattccatccacctatgcaccagaaaggttggatctcttgaggcagcttgagaaagtgaagcaaatgacaatcaatgatgtagattcagacgatgaagtggatgaagtcaaatgatccaggagcaatgcagatttatgtatagctaacagaacttaacattcttcctggtctgatgaaaaatcggatcacctttgttattcgctttgtggaaattttttgttgctgccaaatttctttgagaggagttcggcatagataagttcgttccacgtgtctggcactccgggtaaacaccagtggctacaatcctgaggagcgtcaggtggagt

SEQ ID NO: 3608 - DNA, 413 bp, Cicer arietinum
cagaaacttgagtcttctatacacaagtctttcttttttagacgggtcgcgacttttcaaacacattaaaaaatgggttttcgtttacctagtatcatcagaagggctgcaaaccaagcatcttctaaaggcgtggatgtgccaaagggatatcttgcagtgtatgtaggagagaaaatgaagcggtttgtaatcccaatatcatatttgaatcaaacttcattccaggaattgttgaaccaagctgaggagcaattcggatatgagcatccaacgggtggtctcacaattccttgcagagaagacgttttcttagatattacttctcgtttgaatttttgctgatctcttcagaagaaggagctgacatagattatttgaggcaaatttgtataggccggcactcacttatt

SEQ ID NO: 3609 - DNA, 412 bp, Cicer arietinum
  misc_feature (1)..(1): n is a, c, g, or t
  misc_feature (161)..(161): n is a, c, g, or t
  misc_feature (400)..(400): n is a, c, g, or t
nacccttaaggcatggtctggaaaagaagagaatgtgaagaatgcacaagatgctttgttgacaagggctaaggctaattcagaagctactcttggaacttacaagggtaactctcaacttggtgaaggtgcctcagagagtctccatgttaaggactacnagtattgatcaaagttggtgtatcccttaaagagggtaggtttggcatttaagggtataacaactgaacattgtgagggttgaattttcttgttattgagtattgtggaataattgcttggagtttttctttttgttttctctctgtttgtttgatcatagctttagtctatttggtcaaaacccgagcaaaagggtggacataagacactattctaagtcaggttatttgtttatttngcacttatcttt

SEQ ID NO: 3610 - DNA, 417 bp, Cicer arietinum
acgaggagatacaactcactatgattcagttgctaattcagcagcatctggagtgctttcagctggtctagactcgggtgttccatgcatatttggagtcctaacatgtgaaaacatggatcaggctataaatcgagctggtgggaaatctgggaataagggtgctgaggctgcattgactgctattgagatggcatctttgttcgagcatcatctgaagtaatcatgtcatgttggaatgatcggctaatctctattttcatctccagaatgcttacgttcttgttcaaatgtattcatatcttctcaaactactgctggttacaaataaacagttagcgttttttccttattaatttatgtgtttgtatgggccatgttgtgtggtgtttagggatgggataaattttatgtcct

SEQ ID NO: 3611 - DNA, 254 bp, Cicer arietinum; identical to SEQ ID NO: 3604

SEQ ID NO: 3612 - DNA, 230 bp, Cicer arietinum
accaaagggttataatgcacctcaacaagtgcatatcacacaaggtgattatgatggaaaagcagtaatcatctcatgggtgaccccagaggaaccagggtccaaccatgtacaatttggcacatcagagaataaatttaaagctactgcagaaggcacagtttcaaattacactttctacaaatacaagtctggttacattcatcattgtcttgttgaaggccttgagt

SEQ ID NO: 3613 - DNA, 425 bp, Cicer arietinum
acaaaagcaccattttccattttacacttacattcttatcttagcaatagcattgtaaacaaaggatttaaatgaagatgccaataatatataatccttgcttcgaaaactatatatacctcttatttttcacattttcttaatataacaagttttagaaacgattgtcatcatcggcaggaggataccctgggtggtgaggtggcttctcatatggaggataccctgggtagtgaggtggcttctcatatggaggcccgtaaaccggtggtttctcaactgggggcttataaactggaggctcttcaattggtggcttgtataccggaggtttctctacaggtggtgtgtagacagggggtttctcaattggtggtttgtatacaggtggcttctctactggtggtttgtaaatcggtggtttc

SEQ ID NO: 3614 - DNA, 224 bp, Cicer arietinum
acagaaaacaagctaagggcggatcgtagtaacggattcaataccaatgatcctttgtgtgaaatgagatgttgtgttatattgactgtagaatttcgttgtatgttttagaggggagttgtagaccaactcgatcaatgtaagtgtcctggaaaataaataaggtcctggttaataaacaagtcaatgagaaattgcggcgaccaaggataaaatggaatggt

SEQ ID NO: 3615 - DNA, 428 bp, Cicer arietinum
atgttagagctgcttcaatggcaagaaagatctacttgaggggaggacttggtgttggtgctttccagaggatttatggtgggagccagaggaacggtagtcggccacctcatttctgcaagagcagtggttccattgctcgtcatattcttcaacagttgcagaacatgaacatcattgaaatggataccaagggtggcaggaaaattacttccagcggccgaagggatcttgaccaagttgccggacgtattgtggttgcaccttgatttgtagaatcacttccagctgtcacaaacttatttattttgtctgtgttggagagatgtgaggataacagattatgtgcaattttgattttagtatcaagtgttttttatgtattggacgtattcaatgctatgttgctttttagtcttcaaaaaaaa

SEQ ID NO: 3616 - DNA, 428 bp, Cicer arietinum
gttgacgcaatgtgatttctgcccagtgctctgaatgtcaaagtgaagaaattcaaccaagcgcgggtaaacggcgggagtaactacgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacatt

SEQ ID NO: 3617 - DNA, 424 bp, Cicer arietinum
  misc_feature (249)..(249): n is a, c, g, or t
aaagagaaaaagttcctggaccacggagacccaaactgctaaaaccgaggcggaggcaaaaattacaattgggctgagcccagctgagcttgttgttgtgaatccaaacaaaaaaactgcggttggaaacgaggtcggataccgtttgattccagcaattccagctcatccacttttaacggaagatgattacccacaaatacgtggcgcatttactttttataatgtttgggtcacaccttataatanaactgagagatgggctggtggactttatgttgatcatagtcgtggagatgatactttagctgtttggactcaaaagaatagagacattgagaacaaggacattgttttgtggcacgtagtgggaattcatcatgttccagcacaggaagattttccaattatgccattgttgagt

SEQ ID NO: 3618 - DNA, 426 bp, Cicer arietinum
acaagggaccaactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcaca

SEQ ID NO: 3619 - DNA, 436 bp, Cicer arietinum
ctctcctatcaacaatttttgtttcccgaaataccctcccaaatacgtcaaattcccttcgctgccactttctgcacttccgcgttcttcacctgctccgatggaagctcctcccgaaggttaccgcaggaacgttggaatctgtctcatcaataatcacaaaaagattttcgcagcttcaaggctagacattcccaatgcttggcaaatgcctcagggtggtattgatgaaggtgaggatccgagaaatgctgctattagggaactaagagaagaaacaggcgttagttcagcagaagtgattgcagaggcaccttactggttaacttacgacttcccaccaaaagtcagggagaaattaaacattcagtggggatctgattggaaggggcaggcacaaaaatggtttctttttaagtttactggagaagatcaa

SEQ ID NO: 3620 - DNA, 414 bp, Cicer arietinum; identical to SEQ ID NO: 1906

SEQ ID NO: 3621 - DNA, 417 bp, Cicer arietinum; identical to SEQ ID NO: 3456

SEQ ID NO: 3622 - DNA, 183 bp, Cicer arietinum
cgacgccgattgcgatgggtttttcccctttgaaggcaagccgcaccgccggcctctgattccttcccaaggtttttccctgccgccacgacatacgactatgagctacaacttggttactggagattgtggactgcgtcagcagatgtagcgatgcgtgagagaattctggtcggtggaaaa

SEQ ID NO: 3623 - DNA, 428 bp, Cicer arietinum
tttgattttctaggtggtaagaaaaaggatgaagatcacaaacatcaacaagaggatgtgatcgccactgagtttgatcataaggtcactctgtctgatcaactggcagagaccaagaaagacgaagatgaagttcaagttcaagttccagttgaaggagagaagaaacacaacgtcttcgacaagcttcaccgatctggaagttcttcaagctcttcgagcgaagaggaaggagaagatggagagaagaagaaaaagaaaaagaaggaaaagaagaaggtagtggaagaggagggttcagttgaagttgaaaaagtagaagttgtggatgtaacagcagcacaaccaacagaggaaaagaagggtttccttgagaaaataaaggacaagttaccaggacacaagaaaacagaggaaccacctgttgt

SEQ ID NO: 3624 - DNA, 429 bp, Cicer arietinum
ggcatggggagactattgtttatgcttacagatcaggtgaggtgatacggctaccaaaaggggtttcgattccagtgacactaaaggttctggagtttgaacttttccatttctgtccaatccaagaaatagcaccaagtatatcatttgccgcaataggcctaatggatatgttcaacactggaggagctgtggaagaggttgaaatccataaagcctccgacaacaaacaagaactattcgacggcgaggttgtatctgaactgacaacttctctcagtcctaaccgaacgaaaacagcaactgttgctctaaaggtcagaggaagtggcaagtttggagtttactcttctcagcatccacttcaatgtgcagtcgatggcattgataccgatttcaactatgactcagaaaccgggttgacaacct

SEQ ID NO: 3625 - DNA, 382 bp, Cicer arietinum
gaaagaaattatgttattattgagtttgtgaaactagaacaaccaagccagtcaacaaacaaaataaaaaaggaaaagaaaaatctgaaatcataagtcttgttattttttttctactcgttatgcgactcttcttttatatgtacaacgcaaacggtgtttccacttgtcatcatctacctaggctgatgaatagcccgtgggctcactctgggcttaacaatcttcggagccttttccgcatacctaggaacttcagcccatccatcacatcctctccatttcaaatctcgcaacctcaccatttctttcccgtctcctccttcatcttcgtgttgtggctcgatttgatggaaaagatcatcttcatcgatctcgaaat

SEQ ID NO: 3626 - DNA, 191 bp, Cicer arietinum
actacacaaaaatcacactcagtataatatttttcttcaaagtattttgtggctagtaatatacaacatcgatccatacaaaagtcattcatacagtcttctccacaaaacgatatatcagattgcagctctcattgctccccttgccacctcccgtttcatctcggcagccttaccactgccgcggaagt

SEQ ID NO: 3627 - DNA, 246 bp, Cicer arietinum
actgagacggcggcgatttcttcacgatcttcgaagttcggatccttggaatccaatgctccgtaatcaggtccaatttgaagatcctcgtagccacgtccgatctacgtaaacttacctccgtgtcctcctttcttcggcgatccgctcgttcctgtcgctgatttccgatccttccttgtctccggcgaagattttccgttcgccttatggctctttccggtgtctttcatagtgtgagacctg

SEQ ID NO: 3628 - DNA, 382 bp, Cicer arietinum
actattaattaacagcagaacagactgctttacaactgtcaaaataaataaaaagctaaaatacataacagcttaaagaaattagagaaaaaaaaacacaataacaatcttatcaccatataatagaaaaattaacgccttttctttcctgaagacaaaacgcggaaactttgcttcccttttttctctttcgatgtatcttccttccatcactttctttattttcatatattcttcataatctttcatagagagctatggtaataaaccactattattgtttactatctaatagtggtaaggaggaggaggtgaggaatagaggtaaggcttcttggttggagttggtggtggagagtggtaaactggatgtggaatgtat

SEQ ID NO: 3629 - DNA, 429 bp, Cicer arietinum
acaaagatgttattgaagctctagcagctaagggaattgaggaagatcctcggaactatttgacattcttctgccttggcaatagagaggtggtgaaagaaggagaatacgtgcctactgaaaaaccagagcctgatacagattacatgagagcccaagaggccaggcgtttcatgatttatgttcatgccaagatgatgatagttgatgatgaatacataatcgttggatctgccaacatcaaccaaagatcaatggatggtgctagagactctgaaatagcaatgggtgcttatcagccctatcatttggctaataggcagcctgcaagggggcagattcatggtttccgcatgtcattgtggtatgagcatcttggcatgcttcatgactcattcctccatccagaaactgaagattgcattagga

SEQ ID NO: 3630 - DNA, 427 bp, Cicer arietinum
acattagtgatgggtttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagttaataattaatgtaataaatgtgtgctgtaatatatatgtggtcgcggtttgcttgggttcttaatgaaat

SEQ ID NO: 3631 - DNA, 427 bp, Cicer arietinum
accaagattgcttctgaaggactcaaacatcgtgtgtttgagatctcattggctgatcttcaaggtgatgaggataatgctttcaggaagattaggttgagggctgaagatgttcagggcaagaatgtcctcaccaacttttatggtatggatttcaccactgacaagctcaggtctttggtccgtaaatggcaaactctcattgaagctcatgtggatgttaagaccactgataattataccttgagaatgttctgcattggctttaccaagagacgcagtaaccaagtgaagagaacctgttatgctcaatccagccagatcagacagatccgcaggaagatgagggagatcatggttaaccaagcaacatcgtgtgatttgaaggagcttgttcgcaagtttatccctgagatgattggaaagg

SEQ ID NO: 3632 - DNA, 383 bp, Cicer arietinum
actcaaccacaaggaaaagatatatgtgtttgactgcacgcttgtgcagtctcaacaaacatcaaaattcttagtatcaccaccctgactaaaatccattacaacaaaaagaactagacttgcaatacaagtaattccaaaggaagagattctgataactcatgtgtatctagaaggagcattattcaaaattgaagctacttctatagacaaaaaaaacagtctaagagaggcaagagtaagccagattcttttcctcggaaagctcttctgctgtcaaatccaacttcttccttgagaactcatcgatcgaaagtccttgaacaattttccattccccaccggcacaggtaacagggaatgaatagatcagtccagcgggt

SEQ ID NO: 3633 - DNA, 405 bp, Cicer arietinum
acttcacattctatggaatgatgactgtttccatcacaccaaatcatcaagttgcatcaatctttgcagcagccttctatggaatctttaaccccttctctggtttcttcattccaaaaccaaaaattcctggatggtggatttggtattattggatctgtccagtagcatggacagtgtatggattaattgtttcacaatatagagacatagatgatccaattcatgtggttggatccactgcaaacttcgctgtcaaaggatatattgaacaccattatgggttcaaacctgatttcatgggtccagttgcaggagttttggttgctttcacttgtttctttgcctttatattttccttctgcatcaaggcactgaacttccaatcaagataaataaactact

SEQ ID NO: 3634 - DNA, 277 bp, Cicer arietinum
gattcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaagtgcctcttgggggtaatgagt

SEQ ID NO: 3635 - DNA, 277 bp, Cicer arietinum; identical to SEQ ID NO: 3634

SEQ ID NO: 3636 - DNA, 358 bp, Cicer arietinum
cgaaggaggaagtctgttcgtggttgcattgttagtccagacctctctgtcttgaacttggttattgtgaagaagggtgaaaatgatttgccaggcttgacagatgttgaaaagccaagaatgaggggtcctaagagagcttccaaaatccgcaagctcttcaatctgtccaaggaggatgatgtcaggaagtatgtcaacacctaccgtaggacattcacaaccaaagctgggaaaaaggtgagcaaagctccaaagatacagcgaccggtcactcctcttactcttcagagaaagagggcaagaattgcagataagaagaaaagaattgccaaagcaaaatcagaggcagcagagt

SEQ ID NO: 3637 - DNA, 433 bp, Cicer arietinum
acaaagatgttattgaagctctagcagctaagggaattgaggaagatcctcggaactatttgacattcttctgccttggcaatagagaggtggtgaaagaaggagaatacgtgcctactgaaaaaccagagcctgatacagattacatgagagcccaagaggccaggcgtttcatgatttatgttcatgccaagatgatgatagttgatgatgaatacataatcgttggatctgccaacatcaaccaaagatcaatggatggtgctagagactctgaaatagcaatgggtgcttatcagccctatcatttggctaataggcagcctgcaagggggcagattcatggtttccgcatgtcattgtggtatgagcatcttggcatgcttcatgactcattcctccatccagaaactgaagattgcattaggaaggt

SEQ ID NO: 3638 - DNA, 296 bp, Cicer arietinum
caaagattttcagccatcctgatgttgttgctgaagaaccatggtatggtattgagcaggaatacaccctgttgcagaaagacaacaattggcctgttgggtggccggttggtggttatcctggacctcagggaccatactattgtggtattggtgctgacaaggctttttgccgtgacgttgttgacgcacattacaaagcctgtctctatgctggcatcaacatcagtggaattaatggagaagtgatgcctggccagtgggaattccaagttggtcctagtattggtatctct

SEQ ID NO: 3639 - DNA, 396 bp, Cicer arietinum
aagccaaaagaataagtttttgtttatgtatgacaataatcatttatacaaatactgatgaaatgcaacaccaaatttcttctaagttgaaaaccaaactaacagtagcatgattaacaagatttacacttaataacacaacacaaccctctgctaacaaaattatagtagtcatctataataaaaaatatgttgcatatataaatcactagaactcattacggcctaagttatatacatacacaagttcacatcacatggactgtaatgtaacaattttgcagcaacataacttcatatttttcaaacaatgtagctagctaagtagtttatttatcttgattggaagttcagtgccttgatgcagaaggaaaatataaaggcaaagaaacaagt

SEQ ID NO: 3640 - DNA, 241 bp, Cicer arietinum
acgattcgagaacagttgcaaacttttgtgagtaagtcataggttgaatgcgatatcaacccatgcgaccacaaaaattcccccctagagttgtaatctgtgttaaactctaaaagggggtttcctatagctattcccttcaaatttattttggttttggtttgtagaatgagttcagcaagctggggtgcaaagtgacctgcataactctcaccagtaatgaagaactcattgtttttgt

SEQ ID NO: 3641 - DNA, 437 bp, Cicer arietinum
acgagcttgattcgttgacgaggaagcacgtgacgattgcgttgtgttacacaacgacgccggatagactccggcgaaggtttcctcacttggagtcgttgaagttgaaagggaaacctagggcggcgatgtttaacttgataccggagaattggggagggtttgttactccttgggtgaaagagatttccaagtattttgattgtttgaaatcgttgcactttcgtcgtatgattgtaactgattctgatcttcagattcttgctcgttcgcgatgtaatagtcttcatgctcttaagttagagaagtgttctggattctccactgatggactttactatgttggtcgcttttgcaagaatttaagagtcttgtttatggaggaaagctcagttgtcgagaaagatggtgaatggctgcatgtgcttgctttgaat

SEQ ID NO: 3642 - DNA, 432 bp, Cicer arietinum
aatcagtaaacgagggccaccctgacaagttgtgcgaccagatctccgatgcagtgcttgatgcctgtcttgaacaggatcctgacagcaaggttgcctgtgaaacatgcaccaagacaaacatggtcatggtctttggagagataacaaccaaagccaatgtagactatgagaagattgtccgtgacacatgccgcaccattggattcatctctgatgatgttggtcttgatgctgacaagtgcaaagtcttggtcaacatcgagcaacagagtcctgatatcgctcagggtgttcacggacactttaccaagcgtccggaggaagttggtgctggtgaccaaggtcacatgtttggctatgccactgatgaaacacctgaactcatgcctctcagtcacgtccttgcaaccaagctcggtgctcgtctta

SEQ ID NO: 3643 - DNA, 407 bp, Cicer arietinum
acgacaatgattttgggtggggtaaacctttggttattcgtagtggtaaagcgaataaatttgatggtaaaatttctgcttttcctggtagagaaggaaatggaagtgttgatcttgaagtcgttttggcacctcaaactatggatggacttgaaaacgacatcgattttatgcagtatgttactcaacaagtagtgtgagtgaaaccacatgtatgatctcgcggttaagttatgatgattatgagttgaggatgaaacaaacggcatacgacaatagtggattggatttgggtgtcgttttgaattgttgggtcaacgtaggttcaaagatgtggggtcagtgtttttagggactgtttggttggtttggttgaccctaccaatatagtagtaatgattttctgt

SEQ ID NO: 3644 - DNA, 434 bp, Cicer arietinum
aaccaatcaaaggttccccttatccaaggggatactataggtgtagcagttcaaagagttgtccggcgagaaaacaagtggaaaggaaccatgtggaccccactgtgctccttgtaacatactcctccgatcacaaccacgccgtgccgcttcctagaaaccaccgcaacaataacaacgaatctgctaaatcaaacaaggattccgaatcggaacacgaacccgaaccagaggagagatttacggatcttggagaggaatctctgatcgccgtcgcggatgagttaggaggatggttgggagaagtggaagcgatcgcgtcgccggcggttctggagtgtccgattttctcagatcaggaattgtcaatgttgggggaagaggaggagtcgctgttcgcggatctcggagagttgccagagtgctcggcggtg

SEQ ID NO: 3645 - DNA, 439 bp, Cicer arietinum
gcatggaagcaagaccgttggaagatgggcttgcagaggccattgatgaaggcacaattggaccaagggatgaccccaaaatccgttctaaaatcttgtcagagcagtatggttgggataaggatcttgctaagaagatttggtgttttggacctgagaccactggacccaacatggtggttgatatgtgtaagggagtccagtatttgaatgaaatcaaggattctgttgttgctggatttcagtgggcatctaaagaaggtgctttagcagaagaaaacatgagagccatttgttttgaagtgtgtgatgttgtcctccacactgatgctatccatagaggaggtggtcagatcattcctactgccaggagagtgttctatgcctcacagctgacagccaaacctaggcttcttgagcctgtttaccttgtggaaat

SEQ ID NO: 3646 - DNA, 440 bp, Cicer arietinum
gtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacatt

SEQ ID NO: 3647 - DNA, 341 bp, Cicer arietinum; identical to SEQ ID NO: 537

SEQ ID NO: 3648 - DNA, 438 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactacccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctc

SEQ ID NO: 3649 - DNA, 341 bp, Cicer arietinum; identical to SEQ ID NO: 537

SEQ ID NO: 3650 - DNA, 439 bp, Cicer arietinum
  misc_feature (44)..(44): n is a, c, g, or t
acggacaaggggaatccgactgtttaattaaaacaaagcattgncgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactacccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctc

SEQ ID NO: 3651 - DNA, 347 bp, Cicer arietinum
acacttcaaggaagaaaatcagtaaagacaagggtgctgagccaaccgaatttgaggaaaaagttgcacaggcgctttttgacctagaaaataccaaccatgagctgaaaagtgagctgaaagatttatacataaattcagcagctcaaatcgatgtttctggaagccgtaaggctgtggttgcccatgttccttaccgtttgaggaaagggttccgcaaaattcacgtcaggcttgttagggagcttgagaagaaatttagcggcaaggatgtaatccttatcgccaccaggaggatagcaaggccaccaaagaaaggctctgctgctcagcgcccccgcagccgt

SEQ ID NO: 3652 - DNA, 439 bp, Cicer arietinum
acccggcgccgtatttaacgtcgccacaagcataattggcgctggaatcatgtcaatcccagcgattctaaaggttctcggcgtgattccctcttttgccttgattctcatcgttgccgttttggctgaagtttccgtggactttctcatgcgttttacgcatgccggtgaaacgacgacgtatgctggtgttgtgagcgaggcttttggatccgttggagcattaaccgctcaagtttgtgttataattacaaactttggtggtttaattctctaccttattatcatcggggatgttttatctggaaaggaaggtggtgatgaattgcatttgggaattttgcagcagtggtttgggattcactggtggaattcccgggaagttgctcttcttatcactttggttcttgttatgcttccattggtcttgtacctcggc

SEQ ID NO: 3653 - DNA, 412 bp, Cicer arietinum
attattctgtttttggatctaagttaactccactcctcttttgttcttcactaagcagagaaaacacactaagaaaaagatgggaggtgcaagaagtaatggaatgttgaacggtggaagaagcatcccacagagatgttcaaggcgtccaattccaaaacgaggacaagtgaaagttggaatagtagttggtctcgccaactctgttgcttccattttctctcgtggtaggactaatcctagggggtgtcctcagtaattcagaggaacacagttttgatcatcattttctattttgtataaattggggcttttttattttattttaattcccttttgttctgttcatatgtaaaaatctcttgcttttgttgctaatgaatccgtttggatctaagtaaggattttgatc

SEQ ID NO: 3654 - DNA, 440 bp, Cicer arietinum
accaataactatctgacacataccatgaatgtgtgcctagttatagcttctttattaggacctccaatcactacatttcaagagtagtgaccctaatacatttacattgagctaaccataccctcctctgatgaatatgtggaagccacacttactatgtcttgttctacagattttttgttaacaaaattacaatgttttctaatttctcccttgtttcctgttatgacaccaatactactcattttaatcattgcagctttaaagctttcaaagaaagcatcttggtcagtactaaacttgttgacaatactaatagtatctgcaccagatgttgaaaaaagctcttgatcactctgaagtaaaccctttttaacctttagattggagtagtagtttttgtcgaatgtatcaggagtggttggatcaaaattggcgag

SEQ ID NO: 3655 - DNA, 319 bp, Cicer arietinum
actacactgatcagatcatcaaaggccttgctttggctatgctccttgctggaaccgactcatctgctgtaactttagagtggtcaatgtctaatttgttgaaccatccagaggtattgaagaaggtaagagatgaattggatactcatgtaggacaagatcgtttggtagatgaatcagaccttccaaaacttacttacctaaaaaatgtcatctatgaaacgcttcggttgtatggtccagcccctttattaataccacactcaacttcagatgattgcattattggaggatataaaataccacgagacaccatagt

SEQ ID NO: 3656 - DNA, 405 bp, Cicer arietinum; identical to SEQ ID NO: 1128

SEQ ID NO: 3657 - DNA, 339 bp, Cicer arietinum
actacaaagcattcttctcacgcaagctagaagggaaatcatgccttgattctataagaatctaaaatgagattagtaagtgatgataaaataaaagttctataggactattttgggttaaaaataaacatgttttctgaaaacagttacactatatgcggtatctgcataataataataataataataataataatattggtatttaagccttattagacactaaggttggtgtgaagaatctgtgttataaactttggcctactgagtttgattcttacttcataaaaaaaggtaggaagtttattgttattttttgggcttacatgtcccataggt

SEQ ID NO: 3658 - DNA, 273 bp, Cicer arietinum; identical to SEQ ID NO: 3441

SEQ ID NO: 3659 - DNA, 158 bp, Cicer arietinum
ctttcttatttcttcttcaaattagtgcagcagaaaaagaagatgatgaggttgaagttgaagtatttggctatgaagatgttgttggagccatggccaaataaatgatggcacaagaattatacatatatatgccttctaggcaagtctgatgcttg

SEQ ID NO: 3660 - DNA, 401 bp, Cicer arietinum
actattaattaacagcagaacagactgctttacaactgtcaaaataaataaaaagctaaaatacataacagcttaaagaaattagagaaaaaaaaacacaataacaatcttatcaccatataatagaaaaattaacgccttttctttcctgaagacaaaacgcggaaactttgcttcccttttttctctttcgatgtatcttccttccatcactttctttattttcatatattcttcataatctttcatagagagctatggtaataaaccactattattgtttactatctaatagtggtaaggaggaggaggtgaggaatagaggtaaggcttcttggttggagttggtggtggagagtggtaaactggatgtggaatgtatgggggagaagtatgaactg

SEQ ID NO: 3661 - DNA, 347 bp, Cicer arietinum; identical to SEQ ID NO: 3651

SEQ ID NO: 3662 - DNA, 442 bp, Cicer arietinum
  misc_feature (432)..(432): n is a, c, g, or t
ttactggatggatgagaattatctctacacctgcttcggtcaaaccggcgaggtaacatctctgaaagtgattaggaataagcaaaccagtcaatcggaaggttatggttttatcgagtttaattctcgtgctactgccgagagagtgcttcagacatataacggagccattatgcctaatggtggccagagctacagattgaattgggcgactttcagtgctggggagaggtcgtctagacaggatgatggtcctgatcataccatttttgttggtgatttggctgttgatgttactgattaccttcttcaggagacttttagggctcgttataactctgtgaagggggcaaaagttgtgattgataggcttacttgtcggtctaagggttatggttttgttagatttgctgacgagagtgaacaaattanggctatgact

SEQ ID NO: 3663 - DNA, 409 bp, Cicer arietinum
gatgtggagaaaaccatatatatatttcacatcacctgcagccaaatctttactggtatggtaggatattgtctctgttaagtgttaagctgaatatttgttattgttttttgtatgatcaaaaaatgggggttggtattaagcataaaagtctagcctctcccaacgtaacaaatcatggttcaaatctctgcttaggctcatcaaaaatgccattgattcacatgaattagtgaactcgtgaactttacccaatgatagagacaacgacaccaacaacaaccaaaccttatcccactaagctgggtaggctatatggatcaaatgatgccataatattatgtgatatatcatatctaatgttgtaatttttaattatatcttgtctagtttgtcgacacatcctcgc

SEQ ID NO: 3664 - DNA, 409 bp, Cicer arietinum; identical to SEQ ID NO: 3663

SEQ ID NO: 3665 - DNA, 436 bp, Cicer arietinum
acattataataaagaagaaaggccgaataatctgagtaaagcaactacaacattaattaacgaaaactgagaaatcacaaaagatgtgagtgattacaagatcggtaacttatttctcagaatgagccagcttgcctgtaaattatcaaacttctatggaatcctcccataagctgcagctattgtcatcatttgaaactctcaaactgcaccatctacttcattcattcattcttttcatgcaagggctaacttgccagtaatgcagtaaagttggtgatcaataccgtcccttatatggcgcctcaggtaggtaattgggcatgtataaaacttgtctaggatgaccatgaagttgtccatactgtggtccattctgatgaaaatattgttgagatggcatttgagctacctgtggattatacatgataggttg

SEQ ID NO: 3666 - DNA, 440 bp, Cicer arietinum
actcatgaaggcgtgattgctggattcaaggctgcttccgttgcatgcgttgtcagtgctgtgcctacattgactgctgttcgcaagattccatgggcaaaggcaaacctcaattatactgctcaggcacttatcatatctgctgcatccattgcagcatacttcatcactgctgataaaacaatcttggaatgtgcaagaaaaaatgctcaacttgaaaattctctgagacacaatcgtgacacagtttcatcttagacacttctatactcattgctggtcttggtgaaggatttgtgctacttgcaatattcaaccagtaggcctgttgcaaaactttcctttctgggtctggctcgaatggatttgaaggtgtatatgctcaaataaaagagtttgttgttgttgttgttgttgtgtaacagttatatttggaattg

SEQ ID NO: 3667 - DNA, 332 bp, Cicer arietinum; identical to SEQ ID NO: 3065

SEQ ID NO: 3668 - DNA, 398 bp, Cicer arietinum
cgtcgcatgctcctcgccgccatgggggacgcgggaattcgatttcgagcggccgcccgggcaggtcgtgaatggtgaactacatccatccagattttgtgagaaagatttgctcaaagttgttgatagggagtatgtttttgcatatgttgatgatccttgtctctctacataccctttgatgcaaaagttgagacaagtgcttgtagatcatgcattggtgaatgttgatggtgagaagaatttgaacacatcaatatttcaaaagattgcaacttttgaggatgagttgaagacccttttgcctaaagaagttgaaagtgcaagaattgcttatgagaatggacaatgtggaattccaaacaagattaaggagtgtaggtcttatccattgtaca

SEQ ID NO: 3669 - DNA, 429 bp, Cicer arietinum
gggacagaactctaaccgtgaatggattttctaaggcctttgcgatgaccggttggcggcttggttatattgctggcccaaaacatttcattgcagcatgtggaaagattcaaagtcagttcacttcaggggccagtagtatatctcagaaagctgcggttgctgcattaggactaggctatgctggtggggaggctgtttcgatcatggtgaaagcatttagggaacgaagggattacttggttaaaagtttcggcgaaatagatggtgttaaaatatctgaaccccagggagcattttatttattcattgacttcagcttctattatggaagagaagctgaaggatttggtaaaattgaggattctgagtccctctgtcgatatctgttggataaaggccaggtagcactggtaccctgcccgggcg

SEQ ID NO: 3670 - DNA, 420 bp, Cicer arietinum
gggacagaactctaaccgtgaatggattttctaaggcctttgcgatgaccggttggcggcttggttatattgctggcccaaaacatttcattgcagcatgtggaaagattcaaagtcagttcacttcaggggccagtagtatatctcagaaagctgcggttgctgcattaggactaggctatgctggtggggaggctgtttcgatcatggtgaaagcatttagggaacgaagggattacttggttaaaagtttcggcgaaatagatggtgttaaaatatctgaaccccagggagcattttatttattcattgacttcagcttctattatggaagagaagctgaaggatttggtaaaattgaggattctgagtccctctgtcgatatctgttggataaaggccaggtagcactggtacctg

SEQ ID NO: 3671 - DNA, 373 bp, Cicer arietinum
ctagtaatcagaaggctaacatgcatttcaccatacagtgcaaccatagccttgggaagtgaaatgtcaggagggatacaagatgttagagctgaagacatcacagccattcgaacagaatcaggtgtcaggattaaaacagctgttggtagaggaggttatgtgaaggacatatatgtgaagagaatgaacatgtatactatgaaatgggcatttaagatgacaggtgattacaattcacatgctgatacacattatgaccctaatgctttgcctgagatttcaaatatcaactatagagacattgtggctgagaatgttacaatagcagctaggtttgaaggaatttctaatgacccttttaagggaattt

SEQ ID NO: 3672 - DNA, 331 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctg

SEQ ID NO: 3673 - DNA, 151 bp, Cicer arietinum
ccttaccactattagatagtaaacaataatagtggtttattaccatagctctctatgaaagattatgaagaatatatgaaaataaagaaagtgatggaaggaagatacatcgaaagagaaaaaagggaaagcaagtttccgcgttttgtct

SEQ ID NO: 3674 - DNA, 439 bp, Cicer arietinum
ttcctgctttctctaaaaaaggagatgtaattgtggcggatgagggagtccactggggaattcagaatggcctatatctttctagaagcaccgtggtatattttaagcacaatgacatggattctttaaaagaaactttagagaaaattacttctaaatacaagcacaccaagaatttgaggcggtatattgttgttgaagctctctaccagaattctggccaaatagcaccattagatgatatcattaaactaaaggaaaaatatcggtttcgtattttactggatgagagcaactcatttggtgtgcttggaagttctggaagaggtctcactgaacactacggagttcctgttgagaagttagatcttataactgctgcaatgggacatgcattggccacagaaggaggattttgcactggaagtgcaagagttat

SEQ ID NO: 3675 - DNA, 436 bp, Cicer arietinum
ttcctgctttctctaaaaaaggagatgtaattgtggcggatgagggagtccactggggaattcagaatggcctatatctttctagaagcaccgtggtatattttaagcacaatgacatggattctttaaaagaaactttagagaaaattacttctaaatacaagcacaccaagaatttgaggcggtatattgttgttgaagctctctaccagaattctggccaaatagcaccattagatgatatcattaaactaaaggaaaaatatcggtttcgtattttactggatgagagcaactcatttggtgtgcttggaagttctggaagaggtctcactgaacactacggagttcctgttgagaagttagatcttataactgctgcaatgggacatgcattggccacagaaggaggattttgcactggaagtgcaagagt

SEQ ID NO: 3676 - DNA, 280 bp, Cicer arietinum
cggcgggagtaactatgactctcttaaggtagccaaattcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattcca

SEQ ID NO: 3677 - DNA, 410 bp, Cicer arietinum
ggaaaaaccatcacccttgaggttgaatcgtctgatacaattgataatggcaaggccaagatccaggacaaagagggtatccctcctgatcagcagaggcttatctttgcagggaaacaacttgaggatggtagaaccctagctgattacaacatccagaaagagtctacccttcatttggtgcttcgattgagaggtggcatgcaaatttttgttaagactttgacagggaagaccattaccctcgaggttgaatcttctgatacgattgataatgtcaaagccaagatccaggacaaagagggtatccctcctgatcagcagaggcttatcttcgccggtaagcaattggaagatggtcgcaccctagctgattacaatatccaaaaggaatccacccttcatttggt

SEQ ID NO: 3678 - DNA, 358 bp, Cicer arietinum
acacaagtgagctgctagctcttcttatccactataaacaacaacaaagttacaagacaactcaaagaagctgtgataatcaccatactagtagctaacagcaacgatgcatatcccatttatctttgttttcagcaataacctcaactctatcaaggcagagtgtaaggtccacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttgtgacacacttgcattttcatctt

SEQ ID NO: 3679 - DNA, 432 bp, Cicer arietinum
accagcttcgtgaagaacgcgatatgaaaccggagacatttgctagcttagtatctgctattctctacgagaaaaggttcggtccatacttttgccagccagtaattgctggattaggggatgatgacaaaccgttcatttgcacaatggatgcaattggagcaaaggagcttgcaaaagattttgttgttgctgggactgcatctgagtctctgtatggtgcttgtgagtcgatgtttaaggctgacatggaacccgaggaattgtttgagaccatctcccaagcactgctatcatctgtagaccgtgattgccttagtggctggggtggtcatgtctatgttgtcacaccaactgaagtaaaggaaaggattttgaagggaagaatggattaacttctaggactcctggtcaactacttgagttcacttt

SEQ ID NO: 3680 - DNA, 307 bp, Cicer arietinum
acaagagatcaaggttgtctagaaaccgtaggaccgtgaaccgtgcatatggtggagttttgtccggaggtgctgttagagaaaggatcattagggctttcttggttgaagaacaaaagattgtcaagaaggtcttgaaaattcaaaagtcaaaggaaaagcagacctctaaggcctgattttgcatcatagaatgagagatctttttgaatgactcttaggtttgagtgattcaaaaagatctctcattctagagcaattgttaacattggcaactattctattatgatacagttttgtttgtgtt

SEQ ID NO: 3681 - DNA, 382 bp, Cicer arietinum
gcacaaggtcatgctcaattggtagccaagaatctaaagctattgatagaaggaggagggaaagaaaataaattgggaatttacaaagcacaaccaccaatgtctattgtttcacttggaagaaaacatggagttgcacaattccctttcatgacagttgttggaagatttcctggtatgatcaaatcaggagatttgtttgttgggaaaacaagaaaggaattaggacttgaacctaaaattaaaaaatcttaatcaatttcatatggtgtctgtatatagttactcaacttatttttcttataactattttgtgtgtgtttgtttgtgttcattatttgttttctttcggagtgtattccattgagttgcatgtaccttg

SEQ ID NO: 3682 - DNA, 435 bp, Cicer arietinum
cacaagccacgtttcctaactcggttactttgactcggaacgattctctaaatttgagtaactcggagcgattttctctttttttcctttcgattttctccttcttcgttcgtcatgccgaaggctaaagctgattccaaacccgctgataacaggttaaagcgcaaaggcgcaggaaccggaacgaagcagtcgaagaaagctgctaaggatcctaacaagccaaagaggcctccgagtgctttcttcgttttcatgtctgacttcagagaacaatataagaaggatcatcctaataacaaatccgtcgccgctgtcggtaaagcttgcggagaagaatggaaatcgttgtctgatgctgataaggctccctatgttgctagggcattgaagaagaaagcagagtatgagaaaaatgttcaggcttacaatagg

SEQ ID NO: 3683 - DNA, 439 bp, Cicer arietinum
accaatccacaggaatatccaatatatgattttacatacgaatttcaaaacaaagaaataaaggaaggtgtgatgatttcatgaatgcaaaatgattttgacctaataaaaccaactgacaacaaaacagaaatgcataatgtgaataggaagtagcctctcccatcctgggtcaacaatcacaaatgactccaagaatagaaaagcaactatgcatagaaaaagtaatatggatgataaacagactagggatacacagtgaggtgatggaaaaaaaatgactcaagaagatgcagggttaaaagtcagaaaaaggaagagaatatctagaaacaaagcacttaggtggtgttgatgaaaaccagttgaaccctgggagttcatccattccaataacccacgcggccagttcaggagaaaaaaaaccattttagcatag

SEQ ID NO: 3684 - DNA, 399 bp, Cicer arietinum
actggggcgaggaagctaaaccagggagggaaatggcggacaagttatttaactgtgaagatgtgcttttgaactacttgtatgcaaatgcgagttcatcgagaacagtcgattatgtgaaaccagcttgggcaatcgacacttcaaagttttccggtgcggcaattagccgcaacacgaacgtgcattatcaattgagaagcaattgtctaatgaaattttcggagatgtatggaagtttggcgggtcggatatggcggtttgacagtaggaaagatggttgggatgtatagtagggaagtaaaagagtggtttttatttatttatagttaggtatttggcaagttttgtatttttactattacatctttgtgggtataaagtcttgtttatacttgt

SEQ ID NO: 3685 - DNA, 300 bp, Cicer arietinum
gccgaggtactacactgatcagatcatcaaaggccttgctttggctatgctccttgctggaaccgactcatctgctgtaactttagagtggtcaatgtctaatttgttgaaccatccagaggtattgaagaaggtaagagatgaattggatactcatgtaggacaagatcgtttggtagatgaatcagaccttccaaaacttacttacctaaaaaatgtcatctatgaaacgcttcggttgtatggtccagcccctttattaataccacactcaacttcacatgattgcattattggagg

SEQ ID NO: 3686 - DNA, 462 bp, Cicer arietinum
gattagcgtggtccggccgaggtattcagataatattcagatatccaatctcactttggttaattctccctcctggaatgtccatcctgtttacagcagcaacgttattgttcaaggaatcacaattcttgcgcccgtggactcgccaaatacagatggaatcaaccctgactcttgcacgaacacacgaattgaggactgttatatagtgtcaggggacgattgtgtggctgtgaagagtggttgggatgagtatggtatagcttatggaatgccaacgaagcaactggtaatcagaaggctcacttgtatttctccaacgagtgccgtgattgctttagggagtgaaatgtctggtggaatcgaagatgtgagggctgaggacattgtagccatcaattcagaatcaggagtcaggatcaaaactgctgttggaagaggaggttatgtcaaggacatata

SEQ ID NO: 3687 - DNA, 328 bp, Cicer arietinum
  misc_feature (327)..(327): n is a, c, g, or t
acccattttggaggtggcaaatcaaccggttttggtttgatttacgatacagttgagaatgctaagaagtatgagcccaaatacagacttatcaggaatggtcttgacaccaaaatagagaagtcaaggaagcaaatgaaggagagaaagaatagggccaagaagatccgtggtgtaaagaagaccaaggcctctgatgctgccaaggctggaaaaaagaaatgagtttttagttgtcgtgtttgtgctttaaggttgttttgctttccaagtttttttgatagctatgttatctcatgcatggtctacaaaatgagatattttggnc

SEQ ID NO: 3688 - DNA, 442 bp, Cicer arietinum
accggggttattttctagctacatctcgtgagttaactcgcctagattcaattacaaaagcacctgtcattgttcatttctccgaaagcatttccggggtcatgacaatacgcgcgttcagaaagcagaaggagtttggtgttgaaaacattaaacgagtgaattctaatttgcgaatggatttccacaactacagttccaacgcgtggttgggtttccgcttagaactgcttggaagtttagttttctgcacttctgctttgttcatgatcatgttacccagcagtgtcataaagccagaaaatgttggtttatctctctcctatggattgtcgttgaattcggtgctgttctgggctatatacatgagctgtttcattgaaaacaaaatggtatcagttgagaggataaaacagttctcaaatattccatcagaagcagc

SEQ ID NO: 3689 - DNA, 366 bp, Cicer arietinum
acacaagtgagctgctagctcttcttatccactataaacaacaacaaagttacaagacaactcaaagaagctgtgataatcaccatactagtagctaacagcaacgatgcatatcccatttatctttgttttcagcaataacctcaactctatcaaggcagagtgtaaggtccacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttgtgacacacttgcattttcatcttgtgctgca

SEQ ID NO: 3690 - DNA, 412 bp, Cicer arietinum
accagcttcgtgaagaacgcgatatgaaaccggagacatttgctagcttagtatctgctattctctacgagaaaaggttcggtccatacttttgccagccagtaattgctggattaggggatgatgacaaaccgttcatttgcacaatggatgcaattggagcaaaggagcttgcaaaagattttgttgttgctgggactgcatctgagtctctgtatggtgcttgtgagtcgatgtttaaggctgacatggaacccgaggaattgtttgagaccatctcccaagcactgctatcatctgtagaccgtgattgccttagtggctggggtggtcatgtctatgttgtcacaccaactgaagtaaaggaaaggattttgaagggaagaatggattaacttctaagactcctggt

SEQ ID NO: 3691 - DNA, 438 bp, Cicer arietinum
gattaatcggtcagatgttgcattacatctgcatgaagaaataaaatctgttgctgaccttggagattattatgaactcaactcaacaaaaggaaacagttacatctgtgaagttgctgtggttgccacaccactggatgagataaatattcaatttattcccccaatttcaattcctgagagaaaattacagcacacacatgcaacttttgtcaggggccttctaaaccctgtatatttcggtctcaaggctgcggcaaaaattccagatcttgtggccacattagaggaccctaaacttccatttacaagcatttcagttctcaagaagcacaatgaagaagagtccacttataaaatattctctcgtcaaccagtggcagacacattacttgatagcattttcagtgggaggaaggagacaattaggataaactg

SEQ ID NO: 3692 - DNA, 437 bp, Cicer arietinum
actttctcccttgaagaagaagaagaaacaacaacaacaacaccaccgtcaacaaaagggtgcatcagtcatgtttgggcgtggaccaaggaagagtgataacactaaatattatgatattctcggtgttgcaaaaaatgccagtgaagatgaaatcaagaaagcctatagaaaggcagcaatgaagaaccatccggacaagggtggggatcctgagaagttcaaggagttgggtcaagcatatgaagtgctaagtgatcctgaaaagaaagaaatgtatgatcaatatggtgaagatgcccttaaagaaggaatgggaggaggaagttcatttcataatccatttgatatatttgaatcattctttggtggagcaggctttggtggtggcggtccttcacggggaagaagacagaagcaaggagaagatgtggtgc

SEQ ID NO: 3693 - DNA, 438 bp, Cicer arietinum
gctagctacttgttaataatatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagatttt

SEQ ID NO: 3694 - DNA, 240 bp, Cicer arietinum
acaccgtttaaaaacaaatacaaacctatgctctattctatttgcatgatatggtgccaagtcaaggaaagggagaaagaaacctcaattaccaaccaacaatttgctcaaaaaaaaaaaaaaaaaaaaaaaaaaaaagcttgtacaagctttttttttttttttttttttttttttttaaccaaaacaggggaatatatttatttggtttgtcagccaacttgataaaccaaactttga

SEQ ID NO: 3695 - DNA, 440 bp, Cicer arietinum
tggaaagccaaagttctatctacaaattctaaatacaatgccaagagccacacatgttattacatgtaaagctgcaatatgctgggggaaaggaaagacagtgacggttgaagagatagaagtagatccaccaaaggcaacagaagttagagttaagatgttgtgtgcaagtctctgccacacagacatctcaagcattcaaggatttcctcataatcaatttcctctagcacttggacatgaaggaattggtgttgtagagagtattggcgatgaagtaagaaatctaaaggaaggggattttataattccaacatacataggagaatgtgaagaatgtgagaattgtgtttcaggaaaaaccaatgtgtgtttgacacatcctgtgaggttgactggtctaatgccagacaacagttcaaggttgtcaattaaagggc

SEQ ID NO: 3696 - DNA, 438 bp, Cicer arietinum
ctccaatttgttatttatatctatatagatctggcccaaattacaatggttggaagcccgaaaccgtgaaaatctatggatatgattcagagcccattacatttacttttaacacctccatccctagtgacacttggtatggatataatttgtgtgatgctcctcctccttcatcttccatccaactatccattcacaaattgattgtgtttgtaatgattcttggatctgcttttagtatttggatgtaatttgtaatttttgtatatttggtttttcgtttggattaacaaaatcgtggcgagttattgtgattttgtagaagctatactttatagttattgcaaaattataatgattcatcatgattttgctattttcgtgtaaaatcaaatatgcacttacatatttttctcgtatgtgcacttaaatgttcta

SEQ ID NO: 3697 - DNA, 437 bp, Cicer arietinum
acactagatggacaaggtgaactgtggtggcaaaagtttcaccatgggcagcttagttataccagaccttacctaattgaaatcatgtattcagataatattcagatatccaatctcactttggttaattctccctcctggaatgtccatcctgtttacagcagcaacgttattgttcaaggaatcacaattcttgcgcccgtgaactcgccaaatacagatggaatcaaccctgactcttgcacgaacacacgaattgaggactgttatatagtgtcaggggacgattgtgtggctgtgaagagtggttgggatgagtatggtatagcttatggaatgccaacgaagcaactggtaatcagaaggctcacttgtatttctccaacgagtgccgtgattgctttagggagtgaaatgtctggtggaatcgaagatgt

SEQ ID NO: 3698 - DNA, 434 bp, Cicer arietinum
ctccaatttgttatttatatctatatagatctggcccaaattacaatggttggaagcccgaaaccgtgaaaatctatggatatgattcagagcccattacatttacttttaacacctccatccctagtgacacttggtatggatataatttgtgtgatgctcctcctccttcatcttccatccaactatccattcacaaattgattgtgtttgtaatgattcttggatctgcttttagtatttggatgtaatttgtaatttttgtatatttggtttttcgtttggattaacaaaatcgtggcgagttattgtgattttgtagaagctatactttatagttattgcaaaattataatgattcatcatgattttgctattttcgtgtaaaatcaaatatgcacttacatatttttctcgtatgtgcacttaaatgt

SEQ ID NO: 3699 - DNA, 417 bp, Cicer arietinum; identical to SEQ ID NO: 1754

SEQ ID NO: 3700 - DNA, 426 bp, Cicer arietinum
actaggaattaaagtgaaggatcattctgaagaactttcaaaagggtatgcagcacttgtggttgtaatggtgtgcatttttgtgtctgcatttgcgtggtcttggggtccgctcggttggctaattccgagtgagatatttccattggagactcgttctgcaggacaaagtgttacagtttgtgtcaactttctcttcacttttgtcattgcacaagcttttctttcaatgttgtgcaatttcaaatttggtatcttctttttcttctctggttggatcttgatcatgtctgcttttgtccttttccttgtccccgagacgaagaatgtccctattgaagagatgacagagagagtgtggaagcagcattggttgtggaagaggtttgttgaagatgagaaagtagaggatggaaatgaccctag

SEQ ID NO: 3701 - DNA, 394 bp, Cicer arietinum
acccaaggatgtaaatgctgctgttggaaccatcaaaacgaagaggacagtccagtttgttgattggtgtcctaccggctttaaatgtggtatcaactatcagcctccatcagttgtgcctggtggtgaccttgcaaaggtgcagagagcagtttgcatgatcagcaacaacactgctgtagcagaggtcttctctcgcattgatcacaagtttgatcttatgtatgctaaaagggcctttgttcactggtatgtcggtgagggcatggaagaaggggagttctcagaagcacgtgaagatcttgctgctcttgagaaagattatgaagaagtcggtgctgagggagcagaagatgaagatgaaggagaggattattgatttgcaatatgtagt

SEQ ID NO: 3702 - DNA, 435 bp, Cicer arietinum
aattactggccggattctatcgacatttctgacttagaatgcaagaaacgagagagaaaggggtggaaggtgaagatacatgatctatctggctcagctgtagctgcagccttcataacaactccctttgttccatcttcaggttatgattgggttgccagatccaacccaggagcttggttgattgtccgtccggatgttggtagatccgagagctggcagccgtggggaaagctcgaagcatggcgtgagcgtggcattaaagactcggtatgctgtagattccatcttctacctgaagctcatgacggaggcaatcttctcatgtctgaaattcatataaatgctgaaaagggcggcgagtttttcatagataccgaaaaacacatgagaaccgcaacttctgcagcaagtccaatacctagtccgcaaagt

SEQ ID NO: 3703 - DNA, 435 bp, Cicer arietinum
acctatggggccttcatccagattgcaacatgctttggtctattgggggctttatttattggaatccctgtcaaagaaatttctggatggtggcgggtttgtttctgggtatctaacatacctgcagctctacttgctctggctatgttcttctgtgctgagagtccacattggttattcaagcaaggaagaattactgaagcagaagctgagtttgaaaggcttcttggtgtatccgaagcaaaatttgcgatatcacagttatccaaggtagatagaggagacgatactgatagtgtgaagctctctgaattgcttcgtggccatcattctaaagttgtttttattggatccaccctatttgctttacaacagctatctggtataaatgctgtgttttatttctcttcaactgtttttaaaagagctggagtg

SEQ ID NO: 3704 - DNA, 439 bp, Cicer arietinum
acctatggggccttcatccagattgcaacatgctttggtctattgggggctttatttattggaatccctgtcaaagaaatttctggatggtggcgggtttgtttctgggtatctaacatacctgcagctctacttgctctggctatgttcttctgtgctgagagtccacattggttattcaagcaaggaagaattactgaagcagaagctgagtttgaaaggcttcttggtgtatccgaagcaaaatttgcgatatcacagttatccaaggtagatagaggagacgatactgatagtgtgaagctctctgaattgcttcgtggccatcattctaaagttgtttttattggatccaccctatttgctttacaacagctatctggtataaatgctgtgttttatttctcttcaactgtttttaaaagagctggagtgccat

SEQ ID NO: 3705 - DNA, 409 bp, Cicer arietinum
atttgggatataattacagcatagttgggggtgcaggattgtcagagacagtggaaaagatatcatttgaggcaaaattgtgtgaaggcccaaatggagggtccattgggaaggtgagcgtaaaatatcaaaccaaaggagatgctaagcccaatgagaaggaggttcaagaaggaaaggcaaagggtgatgctcttttcaaggccattgagggttacgttttggccaattctaattacaactgatccatccttcaactatacctaacatgagttgatgtcttcttatgttagctttcaatcaaataaactgttctcttgtttagttttcctttctctctcctgaaatgtgatatttcatgtctttgtatctccctttatcaataaaaattaaataagtttatacatat

SEQ ID NO: 3706 - DNA, 293 bp, Cicer arietinum
actaggttgaattactattgcgacactgtcatcagtagggtaaaactaacctgtctcacgacggtctaagcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 3707 - DNA, 293 bp, Cicer arietinum; identical to SEQ ID NO: 3706

SEQ ID NO: 3708 - DNA, 323 bp, Cicer arietinum
tgctcccccgttgacttcaacttccgaacaaccacctcttttcgatggaaccaccaggttgtataccagttatagttgcccttttgcacaacgtgtatggatcactaggaactacgaggggttacaagagaagatcaaattggttcctattgaccttcaaaacaggcctgcttggtatgaggaaaaagtatatcctgaaaatgaggtgccatctttggagcacaatggcaaggtattgggggaaagtcttgatttgatcaaatatgttgatgctaactttgaagggactcctcttcttcccaatgatctggccaggaaggagt

SEQ ID NO: 3709 - DNA, 440 bp, Cicer arietinum
cccgggcaggtacagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctcggccgcg

SEQ ID NO: 3710 - DNA, 293 bp, Cicer arietinum; identical to SEQ ID NO: 1098

SEQ ID NO: 3711 - DNA, 436 bp, Cicer arietinum
aattctttcttggcacgcactgttagtgccgtgttaggagcgggattttctgcaggccacgcgaccacacaaaactgcggggatgctatcggctccctaacagcagttttcagagaaggaattttggagagttcgccttctctgacaacacctttgtcggacctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaattctggtcggtggaaaaagttcga

SEQ ID NO: 3712 - DNA, 344 bp, Cicer arietinum
acaaggacctcgccagcgtcttcggcggcgagaagacctgcaagaccttccagatcaagaccaagactgagctcaacgagctcctcaccaacaaggagttcaacgctgctgagtgcttgcaattcgtcgagctctacatgcccagagaggatgctcctcgcgctctgatcatgactgccgaggccagtgctaggaacaacgccaagaagcactaaacggttactcaagaaagagtgaaatttgatagacggggttttggaaaaggttcctggagaacataataatgatttaagtggtttatggtttatactatagagtggcggacgatggtttatgttttatgt

SEQ ID NO: 3713 - DNA, 269 bp, Cicer arietinum
ttacatggtggcggcggttaaggcaccgcatccaacgccgaatagcaaggcgagggcgacgctgaggatatccttggtgcgatcgcgaagggaggagaaatcgtaagcgtcggtggaaaaccctaaggggccgcgtgggtgcgacgcgccttgagactgggtttctaattgtaagttgtgttgaatcgggcgatcaataaagatttcgtagggtttgtcattgatgtagagaggggagatggatcggatctcggtgatggtggcgaagg

SEQ ID NO: 3714 - DNA, 293 bp, Cicer arietinum
actaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgg

SEQ ID NO: 3715 - DNA, 394 bp, Cicer arietinum; identical to SEQ ID NO: 3701

SEQ ID NO: 3716 - DNA, 438 bp, Cicer arietinum
acactagatggacaaggtgaactgtggtggcaaaagtttcaccatgggcagcttagttataccagaccttacctaattgaaatcatgtattcagataatattcagatatccaatctcactttggttaattctccctcctggaatgtccatcctgtttacagcagcaacgttattgttcaaggaatcacaattcttgcgcccgtgaactcgccaaatacagatggaatcaaccctgactcttgcacgaacacacgaattgaggactgttatatagtgtcaggggacgattgtgtggctgtgaagagtggttgggatgagtatggtatagcttatggaatgccaacgaagcaactggtaatcagaaggctcacttgtatttctccaacgagtgccgtgattgctttagggagtgaaatgtctggtggaatcgaagatgtg

SEQ ID NO: 3717 - DNA, 293 bp, Cicer arietinum; identical to SEQ ID NO: 3706

SEQ ID NO: 3718 - DNA, 235 bp, Cicer arietinum; identical to SEQ ID NO: 3571

SEQ ID NO: 3719 - DNA, 391 bp, Cicer arietinum
gggtaaggtcttcctttctgccgtgtcgtttgctgttattttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttcatacttccagtattgagctctgtaattacgattatgactatgacaatatctcttattgtgtgacgtgttttattactgatgttagt

SEQ ID NO: 3720 - DNA, 265 bp, Cicer arietinum; identical to SEQ ID NO: 1172

SEQ ID NO: 3721 - DNA, 311 bp, Cicer arietinum
acggtcctaggttgcagctactggcgatcttaggggatcatggacttcctgcctcagggtatggaaagctacttgatttatccgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgcagggcgagctatgagtagagaggtgcctcttgggggtaatgagt

SEQ ID NO: 3722 - DNA, 343 bp, Cicer arietinum
acaccggatatgccaacaaggaagtcgtttgccagaggagagacacggaacggaggtagggaatgccgaagtgttacatggaaatagactgacggttgtcgtttggccactctttagttcaatgagttggcaatcatcggttcaaatgagcagacgtcacaatcatatgataaaatcaaattacacaactcaacattccggaagggagttggccgacgcaaacgatgagaagcttgcggctgactcactataacggagtggatgctgatgatgactggatgaaccgatcatgaaacttactgaggcattacttggacttggaatgtgtgaagacataccctgg

SEQ ID NO: 3723 - DNA, 160 bp, Cicer arietinum
acggacaaggggaatccgactgtttaattaaaacaaagcattgcgatggtccctgcggatgttgactcaatgtgatttctgcccagtgctctgaatgtcaaagtgaagaaattcaaccaagcgcgggtaaacggcgggagtaactatgactctcttaagg

SEQ ID NO: 3724 - DNA, 431 bp, Cicer arietinum
agagtgttgaaattgttgaaggaaatggtggccctgggaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggtt

SEQ ID NO: 3725 - DNA, 192 bp, Cicer arietinum
ggaattcgattagcgtggtcgcggccgaagtacggacaaggggaatccgactgtttaattaaaacaaagcattgcggatggtccctgcgagatgttgacgcaatgtgatttctgcccagggctctgaatgtcaaagtgaagaaattcaaccaagcgcgggtaaacggcgggagtaactatgactctcttaag

SEQ ID NO: 3726 - DNA, 293 bp, Cicer arietinum; identical to SEQ ID NO: 796

SEQ ID NO: 3727 - DNA, 438 bp, Cicer arietinum
gccatgggaggaggtaacggccaaaaggcaaagatggctcgcgagaggaacctcgagaagcagaagaatgctggcaaaggtagccagcttgaaactaataagaaagccatgtcgatccagtgcaaggtgtgcatgcaaacatttatctgcaccacatcagaggtgaagtgcagggagcatgctgaagctaaacaccctaaatctgacgtccttgtttgttttcctcatcttaataagtaaacatgagggaaaggcatgatcaaaccttatatcatattatatatggatcctcggtttctagtgtcaaatgcgtctgtgtttgtcttgggggctagggataaatgaaagggaataattagtgtttttcccttgcagaagtgtgaaaaactgctaattttctctcgtcaaagtgtaactgtttaatggtcattagtgttg

SEQ ID NO: 3728 - DNA, 438 bp, Cicer arietinum
acaggaatcaaagagattacaacaggcggcagacgagaattccaagttacgggagttcttgatggaccgagggcagattgttgatacgttgcaaggagaaatttctgttatctgtgaggatattaggcttctaaaagagaaatttgatgcaaatcttcctttgagtaaatcattcacatcaagtcagacaagttgcatcttagcttcttcaggttcatcccacaaaagcttggcatctaatgtgggttctgagcatagtgattcttccgaaatactcaagatcacccaggcagcctcagttgaaagcctttctgacaaagttgatcaagaggagaggtccaaagctgaacacaatgctcttcttgatgatgggtgggatatttttgagaaagatgcagaactggattctggactttgctagctttttgttctgtgcta

SEQ ID NO: 3729 - DNA, 300 bp, Cicer arietinum
acaaattcaccaacaagacatggctcgttggctactcgtggctcaacgttagcatctccaacgacggcgatgatgagattgatgttttcgctcaactgggcaaacaggatgcttcaggaactcagttagtcaacatgaacgttcctttaaaggaccttattcctcctgtcgacaggcacacagaagctgcagacacatgcttcctgaaatacctgggtcctacaggttccctacgaggtagtcatgctgccacaaaggtgacacctaagcctgggaggttcactggtgactggcctgagt

SEQ ID NO: 3730 - DNA, 434 bp, Cicer arietinum
tcaccttcaccgttaaaacttcgtgtcggggggtagataacgactcctctgacgcactctggacatcatttatcgatgacattgatgttcttttttcgtttgcgatgtagaggtatgctgtactcgtcactgagtaccttctgatctgaatcattcctctctcaagggaatttacttcctgctgacctagtggagcttgaacactcatgatcaacccatccttggcagaatttgcattgcctcctatgtgggctctatctacgacagtcatgtctgccacagtggagtattcctttagacgatgtatcctcgactgcttgactgatcctgagttccatgctctgcgcacgatcatggcaccagctgagagaggtagaagggtcgttgtcagccaagaagagaatgacgttggctttgttttggggactctctga

SEQ ID NO: 3731 - DNA, 439 bp, Cicer arietinum
acacccaaggatttagtggtgctgatattactgaaatttgccagcgtgcatgcaagtatgccataagagagaacattgagaaggacattgaaagagagagaaggagaagtgagaaccctgaagccatggaagaggatgttgaagatgaggtagctgaaatcaaggcagctcattttgaggaatcaatgaagtatgcacgaaggagtgttagtgatgctgacattcgcaaataccaggcatttgctcaaacattgcagcagtccagagggtttggatctgagtttaggtttgcagattccagctctggtggcactactgctgctgcagggacatctgacccatttacatctgctggtggagctgatgatgatgatctttacagttaggtcaaacttgtatgctcgatgttcatttaaagaatatgccagtgctgtcttat

SEQ ID NO: 3732 - DNA, 350 bp, Cicer arietinum
cgaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 3733 - DNA, 474 bp, Cicer arietinum
acataccaagagattgcaggaacgaagaatactattggccagtatgagagccacgctgcttttactcttcctgggctctacagggttgttcatggcattgatgtctttgatcccaagttcaatattgtctctcctggagcagatatgacaatatatttcccctactctgaaaaggagaaaagactcacgtccctgcatggttcaattgaaaagctattatatgataccgagcagactgacgagtgcattggttcactgaaggaccggtcaaagcctataattttctccatggcaaggctagacagagttaaaaacataactggtttggtagaaagctatgctaagaacagcaaattgagggaactggtcaaccttgtcgttgtagctggttatattgatgtgaagaagtccagtgacagagaagaaattgcagagattgagaagatgcacgatctcatgaaggagtataatttg

SEQ ID NO: 3734 - DNA, 288 bp, Cicer arietinum
acaagaacatttgcttcactgtttgggatgtcgggggtcaagacaagattcgtcccttgtggaggcactacttccagaacacccagggtcttatatttgttgtagacagcaatgacagggatcgagttgttgaagccagagatgagttacataggatgttgaatgaggatgaacttagagatgcagtattgcttgtgtttgccaacaaacaagatcttcccaatgcaatgaatgctgctgagattactgacaagctgggtctccactctctcagacagcgccactggt

SEQ ID NO: 3735 - DNA, 262 bp, Cicer arietinum
acagagcttacctggagaccgtggaatgaggcgactacctcgtccacagagcagcgttctggccgctttggggttttctcctgcaagggttttcacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggag

SEQ ID NO: 3736 - DNA, 234 bp, Cicer arietinum
acactagatggacaaggtgaactgtggtggcaaaagtttcaccatgggcagcttagtttcccacaccttacctaatggaaatcatgtattcagataatattcagatatccaatctcactttggttaattctccctcctggaatgtccatcctgtttacagcagcaacgttattgttcaaggaatcacaattcttgcgcccgtgaactcgccaaatacagatggaatcaaccctg

SEQ ID NO: 3737 - DNA, 434 bp, Cicer arietinum
accctcgccgactacaatatccagaaggaatctacccttcatctcgtcctccgtcttcgtggaggtatgcagatctttgtgaagaccctcaccggtaagaccatcactctcgaagttgaaagctctgacaccatcgacaacgtgaaggctaagatccaagacaaggaaggaatcccaccagaccagcagagactcatcttcgccggaaagcagcttgaagatggccgcaccttagctgactacaacatccagaaggagtcaacccttcaccttgtgttgcgtcttcgtggtggtatgcaaatcttcgtgaagaccctcactggtaaaactattacccttgaggtggagagttctgacacaatcgacaacgttaaggccaagatccaggataaggaaggtattcccccagatcagcagaggttgatcttcgccgg

SEQ ID NO: 3738 - DNA, 427 bp, Cicer arietinum
cttatggaggtgaagataacaagagagtgcttggagggttgaaagtgaagaatgtggtgacagaagaggtttctgatttgaaggttaatggattgttctttgcaattggtcatgagcctgcaactaagtttttggatggtcaacttgaacttgactctgatggatatgttgtgacgaagcctgggactacgaagactagtgttgagggagtttttgctgctggtgatgttcaggataagaagtataggcaagctattactgctgctggcactgggtgtatggcggctttggatgcagaacacttcctgcaagggattggtttacaacaggataagagtgattgactagatactagagggtgttcagagcttagaagatgcttaattagaagcaatgtttgatttttaaagaagattggaaacagatc

SEQ ID NO: 3739 - DNA, 221 bp, Cicer arietinum
cttatggaggtgaagataacaagagagtgcttggagggttgaaagtgaagaatgtggtgacagaagaggtttctgatttgaaggttaatggattgttctttgcaattggtcatgagcctgcaactaagtttttggatggtcaacttgaacttgactctgatggatatgttgtgacgaagcctgggactacgaagactagtgttgagggagtttttgctgct

SEQ ID NO: 3740 - DNA, 436 bp, Cicer arietinum
acggacaaggggaatccgactgtttaattaaaataaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccc

SEQ ID NO: 3741 - DNA, 316 bp, Cicer arietinum
gtcgcatgctcttcgccgccatggaggacgcgggaattcgatttcgagcggccgcccggacaggtacccttcaccttgtgttgcgtcttcgtggtggtatgcagatttttgtgaagaccttgactgggaagacaattacccttgaggtggagagctctgataccattgataatgtgaaggcaaaaattcaggataaagaaggtatcccaccggaccagcagaggttgatctttgcagggaagcatttggaggatggaaggacccttgttgattacaatattcagaaggagtccacccttcaccttgtgctccgtct

SEQ ID NO: 3742 - DNA, 451 bp, Cicer arietinum
accgagtagacaacttggataagttggttgccaaagctataactgatagttttggcaaaggaatatggaaaaaggctataatagcactcacccatgcccagttctctccaccagatggattgccttatgaagaatttttctcaaaaagatctgaggctctcttgcaaattgtcagatcaggtgcctccttgaagaaggatgctgctcaggcttctgcgattcctgttgttttgatcgagaatagtgggagatgcaacaaaaatgaaagtgatgaaaaggttcttccaaatgggattgcttggattcctcatctggtcaaaacaatcacagaagttgcactgaacaaaagtgaatctattcatgttgacaagaatttgattgaaggaccaaacccaaatcagagaggaaagttatggattcctctcatatttgctctacaatacttgttcat

SEQ ID NO: 3743 - DNA, 420 bp, Cicer arietinum
acagcagaggatgcaaggctttccaatggactcataggcaatggagtcgaccttatcatctctttgaagatagcaccgtagtccagggatgattctgcttcaatacaaatgcgagccatgattttcacagcaagttcaggataagctccggcagcactttcaccactaagcatgacacaatctgttccatcaagaactgcattatttacatcagttgcttcagctcgggttggccgcggagacttgatcatggattcaagcatctgggtagcagtcaccacaggcttgccaacaagattacacttatatatcatcattttctgtgcaagaaaaatcttctcaactgggatctccattccaagatccccacgtgccaccatgaatgcatcagtctcacgcaggatctcatcaaagttcatg

SEQ ID NO: 3744 - DNA, 457 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccaaaattccttctctgaaaactgctgttagggagccgatggcgtcccc

SEQ ID NO: 3745 - DNA, 339 bp, Cicer arietinum
acccattttggaggtggcaaatcaaccggttttggtttgatttacgatacagttgagaatgctaagaagtatgagcccaaatacagacttatcaggaatggtcttgacaccaaaatagagaagtcaaggaagcaaatgaaggagagaaagaatagggccaagaagatccgtggtgtaaagaagaccaaggcctctgatgctgccaaggctggaaaaaagaaatgagtttttagttgtcgtgtttgtgctttaaggttgttttgctttccaagtttttttgatagctatgttatctcatgcatggtctacaaaatgagatattttggtacctgcccgggc

SEQ ID NO: 3746 - DNA, 457 bp, Cicer arietinum
aaaaaaaagaaggggttgggattgggaaggtgagggattcacgctgcgtgtgttcgtgtttggatctctcatccctaatcctcccatagcctcaccctaagatctgaaactccgaagttccatccatggcttccaagcgtattctcaaggagctgaaggatttgcagaaagacccacctacttcttgcagcgctggtccggttgctgaagacatgttccattggcaagcaacaattatgggtccggctgatagtccatatgctggaggtgtatttctggtcactattcattttcctccagattatcctttcaagcctcctaaggttgcattcaggactaaggtctttcaccccaacatcaatagcaatggtagcatttgtcttgatatcctgaaggaacagtggagccctgcgcttaccatctctaaggtactgctttctatttgctcactgctgac

SEQ ID NO: 3747 - DNA, 436 bp, Cicer arietinum
gtctgacttcacagaacaatataagaaggatcatcctaataacaaatccgtcgccgctgtcggtaaagcttgcggagaagaatggaaatcgttgtctgatgctgataaggctccctatgttgctagggcattgaagaagaaagcagagtatgagaaaaatgttcaggcttacaataggaaacaggcgggaatagaggaggaaggtggttctgacaagtcgaaatctgaagttcatgatgaggatgaagaggaggaggacgatgatgaagatgatgatgagtgaagttgctgttacacgtgatgaatcttaggagaaaattggggaaaaaatatttgttttgcttaggttggggttataatatgttgtgatgtaaccaacccacttttattatctgatgatagtttatgaatttttattgtcttgttgtctaggttt

SEQ ID NO: 3748 - DNA, 425 bp, Cicer arietinum
actatattggaacgatcactgtgcttctgagctgccatcagtttgacctgatgcgaccttcagagagcatggccgatttggaggggaagaaacgcaatcaacgtttactcggcccggtaattactcctctacttcgactcgcatagccccttggctggtcccagaccttcattgggtttcctgcataccctttcaactattggacctttttttcttggtttcatttcttggagttatacgtatatgccctcaagaagatcttgagatgaggagttgccaaattcttttcatcagcatcaggctctggtcaggggtgggcggtcctggaggtttggcgtgtttatttgcatttacgacgatctgttatgtttgggaggcctgtccaacccaaccgcagcaatctgtttgcggtagcggagggcatg

SEQ ID NO: 3749 - DNA, 427 bp, Cicer arietinum
acccaatacttggtctcaacctgttgagactacttgtgcagaatagaattgctgaattccatactgagttggaattactttcatccactgctctagagaatccttgtattaagcatgctgtggagttggagcaatcttttatggaaggggcttacaatcgtgttttgactgctcgacagactgtgccacatgatacatatgtttatttcatggatcttttggcaaagaccatcagagatgagatagcaggatgcagtgagaaggcatacgactatctttcaattaatgatgctaagcaaatgctgctattctcttcagatcaggaactcttggaatatattaaagaggagcaccctgagtgggaagttaagaacaattctgtcttttttcaaaaggcaaaagattctgcaccttgcaaagaaatacc

SEQ ID NO: 3750 - DNA, 437 bp, Cicer arietinum
agagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggctaatcctaattacaattaagtgcttttattatacctggtgtgttgttttgtgacacattttattatatttagtgtgcttaatttggttgccaaa

SEQ ID NO: 3751 - DNA, 467 bp, Cicer arietinum
acacaaaatttgaatcagcaacaaaatgcagcagggaggaggatccgacacggaagtcacatgggaggaccagcagaacatcaacaaattcggaaggttgaataatcgcttacacgagctaaacgatgagatcaaattcgccaaggaaacaaatgataatttagaggatgcaagcaatgagctgattctcacagatgaagaggtcgttcggtttcaaataggggaggtttttgctcatgtgcctaaggatgaagttgagaacaggatagaacagatgcaagaggtgacaagccagaaattggcaaagcttgaagaagagaaagcaaccgtggtcgctcagatgtctgaactgaagaaaattttgtatgggaaattcaaagactctatcaatcttgaggaggattagtaacttgttgatagatttctaggttttttgtggttaatgagtatatgacctcatagaccct

SEQ ID NO: 3752 - DNA, 440 bp, Cicer arietinum
  misc_feature (45)..(45): n is a, c, g, or t
  misc_feature (59)..(59): n is a, c, g, or t
acggacaaggggaatccgactgtttaattaaaacaaagcattgcngatggtccctgcgngatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctgggaacagcgaaagtgaaataccactacttttaacgttattttacttattccgtgaatcggaggcggggcgctgcccctc

SEQ ID NO: 3753 - DNA, 217 bp, Cicer arietinum
cggccgaggtaggttatccaactggtattggtgtgaagaattctcttattatgctcggtgttgttaacttcctgggaattgtattcacctttttagtgcctgaagcaaagggaaaatcattggaagagatgagtggggagaatgaagaagatggtgatgaggctatagaaatggcagggtctgctaggacagtacctcggccgcgaccacgctaatc

SEQ ID NO: 3754 - DNA, 141 bp, Cicer arietinum
actggaatatttaccactaccttattggatactctaccataatcattagtattattaatgtttttaaagggtttgaggctatgggagattatgttggagatcgttacaaggactggaaacatgtgtatattggaattattg

SEQ ID NO: 3755 - DNA, 200 bp, Cicer arietinum
actttggcgagcagttgtcaggatttgcctttactgctaatgggtgggtgcaatcctatggatctcgttgcgtcaagcccccaatcatctacggtgatgtgagccgcccaaagccaatgactgtcttctggtcatctcttgctcagagctttaccaagcgtccaatgaagggaatgcttactggccctgtcaccattctc

SEQ ID NO: 3756 - DNA, 327 bp, Cicer arietinum
acccattttgtagctggcaaatcaaccggttttggtttgatttacgatacagttgagaatgctaagaagtatgagcccaaatacagacttatcaggaatggtcttgacaccaaaatagagaagtcaaggaagcaaatgaaggagagaaagaatagggccaagaagatccgtggtgtaaagaagaccaaggcctctgatgctgccaaggctggaaaaaagaaatgagtttttagttgtcgtgtttgtgctttaaggttgttttgctttccaagtttttttgatagctatgttatctcatgcatggtctacaaaatgagatattttggt

SEQ ID NO: 3757 - DNA, 334 bp, Cicer arietinum
acccattttggaggtggcaaatcaaccggttttggtttgatttacgatacagttgagaatgctaagaagtatgagcccaaatacagacttatcaggaatggtcttgacaccaaaatagagaagtcaaggaagcaaatgaaggagagaaagaatagggccaagaagatccgtggtgtaaagaagaccaaggcctctgatgctgccaaggctggaaaaaagaaatgagtttttagttgtcgtgtttgtgctttaaggttgttttgctttccaagtttttttgatagctatgttatctcatgcatggtctacaaaatgagatattttggtacctgcc

SEQ ID NO: 3758 - DNA, 357 bp, Cicer arietinum
accaatatgtcaatcgacagcgttggtagcttgcaaacaagcaatggtggaggatcggttgcaatgtctattgataacagcagtgttgggtccaatgattcccatacccgcatgttggaccaccaagggttgaagaggcgtgccaatgataactactctgttgcacacagtgtcaatcgtcgtggaagagtcacacatgcattgagtgacgatgctttagctcaagctctgatggacaataattctcctactgaggggcttgaaaattttgatgagtggacaattgatttgaggaagctaaatatgggcgaggcttttgctcaaggagcttttgggaaactctacagaggtacctgc

SEQ ID NO: 3759 - DNA, 310 bp, Cicer arietinum
acagagaaaagattccaagtgaagtggccaaagagattgaagatgcagtttcagatttgagaaaggcgatggcaggggacaatactgatgaaattaagtcaaagcttgatgctgcaaacaaagctgtgtccaagattggacaacatatgtcaggtggttctagtggcggttcatcagatggaggttctcagggtggtgagcaggctcccgaagccgagtatgaggaggtcaagaagtgaggcaatttaggtgtggctatgtagcattttttattattatgaaacatcacataattgctggaatcatacaa

SEQ ID NO: 3760 - DNA, 293 bp, Cicer arietinum
actaggttgaattactattgcgacactgtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcagcgtcgctatgaacgcttggctgccacaagccagttatccctgtggtaacttttctgacacctctagcttcaaattccgaaggactaaaggatcgataggccacgctttcacggttcgtattcgt

SEQ ID NO: 3761 - DNA, 423 bp, Cicer arietinum
gttcagtcgccgtaacgcgagcgaagacgctgagatccaaatcggcttttcagaatgaagttcaacgttgcaaatccaaccactggatgccagaagaagctggaaatcgatgatgatctgaaactccgtgcattttgggacaagaggatctcgcaagaggttaatggcgatgctttgggcgaggaattcaaaggttatgtcttccaaatcaccggaggatgtgacaaacaaggttttccaatgaagcagggagtgttaactcctggtcgtgttcgcctcttgctccaccgaggaactccttgtttccgaggatatggaaggcgtaatggagagcgaaggaggaagtctgttcgtggttgcattgttagtccagacctctctgtcttgaacttggttattgtgaagaagggtgaaaatgatttg

SEQ ID NO: 3762 - DNA, 382 bp, Cicer arietinum
gaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaattatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatgtcatactctcttct

SEQ ID NO: 3763 - DNA, 206 bp, Cicer arietinum
acaagggacccactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttgggcctactgggctgacaactgaagttaagtct

SEQ ID NO: 3764 - DNA, 277 bp, Cicer arietinum
gcaaaagattctacccgccgctcaataggaattgcgtttcaaggtgtcccgcaaggctcatccgccttacgaggtcccccaacgacacgtgcctctggggggccaaggccccctactgctggtcggcaagcgaacgacgggcacacgcatcgcttctagcccggattctgacttagaggcgttcagtcataatccaacgcacggtagcttcgcgccactggcttttcaaccaagcgcgatgaccaattgtgcgaatcaacggttcctctcgtacctg

SEQ ID NO: 3765 - DNA, 432 bp, Cicer arietinum
gcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatcc

SEQ ID NO: 3766 - DNA, 454 bp, Cicer arietinum
gatttcgagcgggccgcccgggcaggtacatctgttggagaagagctttgaggaagagaacaaattggagccagagagaaagacccaattggccaagaagctagggttgcaacctaggcaggtggcagtttggtttcagaaccgtagggctaggtggaagaccaaacaacttgaaagagactatgatgttcttaagtcttcctatgattccctactttcaacatatgattccattgttaaggagaatgagaaactcaaatctgaggtggtatccttaaatgagaagcttcaagttcaagctaaagagatgctaggagaacctttgttagacaaggaagctaatccactaccgatcgaaatagcacaaattttcagcatcaaggtggatgaccacatgagtgctggaagtgttggaagtgcagtggtggacgagggtagtccccatgtcgttgtt

SEQ ID NO: 3767 - DNA, 430 bp, Cicer arietinum
tgtgaatatcttaacgaagctttaggagagaggtgtatctcgagtgaacttcagttagctggtcctgaatacggacatttgcagggtttttcttctcttccaccagctttttctgaagaattattcggccctgagttgttagacaaagtgtctttgcatcctctaagtcaagacatgacaacactgaagaaaccaacagttacagttgataattcgttgagtccggctcacaccttgcttcagatacagtgtgttgatcagaaaggcttgtgttatgacattatgaggatttctaaggattctgatattaaggttgcttatggtagattcacttcaagtgtgaaaggctttcaaaacattgacttatttgttcagcaaaaagaagacgggaaaaagatcatagatcccgaacgtcagaaaactctgtgtt

SEQ ID NO: 3768 - DNA, 281 bp, Cicer arietinum
actcgtccgatggagagatgcttattgttgcgcagcatggagttttggatattcagactgagctgggacgattgctcgtgagaccgaatgagattgccattattcctaggggagtgagatacagggttacgctgcctgagggaccagtgagagggtatatccttgagttatatcagggacactttcaactgccggagttgggacctattggatcaaattgtctggcgaatccacgggactttcagatccccgttgcggactttgatgaggatacgaagagt

SEQ ID NO: 3769 - DNA, 422 bp, Cicer arietinum
actttggcgattagctgtcaggatttgcctttactgctaatgggtgggggcaatcctatggatctcgttgcgtcaagcccccaatcatctacggtgatgtgagccgcccaaagccaatgactgtcttctggtcatctcttgctcagagctttaccaagcgtccaatgaagggaatgcttactggccctgtcaccattctcaactggtccttcgttagatttgaccagcctagatccgaaacctgctatcaaattgctttggctatcaaggatgaagtagaagaccttgagaagggtggtattggtgttatccaaattgatgaggctgccttgagagaggggctaccactaaggaagtcagagcatgctcactacttggactgggctgttcactccttcagaatcaccaatgttggtgttcag

SEQ ID NO: 3770 - DNA, 462 bp, Cicer arietinum
acaagggtccaacccttcttgaggcccttgaccaaatcaatgagcctaagaggccatcagacaagcccctccgattaccacttcaagatgtctacaagattggaggaattggaactgtgcctgtgggacgtgttgagactggtgtcttgaaaccaggatttgtcgtgacttttgcaccaactggattggcaactgaagtcaagtctgttgagatgcatcacgaagctctgactgaggcccttcccggtgacaatgttggatttaatgttaagaatgttgctgtcaaggatctcaagcgtggttatgttgcatcaaactccaaggatgaccccgccaaggaggctgctaactttacatcccaagttatcatcatgaatcaccctgggcagattggaaacggttatgcccctgttcttgactgccacacctcccacattgctgtcaagtttgctgagcttatta

SEQ ID NO: 3771 - DNA, 344 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttggcggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggagga

SEQ ID NO: 3772 - DNA, 459 bp, Cicer arietinum
gggaagaccatcaccctcgaagtcgagagcagtgacacaatcgacaatgtcaaagccaagattcaagacaaggaaggtattcccccggatcagcagcgtttgattttcgccggtaagcagcttgaagatggacgcaccttggccgattacaacatccagaaggagtcaacacttcatcttgttctcaggcttcgtggtggtatcatcgaaccttctttgatggctttggctcgcaaatacaatcaagacaaaaccatatgccgcaaatgctatgctcgtctacaccctagggctgtaaactgccgcaaaaagaagtgtggacatagcaatcagttgaggccaaagaagaagatcaagtaaactctggttttgatattgtttttctcttattggtgtttgttttgtgagacctttatttataaatttcgttgttactcccgactcaactcaatcttctgt

SEQ ID NO: 3773 - DNA, 356 bp, Cicer arietinum; identical to SEQ ID NO: 1437

SEQ ID NO: 3774 - DNA, 369 bp, Cicer arietinum
actgactaccagctcattgatatttctgaggatggatttgtgagtctgcttactgaaaatgggaacactaaggatgacctcaggctccccacggatgacagtctactcactcagattaaggagggatttgctgagggaaaagaccttgttgtgtctgttatgtctgctatgggcgaggaacagatttgtgcccttaaggatattggtcctaagaactagcctctcttgcctgccagtttgttgtttccatttaagcaaagattatttttccaagtttttatattgttttgttctagacctggcttatggatttttgttgttttatccgttttttctctgttgtcctgtgactttattataaacgaggat

SEQ ID NO: 3775 - DNA, 459 bp, Cicer arietinum
accccagcaggttctcgcagcacttagtgttgaaattctcaaagctgctggtgaacgcagtggtgggtctcttgttggtgtagcatttctcctcgaatctgacttcttaggtgatcctgcagctacttatgctgtggcagacattattgctaaattggaggatgaggctgttgctcctgagctaaaggcttttcttaaggagcattggtcagaaggagcttacatagagggactaaggttagggcaagagcattacacgaaccttgtgagaatcattaaagggggcgactctcctatttgcttgagagatcttcctgctccactgacagtggcaattgcttatctcccactttatagagagtgtgtcaaggcaggaggccgtttgttttcgcaacgacttaagggacaaatggttgaagccgcaagaaggcttggggagagggtctttgatgaagtgac

SEQ ID NO: 3776 - DNA, 244 bp, Cicer arietinum
acaccgtttaataacaaatacaaacctatgctctattctatttgcatgatatggtgccaagtcaaggaaagggagaaagaaacctcaattaccaaccaacaatttgctcaaaaaaaaaaaaaaaaaaaaaaaaaaaaagcttgtacaagcttttttttttttttttttttttttttttttaccaaaacaggggaatatatttatttggtttgtcagtcaatttgataaaccaaactttgaaaat

SEQ ID NO: 3777 - DNA, 426 bp, Cicer arietinum
acaactgggaccccaaagggtgccgttttgacccatcaaaactttattgcaaatgttgctggggccactatgaatgaatctttcaacccttctgatgtttatatatcctatcttcctttggcacacatttatgagcgagcaaatcaagtcatgacagtatattttggcattgcagtaggattctatcagggggataatttgaaattaattgatgacctagcagttctaagacctactatcttcagtagtgttcctcgtctatataatagaatatatgctggtattattaatgctgtcaaaacatctggtggtctgaaggagaggctattcaatgctgcctacaatgctaaaaggcaggcattattgcatggcaagaacccatctccaatgtgggacagattagttttcaacaagataaaggaaaaa

SEQ ID NO: 3778 - DNA, 280 bp, Cicer arietinum; identical to SEQ ID NO: 3676

SEQ ID NO: 3779 - DNA, 438 bp, Cicer arietinum
ttccaaccgtaatactgttttctttgatataaacttgcgagggttggatggcattcaaggccctgtttatgttggtactggatgtgtcttcaatagaacggctttatatggttatgagcctcctattaaacccaagcataaaaagcctggatttgtttcttcgctttgcggtggagatagaaagaagagctcgaaatctagcaataagagctctaaaaagaagaaatctagcaagaatgttgatccaactgtgcccatctttagcctagaggatatagaagaaggggtggaaggtgctggatttgacgatgagaaaacactactcatgtcacaaatgagccttgagaaaaggtttggtcagtctgctgtttttgttgcctctacacttatggaaaatggcggtgttcctcaatctgcaactccagaaactctcctcaa

SEQ ID NO: 3780 - DNA, 442 bp, Cicer arietinum
aaaacgggaattcgattagcgtggtcgcggccgaggtacaaagaggtgtcccgagagaagacagctgatcctgatattcaactgggctgtgatgattctaacatttttaaatggacagctcttatcaagggaccttcagaaactccttatgaagggggtgtcttccaacttgcattttctgttccagagcagtatcctctgcaaccacctcaagtccgttttttgactaaaatatttcacccgaatgttcatttttagacaggagagatttgcctagatatcttgaaaaatgcttggagccctgcttggactctgcagtctgtctgtagggctataattgctttgatggctcatccagaacctgacagcccactgaattgtgattcaggtaatcttctgcgttcaggtgatgttagaggttaccagtctatggcaagaatgt

SEQ ID NO: 3781 - DNA, 476 bp, Cicer arietinum
cacagcaataaccaattctccggcggcaatcatccctgtccaagcggctaggctaagatgtctttggtggcaaacgaagaatttcagcacattttgcgtgtgctgaacactaacgttgatggcaaacaaaagataatgttcgcactcacctccattaagggtattggaaggcgatttgccaacatttgctgtaagaaggctgatgttgacatgaacaagagggccggtgaattgagtgctgcagagttggataatttgatgacagtggttgcaaacccacgtcaattcaagatcccagattggtttttgaataggaagaaggattataaggatggaaagctctctcaagttgtttccaattcacttgacatgaagttgagggatgatttggagagactcaagaaaattagaaaccaccgtggtttgaggcactactggggccttcgtgttcgtggtcagcataccaagactactgg

SEQ ID NO: 3782 - DNA, 455 bp, Cicer arietinum
acaattagattcaatcatttctattaactgtagccatgccaaaccctagagttttcttcgatatgaccgtcggtggcacagccgctggacgtatcgtcttcgagctcttcgccgatgtcactccaagaaccgccgagaatttccgcgctctctgcaccggtgagaaaggtgtcggacgtagcggcaagccacttcacttcaagggatcctccttccatcgtgtgatccccaacttcatgtgtcagggaggtgacttcaccgccgggaacggcaccggaggagaatcgatctacggatccaaattcgccgatgagaacttcatcaagaagcataccggtcctggtatcttatctatggctaacgctggtccaggaaccaacggatctcagtttttcgtctgcactgcaaagaccgaatggctcgacggtaaacacgttgtgtttggtcaggttgtt

SEQ ID NO: 3783 - DNA, 127 bp, Cicer arietinum
acctcgaagagagagtccatggggaataactggagagaatcatcctgaacccaaagctcatcgatgcaatgaccggattgaagatgttatccaggcttgctttgagggaaacccgttcaagactgtt

SEQ ID NO: 3784 - DNA, 411 bp, Cicer arietinum
ttctttcttggcacgcactgttagtgccgtgttaggagcgggagtttctggaggccacgcgaccacacaaaactgcggggatgctatcggctccctaacagcagttttcagagaaggaattttggagagttcgccttctctgacaacacctttgtcggatctaatggcggcacctcagaaccagaacgtcttaaatatcggaggattatgccccgggcattcgtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcagatgtagtgatgcgcgagagaat

SEQ ID NO: 3785 - DNA, 431 bp, Cicer arietinum
tcaatcttctaaaaccttactagctacttagcaaaatggcactttcttcttcttcttctaaatctttttctttatcatcatctaattcagtagtcaagtttttgttagctttgatgatgtttttacttataggaaattgttgtgctgaactctctgaaaacttgtatgttaaaaaatgtcctaatgttttcaatgctataaactctgttgttcactctgccgtggctaaagaacctcgtatgggagcatctcttcttcgtcttttctttcacgactgctttgttaatggttgtgatggatcggtgctacttgatgacgcatcctccattaaaggagagaaaaatgcaggtccaaacaaagattctttgagaggttttgaagtgattgatgccataaagtctaaggtggaggcattatgccccggtgtggtg

SEQ ID NO: 3786 - DNA, 293 bp, Cicer arietinum
  misc_feature (6)..(7): n is a, c, g, or t
gactgnnaatttttccccatgcagtgcaacattttcaatagctataacaggggaaaggaaccactactatgttctgtttcactatccaggaactaggatccaatgtagcatctactcggaatcctgcatattctgagtaggagcctctgagcccttagtgagtgatagcttggttggaggtccatcaaacagacgggaacattctgtgtatgcagattctattccaactccagcaccaaaagcaatggatgcccagcgaggctgaggactcctgaaaaagaggagaccgccaa

SEQ ID NO: 3787 - DNA, 298 bp, Cicer arietinum
actcgaaactgtatcgatccagaggaagtaacagtaacagtaatttaattagttagacaccctttagtgtccagttgactttgtggggtccatgagcatgaggcttaatacgggcgttgaagttgttattatattcatatgaattgacatagcgaacatcacctccatttccatatccatgtcgctcatatctcatttcatccttctttgaaccaccaacatgctcctccttgtatgcttcatactcatactcttcaagattgaatggcctcacaccatttggagaatgattatgagt

SEQ ID NO: 3788 - DNA, 366 bp, Cicer arietinum
cagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatgtcatactctcttcttcttttcattttgttgtggaagtgcgagattgtaagtcaagtgtgt

SEQ ID NO: 3789 - DNA, 281 bp, Cicer arietinum; identical to SEQ ID NO: 3768

SEQ ID NO: 3790 - DNA, 168 bp, Cicer arietinum
gtaggtttgaatagaactggtaagagttgtaggtacgttgggttaattatcttcatcctggtcttaaacgaggtaaaatgtttcctcatgaagaacgccttgtgcttgaccttcaatccaaatggggaaataggtggtcaagaattgctagaaagttaccaggaagaa

SEQ ID NO: 3791 - DNA, 434 bp, Cicer arietinum
aagggaacaggaaggacttcaagggacgtattgaaaccagttgatgaccgaaaggtaggaaagcgaaaggctgcttataaaccggagaagagcagcgcaccaaagcctactaagaaggagaagaaggccaaaaaagatcccaacaaaccgaaaagacctccgagcgctttctttgtcttccttgaggagttcagaaagacttttaaggcagaaaatcctactgtgaaggccgtatcagctgttggaaaggctggaggagagaaatggaaatccttgactaaggccgaaaaagctccatatgaagccaaggctgcaaaaaggaaagttgagtatgaaaaacttctgaatgcttataacaacaaggcaagttcagcggatgatgaggaggaggaatctgacaaatccaaatccgaggttaataatgaagatgaagc

SEQ ID NO: 3792 - DNA, 245 bp, Cicer arietinum
acaataaaacttatcatacttttatttcattaagaacccaggcaaaccgcgaccacttatttttaggccacttttcttatttacttgaagaggagggggggaagggcaacttcaacaacaacattctttatttattctcttaattatgatattattattttaaaaggttataattaatcttgtgcagcttttccagcacgatgatcataaccatgaaccccaagattaattattttgaggtatta

SEQ ID NO: 3793 - DNA, 405 bp, Cicer arietinum
acaaagaggtgcaacgagagaagacagctgatcctgatattcaactggtctgtgatgattctaacatttttaaatggacagctcttatcaagggaccttcagaaactccttatgaagggggtgtcttccaacttgcattttctgttccagagcagtatcctctgcaaccacctcaagtccgttttttgactaaaatatttcacccgaatgttcattttaagacaggagagatttgcctagatatcttgaaaaatgcttggagccctgcttggactctgcagtctgtctgtagggctataattgctttgatggctcatccagaacctgacagcccactgaattgtgattcaggtaatcttctgcgttcaggtgatgttagaggttaccagtctatggcaagaatgt

SEQ ID NO: 3794 - DNA, 405 bp, Cicer arietinum; identical to SEQ ID NO: 3793

SEQ ID NO: 3795 - DNA, 293 bp, Cicer arietinum; identical to SEQ ID NO: 796

SEQ ID NO: 3796 - DNA, 262 bp, Cicer arietinum
actgtgggacatctgtcgaagagtgctgaggttatgaagcttgtcaataacctcatgaaggctcctgaaatggctgtggctatgcaagagtttagcaaagaaatgacaaaggcaggtgttattgaagagatagtaaacgatgctgttgactcggcattagattccgaggacatagaggatgagatagaagaagaagttgataaagtcttaaccgccatagcgggtgagacagccgcacaacttcctgaagctgtgaagaaac

SEQ ID NO: 3797 - DNA, 347 bp, Cicer arietinum
gacaagcatttccctctttcaaaaaaaaacatatgaaatggacataggtggagggggagaaattatgaagttggatggttattccatttactattactagaagtggatccttgcaatcactaagcaccgtcgtcttctacagtgttcacccgttcacattcatcaatccattcactgtatatgtctattgcctcagataaagctgtgattgtagtgttaaagctctcttgacatatcctgcaagaagcttcccctagggagttcttcatatcaatgcggcattcaacactggaaccatgattgcagaaaggacaactaaagacagtgtcaagcttatccatccgttt

SEQ ID NO: 3798 - DNA, 412 bp, Cicer arietinum
ttcccgccatggagaacgcgggaattcgatttcgagcggccgcccgggcaggtacactcactagctctgtcagtgcctctgatgttgatcaaatcaaccaagtagttggcgttgaatggcatggggagactattgtttatgcttacagatcaggtgaggtgatacggctaccaaaaggggtttcgattccagtgacactaaaggttctggagtttgaacttttccatttctgtccaatccaagaaatagcaccatttttatcatttgccgcaataggcctaatggatatgttcaacactggaggagctgtggaagaggttgaaatccataaagcctccgacaacaaacaagaactattcgacggcgaggttgtatctgaactgacaacttctctcagtcctaaccgaacgaa

SEQ ID NO: 3799 - DNA, 246 bp, Cicer arietinum
ctctgataaagtaagatatacaactttattttataattggaattacatatatgtgacctgatgaattaacacataacttagcactttttaatactagtgctatattttctttaattcacgtgaaattaagttataggactgcatgaccaatgatgtctatataatataaaatatttttttggctgagttattatatttatttgtttccttgatgtaacattttttgtttccttgatgtgtttagaa

SEQ ID NO: 3800 - DNA, 436 bp, Cicer arietinum; identical to SEQ ID NO: 3619

SEQ ID NO: 3801 - DNA, 419 bp, Cicer arietinum
acagtggaaacttcattgtgaatctgttgggcaaatggaaggaatctgaatatggaggtggtcactctattcctgttggtggcattgcatactatataactgcaccatccagcttagctgatatggcagccaatcctttccatgcactgttctatcttgtgtttatgttgtcagcctgtgccttgttctctaaaacttggattgaagtctctggttcatctgctagagatgttgccaaacagttgaaggaacaacaaatggtaatgcctggccatcgggagtcgaacttgcagaaagagctgaaccgatacattcccactgctgcagcatttggaggaatatgcattggtgccctgacagtattggcagatttcatgggggcaattggttcagggactggaatattacttgcagtaaca

SEQ ID NO: 3802 - DNA, 457 bp, Cicer arietinum
  misc_feature (414)..(414): n is a, c, g, or t
actcgaactattggtgtgatggtgatggttcatggtgatgacaagggattggtgctgcctcctaaagtagcatcagttcaagttattgtgattcctgtgccttacaaagatgctgatactcaaggaatctttgatgcctgttctgcaacagtgagtatgttgtgtgaagcaggaatccgtgctgagtcagattcaagagataactattctcctggatggaagtattctcagtgggaaatgaaaggtgttcctctaaggattgaaattgggccaaaggatttagcaaataagcaggttcgtgctgttcgacgtgatactggagcaaagatagacattgctaatgctggcttggtcgaggaaataaaaaagctgctcgatagtattcaacagaatctgtttgacgttgcaacacanaaacgagatgaatgtattcagatcatacatacatgggatgagt

SEQ ID NO: 3803 - DNA, 365 bp, Cicer arietinum
cttgttaataatatcttatttctcacactagcaatattcttaattcatcatcatgggtgttttcagttttgaggatgaggccaccccaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattga

SEQ ID NO: 3804 - DNA, 260 bp, Cicer arietinum
actccagacttcactatatacaatgccgggcagtttccatgtaatcgtttcactcactacatgacatcttccactagcattgatcttaatcttgctagaagggaaatggttatcctcggcacgcagtatgccgggaaatgaagaaaggtcttttcagtgtcatgcattatctcatgcctaagcgccaaattctctccttacactctggttgcaatatgggcaaagatggtgatgttgcactcttctttggactctcaggt

SEQ ID NO: 3805 - DNA, 304 bp, Cicer arietinum
gtagaatggctacaagtgaaggaggcgatgaacacaaaaaccctgcttttgacccggatttggatacaccagaaaacccggatcacgagtttggtgagttcggtgcgggttgtttctggggtgtggaattggcctttcaacgagttgtgggagtggtgaaaacagaggttggatattcacaaggtcacacaccggatcctaactacaaactggtctgcaccggatccaccaaccacgtggaagtggttcgggttcaatttgacccgaaaatttgtccgtacacaaatctcttggatctcttttg

SEQ ID NO: 3806 - DNA, 357 bp, Cicer arietinum
gattagcgtggtcccggccgaggttggcggtgtatttcccggaggcagaggcatatggtggaggacaatggggagggggggagaaataatgaagttggatggttattccatttactattactagaagtggatccttgcaatcactaatcaccgtcgtcttctacagtgttcacccgttcacattcatcaatccattcactgtatatgtctattgcctcagataaagctgtgattgtagtgtttaagctctcttgacatatcctgtaagaagcttcccctatcgggttcttcatatcaatgcggcattcaacactggaaccatgattgcagaaaggacaactaaagacagtgtcaagc

SEQ ID NO: 3807 - DNA, 493 bp, Cicer arietinum
gatttgcctgctaacaaggaaggtagatttggattcaacttattggtgggcggtttctttagtcccaagagatgtgcagaagcagctccacttgatgcatgggtctctgcagatgacgttatcccactttgtaaagctgttcttgagacatatagagaccttggcaccagaggcaatagacagaaaaccagaatgatgtggttgattgacgaactgggaatagaagtattcagatcagaggtggaaaaaagaatgccagagaagaagctttcaagagcatcccaagaagatcttattcaaaaaaaatgggaaagaagagactacttaggtgttcatccacaaaaacaagagggtttaagctatgttggtattcacattccagttggtagaatccaagcagatgagatggacgagctagctcgtttggccgacgaatatggcacaggggaactccggctaaccgtggaacaaaacataataatcacaaatgtag

SEQ ID NO: 3808 - DNA, 105 bp, Cicer arietinum
acaagagtgtaggcgcctgggcccctatctccaacccttctcagtgcccctggggtgacaaggccttcaagggttacttgggtgaggatagggaggagtggaaga

SEQ ID NO: 3809 - DNA, 182 bp, Cicer arietinum
acccctcttgctcttgccgatcatgttctctctcggtccttcagctgcagtcgagggagggcatacctattcagcaaagtggtgaatgttacggttgggcctcaggtagacagattgatgatatctggactgcacacaggtgaagatatattttgtgtgctgctgtggacaaattatgggat

SEQ ID NO: 3810 - DNA, 293 bp, Cicer arietinum
acccctcttgctcttgccgatcatgttctctctcggtccttcagctgcagtcgagggagggcatacctattcagcaaagtggtgaatgttacggttgggcctcaggtagacagattgatgatatctggactgcacacagttgaagatatattttgttgctgctgtggacaaattatgggatggaaatatgttgtagcacatgagaaaagtgaagtatataaagaagggaagtttgtgcttgagagatggaggatagttgatgacatcgacgagcaattaaatttggatggtca

SEQ ID NO: 3811 - DNA, 126 bp, Cicer arietinum
acatttacgagaccgacggcgtcgggggtctttaccgtggtatcgctccccgtatttctcttggtatttggcagactgtctgcatggttgcttttggcgatatggcgaagacttatgttgagaagc

SEQ ID NO: 3812 - DNA, 231 bp, Cicer arietinum
accagaaaaatgtaagcttatcatcaagcctacaagggcaatcatcacattggttaaggcttccaaagcaaactggctagatttgcacttcaaagaagataagctgaagccaagcatgggtaaagagaaagacccaatggcaggaatcatggacttgatgaagaatatgtatgaggatggggacgaggagatgaagaaaacaattgcaaaagcatggactgatgctagaac

SEQ ID NO: 3813 - DNA, 484 bp, Cicer arietinum
  misc_feature (5)..(5): n is a, c, g, or t
aacgncgcatgctccttcccgccatggggaacgcgggaattcgattagcgtggtcgcggccgaggtactaggttgaattactattgcgacactgtcatcagtagggtaaaactaacctgtctcacgacggtctaaacccagctcacgttccctattggtaggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtaccagtcatactcataatatatggaggctgcgcgtaagatgacaggacggttgaggaagatccaccaacttgaggcacaactggagctcctcttgagtccaccatgtatggaattgtacctgccc

SEQ ID NO: 3814 - DNA, 428 bp, Cicer arietinum
ccttttgcttccaccttcgattcatcaaatccgaacgcgtttcttgaaaaggtgttcgacttcgtcgctaaggaaagtgattttctcgataaggatttttctgagaaggaggtggtgtccgcttttcgcgctgcgaaggtaaagaaagctaagattgttgctgctgagaaggcgaaggttgttgccgaagcgaaggcgaaggttgttgccgaagcgaaggcgaaggctgaaaagaaattgaaggaggagaaggcggcgaagagagataaggaggtagaatcgaaggaagatgagaagaagggtggtgaaagtggcttagctgctccaaacaagggtaatggtatggatctggagaaatattcctggactcaaactctgcaagagcttaatgtgaatgttccggtcccaactggaacaaaatcaaggtt

SEQ ID NO: 3815 - DNA, 230 bp, Cicer arietinum
acaaacattgcattttatttattcaagtcttgtagtaaatatcacaatgtccaatatagtcaaacaaggtaaaagcaaatacaactcaatacattgtgcttcaatgacatatcacaacttaataatattctatttgttatcccaccaaaattgtttttgaagattgtcaataatattattgtccacttgaaaagctttggtgagaacttcagaagaaatttttggattag

SEQ ID NO: 3816 - DNA, 158 bp, Cicer arietinum
ggtcttttgggcctcaagcgcatcaagtggaactttgagaagttccttgttgggcgtgatggaaaggtcaagggacgctgggctagcaccaccaagcccgagagtctggaggagcctatcctgaaggctcttgcggagaaggctgaggcttaatttga

SEQ ID NO: 3817 - DNA, 375 bp, Cicer arietinum
atagaagataaattaaaataaaataaagtgtaataaaaaattaaggcaaccccattaagccattattttttattacactttattttattttatcttctatatcacttttggagttatgcattgacaagatgagcatccatatctttagtgcatttggcaaagtagtccatgtatccatttggaggatcataatcctcatggatcttctcatattctatagtccatttaacggaagcactaccatcagccttatctataacttcaatgatgagtttaaagatcttatagtgctcatcaatatctccaccaaagagcttgaaagtgagttttttgttctcttcatcaatttcttcaacactctctttacatgtgtgt

SEQ ID NO: 3818 - DNA, 375 bp, Cicer arietinum
atagaagataaaataaaataaaataaagtgtaataaaaaattaaggcaaccccattaagccattattttttattacactttattttattttatcttctatatcacttttggagttatgcattgacaagatgagcatccatatctttagtgcatttggcaaagtagtccatgtatccatttggaggatcataatcctcatggatcttctcatattctatagtccatttaacggaagcactaccatcagccttatctataacttcaatgatgagtttaaagatcttatagtgctcatcaatatctccaccaaagagcttgaaagtgagttttttgttctcttcatcaatttcttcaacactctctttacatgtgtgt

SEQ ID NO: 3819 - DNA, 222 bp, Cicer arietinum
gaggatgaggccacctcaattgtagctcctgctactctctacaaagctctagttacagatgctgacaaccttactccaaaggttattgatgccattaagggtgttgaaattgttgaaggaaatggtggccctggaaccatcaagaaattcactttcgtcgaagagggagaaaccaagtttgtgttgcacaaagtggacgcaatagatgatgctaattgggct

SEQ ID NO: 3820 - DNA, 425 bp, Cicer arietinum
actggatggatgagaattatctctacacctgcttcggtcaaaccggcgaggtaacatctctgaaagtgattaggaataagcaaaccagtcaatcggaaggttatggttttatcgagtttaattctcgtgctactgccgagagagtgcttcagacatataacggagccattatgcctaatggtggccagagctacagattgaattgggcgactttcagtgctggggagaggtcgtctagacaggatgatggtcctgatcataccatttttgttggtgatttggctgttgatgttactgattaccttcttcaggagacttttagggctcgttataactctgtgaagggggcaaaagttgtgattgataggcagcgtggtcgcggccgaggtacaagtctatccaaaatatgcatccttctcaaagcc

SEQ ID NO: 3821 - DNA, 176 bp, Cicer arietinum
gtaattcttggatcaacaaactttgaggattggccgattgttgatcctctaccgtcttatggacgaggaagggagttgccgggtggaaggcataggagcctaatttatggatgcaatttgaccgatgttatcataacaggtaatgagggaatcattgatggtcaagggagtatatg

SEQ ID NO: 3822 - DNA, 432 bp, Cicer arietinum
ctttatgagaccctagccatcactcagagtgtcatttttgtgaacaccagaaggaaagttgattggttgactgacaagatgcgaagccgagaccatacagtctcagcaactcacggagacgtggatcagaataccagggacattattatgcgtgaatttcgttctgggtcttcccgtgttttaataactaccgatctcttggcacgtggtattgatgtccaacaagtgtctctggttattaattttgatctccctacacagcctgagaactatctccaccgtattggtcgtagtggaaggtttggtagaaaaggtgttgctattaactttatcactaaggaagatgaaaagatgctgtctgatatccagaagttttacaatgtgatagttgaggagttgccatcaaatgttgcggagctcctctgatgagat

SEQ ID NO: 3823 - DNA, 321 bp, Cicer arietinum
actacggccgcttccagccctggtgcgccatcattggtctggtcttccagttctgcgtcgtcatgtgctacggttacaagtcattcaagccctgggatgtcgagagcttcttcaagaactacaccatgcaaatcgtcgccccttgtcttttcatcttctggaagctctacaagaagactcgctggctccgtccccatgaggtcgaccttacctgggagcgtcctatcattgacgcttacgagaactccatcacaacaccccctactggcttctggcaggagatgggaatgctcgttggcatcaagcgcaaggtgcattcgg

SEQ ID NO: 3824 - DNA, 134 bp, Cicer arietinum
ctaaatattgggaaaaccccgaagagctcattccagagagatttgaacatagtccaattgattgtaaaggccaaaattttcaatttttaccatttggttttgggagaaggggatgtcctggaatgaattttgga

SEQ ID NO: 3825 - DNA, 363 bp, Cicer arietinum
caggtacgggagatgtagtgacggttgagctcgaggagaatcgattgatcaatcacacaaccggaaaggagtataagttgaagcctattggagatgccggtcctgtcattggagccggtggtatctttgcctatgctaggaaaaccggcatgattcctactcgatgagagaaagtcatgttggcagcggcagatgttttgggaggctgactagaattgtttgttcgcctgcattcaaggattctattcagattctctaatcatgcggcttttataaaaatgagtattgtaatttggagttagaattgttaactatttttggaatataaaatgtcaaggctttctattagaacatttgaaatgt

SEQ ID NO: 3826 - DNA, 355 bp, Cicer arietinum
accggtattaacccggcaagaagtttcggatcagccgtaatctacaacgaaggcaaaatttgggatgaccagtggatattctgggttggaccaattattggagctacagtggctgcaatataccaccaatacattcttagaggatcagccattaaagctcttggatccttcagaagcaatgcttaattaattcacctctatctatcacttatttgtcaatgagtctatggtgttaattaatttcccccgaagaataatgttgaggagtgcaaaatgaagtggtccctttgggcgttttcgtcttttccattccgacggaagtaaactgcttcgcggcggttttatctccttgggt

SEQ ID NO: 3827 - DNA, 225 bp, Cicer arietinum
acggacaagggcaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtcc

SEQ ID NO: 3828 - DNA, 121 bp, Cicer arietinum
accagcttcgtgaagaacgcgatatgaaaccggagacatttgctagcttagtatctgctattctctacgagaaaaggttcggtccatacttttgccagccagtaattgctggattagggga

SEQ ID NO: 3829 - DNA, 102 bp, Cicer arietinum
agaacttgtcctggtttgcctttggctattagaatgttgcctttgatgttgggatctttggttaattgctttgattggaaacttgaagatggtttgaatgtt

SEQ ID NO: 3830 - DNA, 246 bp, Cicer arietinum
acaagtcaaagaaatcccaaacatatgccaaaaacggaacatcatgtaaaataagctacggatctggatcaatatctggtttcttcagtcaagataatgttaaagttggcaatgctgttgtcaagtatcaggatttcattgaggctacccgagaaggaagtctttcatttctggcgggaaagtttgatggaatacttggatttgtatttcaggagatctcagttgcaagagctttgccagtatggt

SEQ ID NO: 3831 - DNA, 117 bp, Cicer arietinum
accggagctgctaaggctgttggcaaagtgcttcctgttttgaatggaaaattgaccggaatggcattccgtgtcccaactgtcgatgtctcacgtgttgaccttacagtgaagctt

SEQ ID NO: 3832 - DNA, 207 bp, Cicer arietinum
accggatctgctaaggctgttggcaaagtgcttcctgttttgaatggaaaattgaccggaatggcattccgtgtcccaactgtcgatgtctcagttgttgaccttacagtgaagcttgagaaggccgctacctacgacgaaatcaaggctgctatcaaggaggagtctgagggcaagttgaaaggcattctcggatacactgaagat

SEQ ID NO: 3833 - DNA, 427 bp, Cicer arietinum
  misc_feature (3)..(3): n is a, c, g, or t
cgncgcatgctccttcccgccatggaggacgcgggaattcgatttcgagcggccgcccgggcaggtactatagatggttacgttggaaattccatatagtgagtgtgacaatgttgcaaaaatatacaagaaagtttcttctggtttgagacctgctgcattgaacaaagtcaaagattcagaggtaaaggctttcattgaaaagtgtcttgctcaaccaagggctagaccttctgctgatgaacttctcaaagatcctttctttgattatgttatcgatgatgatgacgacgaaaatgagtatgaatctgttggttcatactaaaacagtccttaatatgataaattatgtggatgacttagtttaatttttttaatttgatttgcttactttttttttagtttttatgtcaatttgcaatctggg

SEQ ID NO: 3834 - DNA, 276 bp, Cicer arietinum
accatcatttccccacattgtggactctctcaatgataccttattgaaaatgattatttagtttataaacggacatggacgaattaagtgtttgaatgtatgttttaggaggaaaggagtttagcagcagcaccaggtcttgcaagtggaacacatactagattatgtgctcttggaacagtgagaccaggtctttcatccatgctaaccttatcatcagcacctttcaatatttgtccatttggtcctgctacctgtaattcaaagcactgtaat

SEQ ID NO: 3835 - DNA, 231 bp, Cicer arietinum
cgataacttcgttttcggtcaatccggcgccggaaataattgggcgaaaggtcattacaccgaaggcgccgaactcatcgattccgtcctcgatgtcgttcgcaaagaagccgagaattgcgattgcctgcaaggatttcaagtgtgtcattctttgggaggtggcacgggttctggaatggggacgctattgatttcgaaaattcgagaagaatatccggatcgaatgat

SEQ ID NO: 3836 - DNA, 362 bp, Cicer arietinum
aaacacaaagaggagagagagagaggaaatagatagagagataaagttgaagttcaacaccgaccggactttcggtgctccgctgatcaccgttgtggctcccacctctccgtattttacgctctaaaggaccacatgtctaacatagaggctgacaaagaaatcggacagatggatttggatgcgtctgaggggtcagttaacatgccatcgtcccaaaagcaggaggaagctttaaagaaaaaatatggaggaattgggcccaaaaaggcaccacttatttctaaggaccatgagcgtgcttactttgattctgccgattgggcattgggaaagcaagggggtgagaagccaaagggacc

SEQ ID NO: 3837 - DNA, 301 bp, Cicer arietinum
gacaaagggaaacgatgtaaatgcaaaacggattaaggagtataggcataaggttgaatcagagctttcaaacatctgtaatgatgttatgagagtgattgatgaacaccttataccttcagctgcagctggtgaatcaactgtcttttactataagatgaaaggagattattatcgttaccttgcggaatttaagacaggcaatgagaagaaggaggctgctgatcagtcgatgaaagcatatgagtctgctaccactgcagcagaggctgaattacctcccactcatcccattcgattg

SEQ ID NO: 3838 - DNA, 433 bp, Cicer arietinum
gcatgctccttcccgccatggagaacgcgggaattcgattagcgtggtcgcggccgaggtactcaacaagggagatgtgtttgtgttcccaattggtctcattcacttccaattgaatgtgggatatgaaaatgcaattgctgttgctggacttagtagccaaaatccaggtgttgtcactattgctaatgctgtgtttggttctaatccaaaaatttcttctgaagttctcaccaaagcttttcaagtggacaataatattattgttaatcttcaaaaacaattttggtgggataacaactagaatattattaagttgtgatatgtcattgaagcacaatgtattgagttgtatttgcttttaccttgtttgactatattggacattgtgatatttactacaagacttgaataaataaaatgcaatgtttgt

SEQ ID NO: 3839 - DNA, 352 bp, Cicer arietinum
actggatgtttgccaattatctctacacctgcttcggtcaaaccggggaggtaacatctctgaaagtgattaggaataagcaaaccagtcaatcggaaggttatggttttatcgagtttaattctcgtgctactgccgagagagtgcttcagacatataacggagccattatgcctaatggtggccagagctacagattgaattgggcgactttcagtgctggggagaggtcgtctagactggatgatggccctgatcataccatttttgttggtgatttggctgttgatgttactgattaccttcttcaggagacttttagggctcgttataactctgtgaagggggcaaa

SEQ ID NO: 3840 - DNA, 398 bp, Cicer arietinum
gctgcactgatgcttgtttgaagagatatcttgaagctcgaaattggaatgtcgacaagtcgaagaagatgttggaagatacactcaagtggagatcagcctataagcccgaggaaattcgttgggatgaggttgcaattgaaggggagactggcaaagtttatagagcaggtttccatgacagacaaggaaggactgttcttattttgagacctggaatgcagaacacttcttcaatggagaatcagataaagcatcttgtgtatcttttggaaaatgctatgcttaaccttccaccaggtcaagaacaaatggcttggttgatagacttcactggttggtcattgaccaacaatgtgcccctcaaatcagccaaagaaaccatcagcattctacag

SEQ ID NO: 3841 - DNA, 417 bp, Cicer arietinum
tttgaggatgaggccacctcaattgtagctcctgctactctctacaaagctctagttacagatgctgacaaccttactccaaaggttattgatgccattaacagtgttgaaattgttgaaggaaatgggggccctggaaccatcaagaaattcactttcgtcgaagagggagaaaccaagtttgtgttgcacaaagtggacgcaatagatgatgctaattgggcttaccactacagcatatttggaggtgctgggcttccagacacagttgagaagatctcatttgaggctaaattgattgcaggtccaaatggaggatccattgcaaagttgagtgtgaagtatcacaccaaaggagattttactccttctgaagaggagctcaaaagtggcaaagccaagggtgatggtcttttc

SEQ ID NO: 3842 - DNA, 126 bp, Cicer arietinum
acaaacggtgcaccaatttcacacaatgggttctaccaacactgtgtgctccaagcaaagcgaacaactccagaggtgtcaattcccatgggaccaaatttgtcaagaacagcagaaatggactca

SEQ ID NO: 3843 - DNA, 108 bp, Cicer arietinum
cctttcgaattcccagcttacttgtagattggtggtggcggggaagcataaatgtaaactggtggtggcggtgatttcactggagggggaggtgatttgtaaatgtat

SEQ ID NO: 3844 - DNA, 172 bp, Cicer arietinum
ttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccct

SEQ ID NO: 3845 - DNA, 423 bp, Cicer arietinum
ccatttcattgttgccgcggtaggggtagaactaaattattcgggatgggtagggttatcagggcacaacgtaagggtgcgggatcagtcttcaaatcccacacccaccaccgtaagggaccagccagattccgcagtctcgatttcggtgaaagaaacggttacctcaagggagtaatcaccgatatcatccatgaccctggtcgtggtgcacccctcgctaaggtctctttccgtcatccttttaggtataagaaacagagtgagcttttcgttgctgctgaaggaatctacactggacagtttatttactgtggaaagaaagctactcttgttgttggtaatgttttgcctctcagatctatccctgaaggagctgttatttgcaatgttgaactccatgttggtgaccgtggtgctttc

SEQ ID NO: 3846 - DNA, 432 bp, Cicer arietinum
accatcaatatcaaaacaaccacaaaataaaggtcgaccatcgccgatcaagaacccagttttgcaagtttggctgcataaaaacggcaaaattaaaaggcaaaaataaactaagactcttaaaagataataagctactataaagcaacatccacttctgcatcaaccatcacttcttcttcactgcagctttggtgatcttggctccagttggatccttcttctcacacactcaacacagtttgcttatctggctaccttttgcactatgtcctgactcatactcaaattcaaggtgcctatattaattattttggagtttcccttgcttgtttgttcgtggctctcgttggtttgggaagaatttatcttggtatgcatagtttgattgatgttgctgctggcctttttcttggactcggaatccttgga

SEQ ID NO: 3847 - DNA, 346 bp, Cicer arietinum
acataaccaaattccatgtctcagaagaagaatcaggaaagagacttggggagggtgtaagtgatccaagcctaacaaaatctggtgtttactggagctggaacaaagcttctgcttcatttgaaaaccagctatcccaagaggccagtgatgtcgagaaggctcgcaaggtgtgggaggttagtgagaagcttgttggtttggcctaaagtcagattttccaacattatgcagaggcattgtcatgttgagtgcattaagtgttgttttgttagataggagctttttttccctttatgtaggagtcatggatcaataaaatcattcaaccatgtggcaaagtgcc

SEQ ID NO: 3848 - DNA, 358 bp, Cicer arietinum
actcatagttgatatcaatgccatctattatgttaaagctccaaggatccttgacttcgttgtattgctggatgatctttttgagtgagtttacagcattgtcaggccattctacttttgaagcaggattgaatggatgtttatcaccacgaccaccgatgcttattacaaccttcacatttttatgattttgcttgagttccttcactttttcaggactgaagaaatgaacgttccaactggggttgaaaactcctgtgccttttccactatcatcgtaagtctctgtggcaaagcctaaaatgaagtggaattggtggatcttggagttgatgatatcagttgggaaattatgtaa

SEQ ID NO: 3849 - DNA, 109 bp, Cicer arietinum
ttggttgaatcagcggggaaagaagaccctgttgagcttgactctagtccgactttgtgaaatgacttgagaggtgtaggataagtgggagctggaaacagcgaaagtg

SEQ ID NO: 3850 - DNA, 180 bp, Cicer arietinum
ggtcagagcaaatcataagcgaaaacgaaaaaacaaaattaaaaggcaaaggcttaattttggacggtgttgtgcagaagaggagaatggcagcagaagagggacaagtaatcggtgttcatactgtggatgcttggaaagatcagatccagaagggaaatgagtccgggaaattgattg

SEQ ID NO: 3851 - DNA, 183 bp, Cicer arietinum
actattaattaacagcataacagactgctttacaactgtcaaaataaataaaaagctaaaatacataacagcttaaagaaattagagaaaaaaaacacaataacaatcttatcaccatataatagaaaaattaacgccttttctttcctgaagacaaaacgcggaaactttgcttcccttttt

SEQ ID NO: 3852 - DNA, 433 bp, Cicer arietinum
actattacatttcccataaatgcacttaagttaggtgtgtgtgcaaaagtgttgaacttggtcaaggttaaattgggggccccaccaacactcccttgttgctcactcattcaaggtcttgctgaccttgaagctgcagcttgtcttcgcactgcccttaaagctaatgtccttggactccaccttgatgttcctatttcattgagtctcattctcaacaattgtggaaagaacaactctggtttccagtgccctttataagattaattcttgttcacatgtttggttcgggtggttgttttctcttttcaatttatgcttttggcttatttttatgggtgattgcttaccatatattattgactttcttactccttcactattgtttttctattggatatggaagattatatacatcttcctcgtcaccttc

SEQ ID NO: 3853 - DNA, 320 bp, Cicer arietinum
atcatgtgctataccggaggactctgtgcataaccaattccagacatggggggcagtttctgtccttgaaagcagcagttcctcctctggtggaaagacgaccgggatttacatccctgtgccttgtggacgtgcacgcaccaagcgtccacgtcccgcgacattcaaccctcgttcggccatgcagctcatttcccctacttcctcctttgtagggtataatatgcagcctaatgttatctccaccaaggcatctttagagttcgaaaacgttgttgagtctcaaattgtgggcaagaaaccaaagcttgcttctggag

SEQ ID NO: 3854 - DNA, 262 bp, Cicer arietinum
ggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactc

SEQ ID NO: 3855 - DNA, 427 bp, Cicer arietinum
actggatggatgagaattatctctacacctgcttcggtcaaaccggcgaggtaacatctctgaaagtgattaggaataagcaaaccagtcaatcggaaggttatggttttatcgagtttaattctcgtgctactgccgagagagtgcttcagacatataacggagccattatgcctaatggtggccagagctacagattgaattgggcgactttcagtgctggggagaggtcgtctagacaggatgatggtcctgatcataccatttttgttggtgatttggctgttgatgttactgattaccttcttcaggagacttttagggctcgttataactctgtgaagggggcaaaagttgtgattgataggcttacttgtcggtctaagggttatggttttgttagatttgctgacgagagtgaacaaat

SEQ ID NO: 3856 - DNA, 271 bp, Cicer arietinum
caaaagattctacccgccgctcaataggaattgcgtttcaaggtgtcccgcaaggctcatccgccttacgaggtccaccaacgacacgtgcctctggggggccaaggccccctactgctggtcggcaagcgaacgacgggcacacgcatcgcttctagcccggattctgacttagaggcgttcagtcataatccaacgcacggtagcttcgcgccactggcttttcaaccaagcgcgatgaccaattgtgcgaatcaacggttcctctcgt

SEQ ID NO: 3857 - DNA, 320 bp, Cicer arietinum
caaaagattctacccgccgctcaataggaattgcgtttcaaggtgtcccgcaaggctcatccgccttacgaggtccaccaacgacacgtgcctctggggggccaaggccccctactgctggtcggcaagcgaacgacgggcacacgcatcgcttctagcccggattctgacttagaggcgttcagtcataatccaacgcacggtagcttcgcgccactggcttttcaaccaagcgcgatgaccaattgtgcgaatcaacggttcctctcgtacctgcccgggcggccgctcgaaactgtcatcagtagggtaaaactaac

SEQ ID NO: 3858 - DNA, 428 bp, Cicer arietinum
atcatgtgctataccggaggactctgtgcataaccaattccagacatcaagtccagtttctgtccttgaaagcagcagttcctcctctggtggaaagacgaccgggatttacatccctgtgccttgtggacgtgcacgcaccaagcgtccacgtcccgcgacattcaaccctcgttcggccatgcagctcatttcccctacttcctcctttgtaggggagaatatgcagcctaatgttatctccaccaaggcatctttagagttcgaaaacgttgttgagtctcaaattgtgggcaagaaaccaaagcttgcttctggagagtcaaagaagaaaaagaaaatgaagatgccacttcctgcagctccagctgacagcaatcaggatgcttcacaacctattaggaaatgcatgcattgtgagataacca

SEQ ID NO: 3859 - DNA, 260 bp, Cicer arietinum
gatgaaccggtccccgagtcatgaatcatcgctaagccaccagtctgaggcggtaaatgcggcggcggtggatggagagagtaaagagagtgatgaaagtatggcttcggttgaaacggctgagacttcgatgaacttatttagagatgaaccggagtcaaccagagatttgaaacgggtggaccgaaccggtgaaagtggagaggaaaatgttggtttagaattgactcttgggtttgaaccggtttcacgtgttcatc

SEQ ID NO: 3860 - DNA, 438 bp, Cicer arietinum
caaactggttcatagcactcggagacaaaagcatacccgatcaagaggctggggagagatcacttgatttccaatttggatggtttatggaaccactaacaactggagactattctgtaagcatgcgaaacattgtgaaaaatcgattacctaaattctctccacgacaatcagttctagtcaagggttcatttgattttcttggcctaaactattattcttctagctatattaataatgcacctcccaaagctaatgcaaaacctacttacacaaccgatgctatgtcaaatacttcatttgaaaaacatgggatacccctaggtccaagggctgcttcggtttggatatacgtttatccaagaggacttcgagatcttttattatatatcaaggataaatacaacaatcccgaagtttacatcactgaaaatggta

SEQ ID NO: 3861 - DNA, 435 bp, Cicer arietinum
acggacaaggtgaccccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgccc

SEQ ID NO: 3862 - DNA, 222 bp, Cicer arietinum
acaaggctcctacctaccaggctcctcactactagattcgctcttcgacgatgaaggatagtagctgtttgtgctgtggttattgagtgggtgactcgtgctgattcacgatcatggtatatgacctgtgtgtgaaaacgcatagcgagaggacggcgctggacttctgacttatgagagattctggagggatgtcagatatgtgtttggatggatggactt

SEQ ID NO: 3863 - DNA, 291 bp, Cicer arietinum
acaagaacattagcttcactgtttgggatgtcgggggtcaagacaagattcgtcccttgtggaggcactacttccagaacacccagggtcttatatttgttgtagacagcaatgacagggatcgagttgttgaagccagagatgagttacataggatgttgaatgaggatgaacttagagatgcagtattgcttgtgtttgccaacaaacaagatcttcccaatgcaatgaatgctgctgagattactgacaagctgggtctccactctctcagacagcgccactggtacc

SEQ ID NO: 3864 - DNA, 253 bp, Cicer arietinum
cggacgtaacactaccgtgaacgaagctcagtctcgtggtagcggtggtggaggcggccgtggtggcggtggatatggtggaggcggtggatatggtggaggcggtggatatggtggtggacgtcgtgaaggtggatataacagaggtggcggtggaggatatggtggtggaggtggatatggcggaggaggtggtggtggttatggtggtagcagagatcgtggatatggtggtggtgatggtggttctcgc

SEQ ID NO: 3865 - DNA, 438 bp, Cicer arietinum
actcaatccctgcctcgtcccttgagcccggtggcatcgtcccaggcgagccagagcttgttccccgttcactcgaggattcttttcggagtttatcctttgcaaaatcaatcgacacttcaaccgagtttagcagttgtaggttctctgacataatgggagctggcaatgaagatgacgaggggaaggagatgcctcccgttcttaagaacaagtctccaagatggcacgaacagctgcagtgttggtgccttaactttaggggaagggtgacagtcgcgtcggttaagaattttcagctgattgctgcaacaccgcctgcagctagtgcggctcctacaacaacaggacctgcacctgcacgctctcagccgacacagtctgaccacgacaagattattcttcagtttgggaaggttggcaaggatatgtccacaa

SEQ ID NO: 3866 - DNA, 293 bp, Cicer arietinum
acgaatacgaaccgtgaaagcgtggcctatcgatcctttagtccttcggaatttgaagctagaggtgtcagaaaagttaccacagggataactggcttgtggcagccaagcgttcatagcgacgttgctctttgatccttcgatgtcggctcttcctatcattgtgaagcagaattcaccaagtgttggattgttcacccaccaatagggaacgtgagctgggtttagaccgtcgtgagacaggttagttttaccctactgatgacagtgtcgcaatagtaattcaacctagt

SEQ ID NO: 3867 - DNA, 434 bp, Cicer arietinum
acatacttaattgtagtttgattcttgctctcttcacactatcaagaggattagctgccaaaggtatctatccagcagtagatcctttagattcaacgtcaactatgctccaacctcggatcgttggtgaagaacattatgaaactgcgcaaagagttaaagaaactttacaacgttacaaagaacttcaggatattatagctattcttgggttggacgaattatccgaagaggatcgcttaaccgtagcaagagcacgaaaaattgaacgtttcttatcacaaccatttttcgtagcagaagtatttacaggttcgccagggaaatatgtcgcgctagaagaaacaattagagggtttaaattgattctttctggagaattagatagtcttcccgaacaagcgttttatttggtgggtaatatcgatgaagct

SEQ ID NO: 3868 - DNA, 327 bp, Cicer arietinum
  misc_feature (18)..(18): n is a, c, g, or t
acccatttttgacctggnaaatcaaccggttttggtttgatttacgatacagttgagaatgctaagaagtatgagcccaaatacagacttatcaggaatggtcttgacaccaaaatagagaagtcaaggaagcaaatgaaggagagaaagaatagggccaagaagatccgtggtgtaaagaagaccaaggcctctgatgctgccaaggctggaaaatagaaatgagtttttagttgtcgtgtttgtgctttaaggttgttttgctttccaagtttttttgatagctatgttatctcatgcatggtctacaaaatgagatattttggt

SEQ ID NO: 3869 - DNA, 315 bp, Cicer arietinum
acatcgtgaatgtcggaagggatttgtttcatttgttgcctgatgctttcaaagggattaagcagattggtgtcattggatggggttcacagggacctgctcaggcccagaatctacgggactcacttgctgaagcaaagtctgatattgtggttaaggttggactcaggaaaggttctcattcctttaacgaggctcgggaagctggatttagttattataatggaactctaggtgacatatgggaaactatatctgggagtgatcttgtgttgctgctaatttctgattctgcacaggcagataattatgaaa

SEQ ID NO: 3870 - DNA, 344 bp, Cicer arietinum
acatctgaaattagcttaaaatggggtgtataatcttctcttttcatctggctacaattgtaattgtaatataaacagtttataattaatcatctcctcactctcacccaaatgttaatatgaaattcatatgcaagtatgtcttatatgaatccccatggaactcaggtcaccgtgagaagaacttgactagtatctgagatttacaaaggaggaaggcgtccgagctaggtaggtatgagcgccaatatctgatttcttatgatacccatgtatttctgtatctcaccatatattggaagattctttgaacaaaatggatgcaaactggtgacagcagaatc

SEQ ID NO: 3871 - DNA, 372 bp, Cicer arietinum
acaaattcattacaacaacaaatgagtcagagggaataatgtttggagttatgtgtataaatctaagatcaaggtatcttcatgaacaccgtttaaggccatcaacaaataagcttctgctgaaacttctttaaaaggctatccgtgcaatggtttttctaacttcatcaatttcaggacattcctcttcatctgactctaccaataactaattaaatcaacatatccgatatcaacagatcgcaataaagatatgggctactacacaaggaataagaggcaagttcattccaacctccattgaactaaatctaagtgatttagtcatagagccaatgttgagtttatcaaagcggtgaacaatatccatta

SEQ ID NO: 3872 - DNA, 178 bp, Cicer arietinum
acaaatgaattactaaacactactcaggcacattttaagttctggtcgatttcccatccaaaattatggaatccaaatcatcttgtgttggccgtggtcaactccagcttgcttccttcttccatattttcttttcttaaggagcacggtataaaacggcttgccccctcttcagaag

SEQ ID NO: 3873 - DNA, 213 bp, Cicer arietinum
actaggttgacctactattgcgacactgtcatcagtagggtaaaactaacctgtctcacgacggtctaatcccagctcacgttccctattggtgggtgaacaatccaacacttggcgaattctgcttcacaatgataggaagagccgacatcgaaggatcaaaaagcaacgtcgctatgaacgcttggctgccacaagccagatatccctgtg

SEQ ID NO: 3874 - DNA, 293 bp, Cicer arietinum; identical to SEQ ID NO: 671

SEQ ID NO: 3875 - DNA, 321 bp, Cicer arietinum
acctggatttgccgcaactgaaattgagttagctaaaagggtgaaagacttttccttcaaggaaacaggattggatcagtatgctatagcgaaatttgctgaaagcttcgagatgattccgagaactttggctgagaatgctggactaaatgcaatggagattatatcttctctttatgcagaacatgcatctggaaataccaaagttggcattgatttggaaccaggtgtttgtaaggatgtctcaaccatgagagtctgggatctctatgtcactaagttatttgctcttaaatacgctgcagatgctgcatgcaccgt

SEQ ID NO: 3876 - DNA, 119 bp, Cicer arietinum
acaaaaacgagaaccacagtaacacaaaaccgtaacatgataaataccatagccaaaccactaatttcttaaacctactaaagtgacatgacaaggagaacattcttaatcataaaccc

SEQ ID NO: 3877 - DNA, 293 bp, Cicer arietinum
actaggtttaactactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 3878 - DNA, 423 bp, Cicer arietinum
gatttcgagcgccgcccgggcaggtacacacgtgtaatgagagtgttgaagaagttgacgaacaaaacaaaaaaatcacttacaagctattcggtggagatattgatgagcactataaggactttaaactcgatcctccgagtatttgataagagtgatggaagtgatgctgttaaatgcaatattgaatatgagaagatcaatgaggatatctatcctccatatggctgcatggattaccttatcaaatgcactagagacttggatggtagtcttgtcaagggatacatccataataatttacatatgtagaataataactaattatatagatatgttcatctatataattagtgtgatgtttgtaatggggcatgtagaataataagcatgcatatttgcttatgttgtttctatcaaata

SEQ ID NO: 3879 - DNA, 402 bp, Cicer arietinum
ggaaagatggaaacgtgattatcatcgacatatcaatcgatgaaacaagtgatgatcgtgaattaactgggttgcaattggactatgatttggtgatgctgacaatgttccttggaaaagaaagagaaaagaaagaatgggagaaacttatttacgatgctggtttcagtagttacaaaattagaaccataagtggctttaagtccatcattgaagtttttccttaactttaacttgaagcagcttgggtccagttatgcctcatatttaataagtttctatttgagagtcaaattaatagcgtctttatttttttggattgtattggtgtttattgattcctataagaaacgaatttcccaaacttgttattggtgtagagatcattgttccaattggaaa

SEQ ID NO: 3880 - DNA, 435 bp, Cicer arietinum
acggacaatgtgaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgccc

SEQ ID NO: 3881 - DNA, 437 bp, Cicer arietinum
tcaaaatttacaagaaaatcagctttctattcttggtctaatcctaaatccatgcctcttttgccattgaatgaggatcacgatgacggcgacgatgattattatgattataacgatgaagaagaaaaggttagaaaagtaccatctgcttcatcgtcttcttcttcctcttcattggctgaggataagaaacaagaagatgatcaagtggagtttcgtcaatcctatgctgctgaaatgaggcttagattgagaagtttcaagtcaaggagtttttctcttgcagatctgcaagaacatgatgatgaggaagatcatgatcgttaattaataattaacattaacatagactttttcttttattcttttttttttttgttaaataaattttttagtattcactactaagttactactactgaatattgaataacttg

SEQ ID NO: 3882 - DNA, 402 bp, Cicer arietinum
actcattacccccaagaggcacctctctactcgtagctcgccctatagtagttgtcggtgaagcacgtcccattggacatcaatacagttgatcctcgcagagcttccctccagcagcgtctcccatctagttcatccagcatatcatcggcacaaaggcgcatttactttcaagaggtcatcccgtcagcgggatctattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtct

SEQ ID NO: 3883 - DNA, 420 bp, Cicer arietinum
acaccaaaccgaaggtcaacacgatctccaacaccaaagcgggacccactccaactccagctgaaagtgagaatgctggaacagacaaaccagtagcgaagacgaggagcaaggaagcgacgatggatccgaggagttgagcgataatgtaaacgataccacggaggagggtgatgttaccaccaacgaaggcaccgaaagtgacggcggggttaacatgaccaccggagatattggcacctacggaaacagcaacaaagagagcaaacgcatgagcgatagcggcggagatgaggccggagggagtagcagcaccgtcgttggttagcttgttgtaagcgatgcttgaaccggagccggcgaagacgaagatgaaggttgagataaactcagcgagaccagctttcaaggtgtctgggt

SEQ ID NO: 3884 - DNA, 313 bp, Cicer arietinum
accagactttacctcgtcgatgacggaaggttctagatctacgaatacggcacgaggaacgtgtttgccggaaccggtttcgctgaagaacgtgttgaatgcatcgtgtgcaactccgacggaagaatcactaggcatcatgccatcaggctgaatgccatgttcgagacagtaaagctcccagcatgaatttccgacttgaataccggcttgaccgatgtgaatgctgataatttctctcatttttcgaatttcgaatttgaaacgttgagagaaaaaagaaacagaagaaagaggaagaggaaaatgtggt

SEQ ID NO: 3885 - DNA, 338 bp, Cicer arietinum
actggggtgccaactgctatgagaaggcaactgtagccagtgcagagataaaattcaggcacggccttcctcctggtgatggagttctatactaccctggtgaggtattctcaaccaatcaaccagtggcttctcttagactagagcgcttactcagtggcttgcaggacattgaatacctgagactttatgcttcaagatatggtagggatgaagctactgcacttttggatagagcgggagtttattttggtcctgagcgttacactcacgagcacatgccaattgatgcaatgaggggtcaaatatttaattcgtgtcgttcatgatttttttgt

SEQ ID NO: 3886 - DNA, 434 bp, Cicer arietinum
acaaagatgttattgaagctctagcagctaagggaattgaggaagatcctcggaactatttgacattcttctgccttggcaatagagaggtggtgaaagaaggagaatacgtgcctactgaaaaaccagagcctgatacagattacatgagagcccaagaggccaggcgtttcatgatttatgttcatgccaagatgatgatagttgatgatgaatacataatcgttggatctgccaacatcaaccaaagatcaatggatggtgctagagactctgaaatagcaatgggtgcttatcagccctatcatttggctaataggcagcctgcaagggggcagattcatggtttccgcatgtcattgtggtatgagcatcttggcatgcttcatgactcattcctccatccagaaactgaagattgcattaggaaggtg

SEQ ID NO: 3887 - DNA, 293 bp, Cicer arietinum
actaggttgacttactattgcgacactgtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 3888 - DNA, 423 bp, Cicer arietinum
accaagattgcttctgaaggactcaaacatcgtgtgtttgagatctcattggctgatcttcaaggtgatgaggataatgctttcaggaagattaggttgagggctgaagatgttcagggcaagaatgtcctcaccaacttttatggtatggatttcaccactgacaagctcaggtctttggtccgtaaatggcaaactctcattgtttctcatgtggatgttaagaccactgataattataccttgagaatgttctgcattggctttaccaagagacgcagtaaccaagtgaagagaacctgttatgctcaatccagccagatcagacagatccgcatgaagatgagggagatcatggttaaccaagcaacatcgtgtgatttgaaggagcttgttcgctagtttatccctgagatgattgga

SEQ ID NO: 3889 - DNA, 277 bp, Cicer arietinum
actcaataatattacacttttacactttcacattctacttctttgagcagctggcttaaagctggcaaaaccagtaacttctcttcctgtgaccaaagtgttgatttcatacgtgccttcgaaggtgtagataggttctaagtcacagaatgccttagccactagaaaatcagctaaaattccattgccaccaagcaattctcgtcccagtgcagctgtttctcttgccctcaaggtgatccacgacttccctaagctagcatgacccggggtcatt

SEQ ID NO: 3890 - DNA, 124 bp, Cicer arietinum
aaagaagaagaagaattttaacatatcatcactagatgatggtatcaaaacttaaaatgcggaataaactaggagtctctcctttcacctatttacctttacatcacatatatattaatgaata

SEQ ID NO: 3891 - DNA, 127 bp, Cicer arietinum
ccgagatacttttacactcaaagaaaaggaaaattgtgatctagtcactacatatatttaattaggcataagataacccattaatcatactgtttatcatcttcacctgcatcctctatgttatcaa

SEQ ID NO: 3892 - DNA, 192 bp, Cicer arietinum
acgctttgtcgtggtgcctaaagaatttaattttccaaaattcaaaagaccatcttatcctcttctatgttaagccccctcgtgccgtttattcggcctttgatggcacaggataccttttttcatctgacataactgcaaccatggagaagtatagccaacaagttgccgattgtgtcttggagaaagcca

SEQ ID NO: 3893 - DNA, 314 bp, Cicer arietinum
accgaaacaatacccaacagaaatttctgaagcagcttggaaggcagcatgaaagttcctgcctaagaatttcagttcttcacagttgcggcattgatgatgtcaatgaactccggcttcaaagaagcaccgccaaccaaaaatccatcaacatcgggctgtgatgccaattctttgctgtttcctccatttacagaacctccatagataattctgagtgaagcagcaacatcagcactcacattgtcgtgaacccatttccttaaatcagcatagacctcttgagcctgagcaggagttgcaacctttcctgt

SEQ ID NO: 3894 - DNA, 270 bp, Cicer arietinum
gcaaaagattctacccgccgctcaataggaattgcgtttcaaggtgtcccgcaaggctcatccgccttacgaggtccaccaacgacacgtgcctctggggggccaaggccccctactgctggtcggcaagcgaacgacgggcacacgcatcgcttctagcccggattctgacttagaggcgttcagacataatccaacgcacggtagcttcgcgccactggcttttcaaccaagcgcgatgaccaattgtgcgaatcaacggttcctctc

SEQ ID NO: 3895 - DNA, 310 bp, Cicer arietinum
accgcctgtgccaagctcttccgttgctccaccatggccatcctcgacgctggtgactccgacattctcagcgaccagcaggcttaagtgtctcgctgatagagaatgcattttatggcgtttggggtaaaatgggtccagggcatttgaggatataccaatctgagtgatgaaaaagcgacaactcttagtgagaacacgcgatgcaagaaagctggcagttctccccttgacctatgcgtcttgggcttcgttggacttggtatcgattaccagttcaagccaataaaaaataaagctcatgaacatt

SEQ ID NO: 3896 - DNA, 430 bp, Cicer arietinum
actaccttgtatggagctgtttataagcctgatgcttcaagatttggacctccaccttacaaaaccatgatcaatgtttatggtggtccaagtgttcagcttgtttctaactcttggcttaatacagttgacttgagagcgcaatacttgagaaatcaaggcgtcttagtttggaagttagacaatagaggaacttctagacggggattgaagtttgaaagctgtgtaaagcacaaacttggacaaattgatgctgatgatcagtttactggagcagagtggcttatcaaagaagggctcgcaaaatccggtcacatcgggttgtatgggtggagctatggtgggtatctgtctgctatgacactgtcaaggtatccagatttcttcaagtgtgctatagccggtgcacccgttacatcgtgggatggat

SEQ ID NO: 3897 - DNA, 190 bp, Cicer arietinum
  misc_feature (120)..(120): n is a, c, g, or t
catatctattcttacgaacagcatgcattcctgcttcttgacaaatagcagatatctcagcagcactaattttgacaggacttgaaacataatcctccaggtccacctcatcactcaagntcattttggctgtgcaaacctgaaatacaagcctcttttgccgtctatcaggtaaagggaactcaatttt

SEQ ID NO: 3898 - DNA, 111 bp, Cicer arietinum
tggagcttatgagaaacctcccgggacctttgttcctcttctctatacacaggtcctttatttctctcctcccgtctcccgcggcattaacttcaatacttaaacccctta

SEQ ID NO: 3899 - DNA, 157 bp, Cicer arietinum
cgatggtgtcattcatatgaacgaaagtatgcaatgggcttcaagttcagctgctgagagaggtagaggctcagattttgactttgagaatggcagagttgtgaagccgtgggaaggtgagagaattcatgaagtaagaatggatgaattggagctt

SEQ ID NO: 3900 - DNA, 210 bp, Cicer arietinum
aaagtcttttatgtgcccttcaggaattgatgactttcctatgactactattgaccatatcaaggagggcttacctgtgttggcaaaatatagaagacctttaatcgtgcacgctgagattcaacaagattctaaaagtcctttggagctttacagcaatggcgacccgcatgtttataagacatatctcgacactagaccaccttcatg

SEQ ID NO: 3901 - DNA, 125 bp, Cicer arietinum
tggctttggcatgatcatggaaagaatgaaagttgggaatgccaagctagaagaaattgatatgcttcaggagttgactaagcaaattgaaggtcacacgatctgtgccttgggtgatgctgctg

SEQ ID NO: 3902 - DNA, 420 bp, Cicer arietinum
caaatcatttcacttttgagatcaaacaacacttctggtttccaaatttctcttagagatggaagatggatttcagtgccacctgatcatagctccttcttcatcaatgttggtgattctcttcaggttatgactaatgggaggttcaaaagtgtgagacacagagttttggcaaatgggatcaacccaaggctctcaatgatttactttggtggaccaccccttagtgagaaaatagcaccattgccttcactcatgaaaggaaaagaaagtttgtataaagaatttacatggtttgagtataagaattcaacctatggttcaagattggctgacaatagacttggacactatgaaaggattgctgcctcctaatgcaagattattattatagggtgtttcacttgtcaatacaaaaaa

SEQ ID NO: 3903 - DNA, 179 bp, Cicer arietinum
acagaaaaagttatgaaaatattcacaaagaagagaatcatttaaaaaacttaccaataggacatttccgtggttttatcaaattacatcaatgtcatcaacattaagccaatcattgaaatccttggtcacagaagaattacgagcacttgtatgctcagagcctgcatgtctgcttt

SEQ ID NO: 3904 - DNA, 343 bp, Cicer arietinum
agtttatacttcacctccttacattccacacccagtttatcactcacctccaccaccagttcatacttctcccccatacattccacatccagtttaccactctccaccaccaactccaaccaagaagccttacctctattcctcacctcctcctccttaccactattagatagtaaacaataatagtggtttattaccatagctctctatgaaagattatgaagaatatatgaaaataaagaaagtgatggaaggaagatacatcgaaagagaaaaaagggaagcaaagtttccgcgttttgtcttcaggaaagaaaaggcgctaatttttctattatatggt

SEQ ID NO: 3905 - DNA, 216 bp, Cicer arietinum
acaccaaaccgaaggtcaacacgatctccaacaccaaagcgggacccactccaactccagctgaaagtgagaatgctggaacagacaaaccagtagcgaagacgaggagcaaggaagcgacgatggatccgaggagttgagcgataatgtaaacgataccacggaggagggtgatgttaccaccaacgaaggcaccgaaagtgacggcggggttaa

SEQ ID NO: 3906 - DNA, 404 bp, Cicer arietinum
actcattacctccaagaggcacctctctactcgtagccagctctacagtagttgtcggtgaagcacgtcccattggacatcaatacagctgatctcagcagagcttccctccagcaacgcttctatctagttcatccagcatatcatcggcacaaaggcgctttactttcaagaggtcatcccgtcagcgggaactattcctctccagcctagaattctcttgcactgatagatcaagtagctttccataccctgaggcaggaagtccatgatcccctaagatcgccagtagctgcaacctaggaccgtgcatccttggggaaaacccttgcaggagaaaaccccaaagcggccagaacgctgctctgtggacgaggtagtcgcctcattccacggtctccagg

SEQ ID NO: 3907 - DNA, 208 bp, Cicer arietinum
actcaaagggattattagcttcctgagcagcaacaagtccactaatgtgagccatatcacataacaaaagtgcaccacacttatcagcaacttgtctaaaccttccataatcccaatccctagggtaagcactaccaccacaaattatcaatttaggtctaaaatccaaagctttttcctccaacctatcataatcaataaatcccgt

SEQ ID NO: 3908 - DNA, 434 bp, Cicer arietinum
acgagcttgattcgttgacgaggaagcacgtgacgattgcgttgtgttacacaacgacgccggatagactccggcgaaggtttcctcacttggagtcgttgaagttgaaagggaaacctagggcggcgatgtttaacttgataccggagaattggggagggtttgttactccttgggtgaaagagatttccaagtattttgattgtttgaaatcgttgcactttcgtcgtatgattgtaactgattctgatcttcagattcttgctcgttcgcgatgtaatagtcttcatgctcttaagttagagaagtgttctggattctccactgatggactttactatgttggtcgcttttgcaagaatttaagagtcttgtttatggaggaaagctcagttgtcgagaaagatggtgaatggctgcatgtgcttgctttg

SEQ ID NO: 3909 - DNA, 424 bp, Cicer arietinum
acgagcttgattcgttgacgaggaagcacgtgacgattgcgttgtgttacacaacgacgccggatagactccggcgaaggtttcctcacttggagtcgttgaagttgaaagggaaacctagggcggcgatgtttaacttgataccggagaattggggagggtttgttactccttgggtgaaagagatttccaagtattttgattgtttgaaatcgttgcactttcgtcgtatgattgtaactgattctgatcttcagattcttgctcgttcgcgatgtaatagtcttcatgctcttaagttagagaagtgttctggattctccactgatggactttactatgttggtcgcttttgcaagaatttaagagtcttgtttatggaggaaagctcagttgtcgagaaagatggtgaatggctgcatgt

SEQ ID NO: 3910 - DNA, 437 bp, Cicer arietinum
acatggattgagaaatgcatagctattttgataaatttaactacttctgaagttggaagggaggaaatggtatcaactcctggattcattagcgctttggcttcaatattggacaccgatgagctccttgtgcaggagcaagctgtctattgtctcctaattttgtgcaacagtagtgagcaatgttctgacatggttcttcaagaaggggttataccagcgttggtatccatatcagtgaatgggaccccaagagggagagaaaaagctcagaaactcttgatgctgttccgacagcagcgacgagatgattcacctgttgaggaacatcaatgtcctcctgaaaccagtgatttgtctatgccgcctgctgaaatgaaacctccatgtaagtctatgtctagaagaaagactgggaaaggttttagcttattctg

SEQ ID NO: 3911 - DNA, 121 bp, Cicer arietinum
actaaagacacgggttccttgtttgatataacattccaaagaccatcactagcaattattataaaatccacgccttcaatttcttcctcctgaatttctgggtcagcaacaacatatggct

SEQ ID NO: 3912 - DNA, 365 bp, Cicer arietinum
ataacaaatcataattgtattgaattttttaaaataaaaaaagataaaactttcaccattacatatctagcaagactttactatattttcaatctcaatatatagaagcttgtatatataacttagaatgattttattattatttcttgatgaaaaaagtaagaactatatagaacctctaagctcttagcctgaccttttacaaaacttgtaaccaacggctatagctgccaaaactccaagtatacctgtagctgtaagaatatcgcgctgctgtaatacaggccaactccagcttactttgctcccctgctttttatgttcttttgtggtttcttcaatctctttgttttgctcaaaagttg

SEQ ID NO: 3913 - DNA, 192 bp, Cicer arietinum
gtccctgcttttcccgacgcaatgtgatttctgcccagtgctctgaatgtcaaagtgaagaaattcaaccaagcgcgggcaaacggcgggagtaactatgactctcttaaggtagccaaatgcctcgtcatctaattagtgacgcgcatgaatggattaacgagattcccactgtccctgtctactatccag

SEQ ID NO: 3914 - DNA, 421 bp, Cicer arietinum
ctcgttgttgccgccgctgctccaccactctccgaaccgtttctcctgcaattccttaagctctttcgttctaacaagattttgaaagatggctgatgctgaggatattcaacctcttgttgttgacaatggaactggaatggtcaaggctggttttgcaggcgatgatgctcctagggccgtgttcccaagtattattgggcgaccacgtcatactggtgtaatggttgggatgggtcagaaggatgcctatgttggtgatgaagcccagtcaaagaggggtatcctcacattgaagtatcctatagagcatggtatagttagcaattgggatgatatggagaagatttggcatcacacattttacaatgagcttcgtgttgcccctgaagaacaccccgtgcttcttactgaggtacca

SEQ ID NO: 3915 - DNA, 122 bp, Cicer arietinum
ctcgttgtttctcccgctgctccaccactctccgaaccgtttctcctgcaattccttaagctctttcgttctaacaagattttgaaagatggctgatgctgaggatattcaacctcttgttg

SEQ ID NO: 3916 - DNA, 425 bp, Cicer arietinum
gcaatgtcaggtgccggattttctacggtatactcgatcacacaatactgcttggacaccatcggatccctgacagcagatttcagaaaaggaattttggagaggtcaccttctctgagaacacctatgacggatctaatggggacagctctgaaccagaatgcctaagatatcggaggacggtgcccgaggcatctgagagcgacatccttctgatctactatgactattgcgatgggtttttcccctttgaaggcaagccggaccgacggactctgattccttcccaaggtttttcactgccgcctcgagatacgactacgagctacaacttggttactggatattgtggactgcgtcgagagatggagcgatgcgtgagagaattctggtcggtggaaaaagtcgacagtatgcccccgaac

SEQ ID NO: 3917 - DNA, 356 bp, Cicer arietinum
acaagcaaagcacaataatatatcatcaagaaaatgaagacaagcacaagaagtccttgatgatattaattaattaatgaaagaaagcaaaatacccaataaacagacacatccataaaacaacacaatccaagataagaaagacaattgagtattctcaatgagaggttgttgtgtcatccttgtgatgatctttgtcatcaagttcagtagcagtcttaggatgataaccaggaagtttctctttgatcttttccaaaatacctttcttctccttcactgcatcttcactttcatcatgacttgttgtctctgatacaacaacaacaggcggttcctctgttttcttgtgtcct

SEQ ID NO: 3918 - DNA, 403 bp, Cicer arietinum
actattttactaacaacaaataaaatagcatcattaaactgatattatattccaaatggtaacagtaaacacaacctagatgtgcatatgactctctaggaaaagcactttgaaactccaaagatcatctattctacataatggtatgaaggtttcacataaatatatcatccccatgattgtagtatacaaaagctagactacagcaatttgaaacattcgatgcaatgcagcacattataagattatggcagcagccaagaacacaccttctttggctggacagcaaagttaaacagtttttgttttgactccaacctttctccaagaaacaccaggcataatttgctttttgtcgacgcgatttttgtattggacagcaaagttaagcagtgaatcaatg

SEQ ID NO: 3919 - DNA, 277 bp, Cicer arietinum
accgttgttttgtcggtggtctagcctggaccaccgacagtgacgccctagccaaagccttctcttcctacggcgaagttactgattccaaggttattaacgaccgtgagactggaatgtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggata

SEQ ID NO: 3920 - DNA, 436 bp, Cicer arietinum
gatcttcttaccatgatgtgataagggtatctgagattcagaaggtgttggacattactggggttcaaacctacattattaatagtgcaagggttgtgttcttaaatgaaaggccacaacctaggccaggaaaaggtgtcacaaacacttgtgaagtttgtgagcgtagtcttcttgattctttccggttctgttctcttggttgcaagattgtaggaacatctaagaatttccagaagaaaaagaaacattcagcagcaatggcatcagattctgaggaatcatacagtggcaacaacaacatccacagccgtcagatgaaaatcaaatatcaaagcttcacaccatctacaccacccccaacttcagttaattacagaacaaccaagagaagaaagggaataccacatagagccccattaggggggctagttat

SEQ ID NO: 3921 - DNA, 359 bp, Cicer arietinum
gatcttcttaccctgatgtgataagggtatctgagattcagaaggtgttggacattactggggttcaaacctacattattaatagtgcaagggttgtgttcttaaatgaaaggccacaacctaggccaggaaaaggtgtcacaaacacttgtgaagtttgtgagcgtagtcttcttgattctttccggttctgttctcttggttgcaagattgtatgaacatctaagaatttccagaagaaaaagaaacattcagcagcaatggcatcagattctgaggaatcatacagtggcgacaacaacatccacagccgtcagatgaaaatcaaatatcaaagcttcccaccatctacaccaccc

SEQ ID NO: 3922 - DNA, 435 bp, Cicer arietinum
agcagcttgaagatggccgcaccttagctgactacaacatccagaaggagtcaacccttcaccttgtgttgcgtcttcgtggtggtatgcaaatcttcgtgaagaccctcactggtaaaactattacccttgaggtggagagttctgacacaatcgacaacgttaaggccaagatccaggataaggaaggtattcccccagatcagcagaggttgatcttcgccggaaagtagctggaagatggaaggaccctcgctgattacaacatccagaaggagtctacccttcaccttgtgttgcgtcttcgtggtggtatgcagatttttgtgaagaccttgactgggaagacaattacccttgaggtggagagctctgataccattgataatgtgaaggcaaaaattcaggataaagaaggtatcccaccggaccagc

SEQ ID NO: 3923 - DNA, 417 bp, Cicer arietinum; identical to SEQ ID NO: 1996

SEQ ID NO: 3924 - DNA, 135 bp, Cicer arietinum
ggaaccgttgattcgcacaattggtcatcgcgcttggttgaaaagccagtggcgtgaagctaccgtgcgttggattatgactgaacgcctctaagtcacaatccgggctagaagcgatgcgtgtgcccgtcgttc

SEQ ID NO: 3925 - DNA, 182 bp, Cicer arietinum
acctaacccaagagtggagttagaggagcattattacaattgcgaaaacactaaactagttgatcttggactcagaccacactttctttcagattccctcattgattcactgcttaactttgctgtccaatacaaaaatcgcgtcgacgaaaagcaaattatgcctggtgtttcttggagaa

SEQ ID NO: 3926 - DNA, 400 bp, Cicer arietinum
ttgtgaggcaatctgctaagagcattgttgcaaatggacttgcaaggaggtgcattgtgcaagtgtcctatgctattggtgtgcctgagcctttatctgtgtttgttgacacatatggtacagggaagatccctgataaagagatcctcactatcgtgaagaacagctttgatttcaggcccggcatgatctctatcaaccttgatctgaagaggggtgggaatagcaggttcttaaagactgctgcttatggacattttggtagggatgatcctgatttcacatgggaagtggtgaagcctcttaaatgggaaaaggcttaagtcacctctctgtgctcggagttttgaacctttattattgccactataatatctgctaacctctccgtgtacctctc

SEQ ID NO: 3927 - DNA, 265 bp, Cicer arietinum
acagcgttttttcctcgaagaagagggacttgatttcatagaaccgcagccgggcctgattcgtgttgtgatatattgagccaagtgatatgaacaagaagtatacaagtttttgacagtaaaaatccatgaacatagagatgttgtagtcattcttgtatcatgtatatgggaagaaatgctgaaaaaaatgaaaaaaaaaagatctttagaagaaaaaaatggaaaagattagaatgaaagagaagggttgtagtagaattgt

SEQ ID NO: 3928 - DNA, 374 bp, Cicer arietinum
ccgaaacctgttatcaaattgctttggctatcaaggatgaagtagaagaccttgagaagggtggtattggtgttatccaaattgatgaggctgccttgagagaggggctaccactaaggaagtcagagcatgctcactacttggactgggctgttcactccttcagaatcaccaatgttggtgttcaggattccactcagatccacactcacatgtgctactctaacttcaacgacatcattcattccatcattgacatggatgctgatgttatcaccattgagaactcccgttctgatgaaaagcttctgtcagtcttccgtgaaggagtgaagtatggtgctggaattggccctggtgtgtacctgcccggg

SEQ ID NO: 3929 - DNA, 287 bp, Cicer arietinum
accggtttccaggactgcaagaagcagtctcacgagcgtaacgctgcacaactcgagtcggaacgaacccaggttatccggggtgtgtaaatcgaccaacgagagtcatcaccttacatatctatcatggttcggactggagactggcgtcactcctaacatccacaatgcgcattctgacggccacgacgtaatgagattggattccgagacagcatctgcattagatgcatagcgttattcgccggtgtatatttctattcggatagttgagggtgcgttggcgt

SEQ ID NO: 3930 - DNA, 424 bp, Cicer arietinum
accaatgttatcccatttttaaatactttgagaactggtgccaagatgagaataggcatggagatttcttctctgccttgatgaaagcacagccacaatttcttaatgactggaaggcgaagttgtggtctcgattcttctgtctatcggtttatgttacaatgtatctcaatgattgccagcgcacggatttctatgaaggaattgggcttaacacaaaagaatttgacatgcatgtcatcattgagacaaaccgaaccaccgccagaattttcccagctgttcttgatgttgagaacccagaatttaagcgaaagttggaccggatggtggtgataaacgagaagattcttgctgttggtgagagtgatgacaattcattggtgaagaacttaaagaggattccactgattgctgctttggt

SEQ ID NO: 3931 - DNA, 352 bp, Cicer arietinum
caaaacttcgtttctcagatccggatccacgcgccgccatcatggtgaacgttccaaagacgaagaagacatactgcaagagcaaggagtgcaagaagcacacactccacaaagtgactcaatacaagaagggtaaggatagcatcgccgctcaaggtaagcgtcgttacgatcgcaaacagtccggttatggtggtcagactaagcccgtcttccacaagaaggctaaaaccactaagaaaattgttctgaggctgcaatgccaaggttgcaagcatgtttcccaacatgctatcaagaggtgcaagcactttgagattggtggcgacaagaagggcaagggaacttctct

SEQ ID NO: 3932 - DNA, 360 bp, Cicer arietinum
caaaacttcgttttccagatccggatccacgcgccgccatcatggtgaacgttccaaagacgaagaagacatactgcaagagcaaggagtgcaagaagcacacactccacaaagtgactcaatacaagaagggtaaggatagcatcgccgctcaaggtaagcgtcgttacgatcgcaaacagtccggttatggtggtcagactaagcccgtcttccacaagaaggctaaaaccactaagaaaattgttctgaggctgcaatgccaaggttgcaagcatgtttcccaacatgctatcaagaggtgcaagcactttgagattggtggtgacaagaagggcaagggaacttctcttttctagg

SEQ ID NO: 3933 - DNA, 403 bp, Cicer arietinum
caataaacccatataaacttccttaattagaaaccctctaaactcattattaaactttgatttattgctcttataaccttcacagagaaatcttgttttctttgttaatatagttattatgaatgattgaaaaacaacacaaatgtctccagtaatctgtgagatctctggttttatgataaactccactctcagacgcaggacacatttagttcaatctttctctgttgctttcctctattggctctatattttctcatgaactaaccctattttttccaattttctttccaatacaaatctagtttcattctatctatctaatcaatttaactatctaattaaatactaattaccactatctaaatcgccacatcaaagtttttgagtcttaagcgaacag

SEQ ID NO: 3934 - DNA, 201 bp, Cicer arietinum
acacatataatgtataataagaatgtgtgtttgctttgttaaaatgttaaagtggtcacggatctcacctttagcaaattgaaatgttataattagattttgtcgaaggtgatatcacagaattgttgtctttcatgtgtaagcaaatatagctaatatgaatcataattctctgcttcttcaatgaaataaatctttgct

SEQ ID NO: 3935 - DNA, 420 bp, Cicer arietinum
actgcttgtgttgccctcattagaaacaacctactttttgttgcaaatgccggtgattcacgctgtgtaatatctaggaagggtcaggcatacaatttgtctagagatcacaaacctgatcttgagattgagagggatagaatctataaagctggcggttttattcacgcaggacgagttaacggaagtttaaatcttgcaagagctataggtgacgtgtactttaagaacaatagatttttgtctgccgaaaaacaagttgttaccgccaagccagatataaacactgttgacctttgtgacgatgatgaatttttagtgctagcttgtgatggcatatgggattgcttgtcgagccaacaattggtcgattttgtgcgacaagaacttctcatggaaaccaaactttctgaggtttgt

SEQ ID NO: 3936 - DNA, 199 bp, Cicer arietinum
acgtcaacattttctaaacacgaaaataacaataacattcaacttgtttggcttttagatgcgtttcgtggtgtctaaggaactatcctgatgctccaccaagaaaaataacataccgacgaaagtaaaatgcaattttttaaaataaattttacagaccatgggtcatcaaagcatcgataatatatttcaacagggg

SEQ ID NO: 3937 - DNA, 413 bp, Cicer arietinum
cggcgggatgtcctatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacattgtctggtggggagtttggctggggcggcacatctgttaaaagataacgcaggtgtc

SEQ ID NO: 3938 - DNA, 345 bp, Cicer arietinum
accgttgtttcgttggtggtctagcctggaccaccgacagcgacgccccagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggat

SEQ ID NO: 3939 - DNA, 265 bp, Cicer arietinum
accctctgtgccccaccaggcatatcatcgtcctcatcatatgcctcttgctgttgctgatgctgcttcctcctcgtctcctcttccatattgacatcatgaagtgtagtttcctcacactcgtccagctccatatctgtcaactgcgatgaaggtttagctggcaaaacagcttccaaacccttcacctggtcaagactaagagtctcagggaactccactgtaaagtggatgtaaagcttgcccttcatgaatggcctctggt

SEQ ID NO: 3940 - DNA, 423 bp, Cicer arietinum
acatctgagtagttacccctacgtttctgcttatttgattgttctctttttttagatattcaatttggttgttaagatcttccatgtgttgttgtttcttcattcttgatcttcgtgccgattccctattcgattgcattctcttccttttcttttgatccataacatgcacctgttgttgttgaatatctccctctgatccagatccagagttttgaagagagcttgttccagatgaatatgctccaccaggagaagccataggtagttaggttttaaatcgcggtcgcgagttgcgatctttgatttgattgatgcagcctcaattgcagatgcgactgttcgcttaagactcaaaaactttgatgtggcgatttagatagtggtaattagtatttaattagatagttaaattgattagat

SEQ ID NO: 3941 - DNA, 405 bp, Cicer arietinum
accctaccatcctttagtttgacttcttttacctctccatcggagttagtagtgaatccaacagcaacggttcctttaacgatgttgacacccttatttgcataatatccctcatagaacgcagctatttcagaagtaaaaagtctaggcatacaccaaggttctgggtagaccatggtaacatcaacatcattgagtttcaaaactgcactgatctccagaccaatgtatcctcccccaacaaccacagcttttccattcttctttgctttgattgactcatacaatttgtcagcatcatcaacttccctcaaataaaatatatttttggcatcagctccttctacaccgaaatctgtcaaccttataacagttgagccggtggcgatgaccaaagtctggtag

SEQ ID NO: 3942 - DNA, 417 bp, Cicer arietinum
acggacaaggtgactccgactgtttaattaaaacaaagcattgcgatggtccctgcggatgttgacgcaatgtgatttctgcccagtgctctgaatgtcaaagtgaagaaattcagccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttgttttacttattccgtgaatc

SEQ ID NO: 3943 - DNA, 431 bp, Cicer arietinum
acatatatggtggaaatcacaatggtcgttaccttagtgatcttcatgttttggatttgagaagttggacttggtcaaaggtcgaggctaaggctggagatgagtcccctacaactttgaacccttgtgctggccattctttgattgcatggggaaataagctcctgtcaattgctggtcacacaaaagatccttccgaaagtatccaagcaaaagagtttgatctacaaacagcaacatggtcaactctaaagacttatgggaaagctccgatatcacgaggaggccaatcagtgacccttgttgggaatagcttagtaatttttggtgggcaagatgcaaagaggactctattgaatgacctgcatattcttgacttggaaactatgacatgggatgaaattgatgctgttggagcgcctccttccccc

SEQ ID NO: 3944 - DNA, 433 bp, Cicer arietinum
cgcactgttagcgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccccgccgccacgacatacgactacgagctacaacttggttactggagattgtggactgcgtcagcagatgtagcgatgcgtgagagaattctggtcggtggaaaaagtcgacagtatgcccccg

SEQ ID NO: 3945 - DNA, 332 bp, Cicer arietinum
cttttagtatggcattggttatagctgtgttatctattttcagaatgcagaaattagctcaggaacaaaatgaaaagattgaaaaagttaatcgtgaaaggaaatatcatcagcaaaatactgcatatgagcttaatgctttgtcaatgcaatggaaggagctctgtcagaaaaatataggcatcagtgctgcgtgtgcttctgttgaaatttgcctacatgaactgagaagagaagctgcagaaagaggctggaacttggatgctatcactgaaaatggccaattaaatcattccgagtcatgagattcttatgtgcttacgtagttttgt

SEQ ID NO: 3946 - DNA, 400 bp, Cicer arietinum
acaacactgctgttggtaacatcattatcgtcttggctggtgctgtccctggttactgggtgtctgttgccactatcgatacccttggacgaaagactattcagcttggtggtttcatcattctgactattctcttcattgtcatgggtttcgcttacaaccatatctcctccaacggtctcctcgctatttacgtccttgcccagttcttcttcaacttcggccctaacactaccactttcatcgtccctggtgaggtcttccctacccgctaccgatctacctcccatggtatctccgctgcctcaggaaagattggttccatcattggccagggtgccatctccatcctccgcacccacggtgtcaccgacaagaacgaggccccctggatggacca

SEQ ID NO: 3947 - DNA, 274 bp, Cicer arietinum; identical to SEQ ID NO: 986

SEQ ID NO: 3948 - DNA, 343 bp, Cicer arietinum
actgctgacaacattaagtcagacattaattaatgatgaaaattattcactcccgctaagaacagataatctgtaatagaacattttctttttttcagacaagcaacatacatttttaaaaatcacacaattcgaccatcaatattctcaggcatagctctgcattcatgatgaccaccatctattttattaatgccagctttagctaattcttcgtgctttccattgagttttggtgagagctggagagagtgatatctctccgcatccaagtgaggtggatgcttgtcagaatgatggtggcgatgatggtgatgatgaccagaccgtttatgcattgatc

SEQ ID NO: 3949 - DNA, 434 bp, Cicer arietinum
actatatagtatggctctttggtttccacaaacaacggctaaacaacaagccattgatgaacttcaataattactcatccgcctctaatatactatcagaaattagaatctagtaaaaggacgaaaaaatgaacaaacacgagggattggatgtgcaatcaccataaactttttgctctaattcaattgactaactcaatccctgtcaaaggaagcccgtcatgaagttgaagaaccacatcaccaacaaccttagccatggatcgataggaatgttccgtaacgcctgcaatatgaggagtcatgataacgttcttaaatttcaatatctgatcatcgggatcaaacggctcagtccatgcgacatcagtgcctaacccgcctaaatgaccggttttgaggtgttttaccacagcctcatagtctaaaagacg

SEQ ID NO: 3950 - DNA, 418 bp, Cicer arietinum
aggcagtgtatcggttgttctactagtttgctttttggtgattcactctgagttggctcaggctgccatctacactgttggaggtgctggtggttggacctttaacactattgcctggcctaatgggaaaaactttaaagctggtgatacacttgtattcaactatagtccgggtgcacacaatgtggtggcagtgagcaaagcagggtatggtagccgcaagactccaagaggagccaaagtgtatcggtcaggaaaagatcagataaggcttgctagaggacaaaactatttcatctgcaattatgttggtcactgcgagtctggaatgaaaattgccatcaatgctgtttgatttttattattataataataatattgtgtgcttttatctatgtgctttcatcatacctcttgt

SEQ ID NO: 3951 - DNA, 260 bp, Cicer arietinum
  misc_feature (204)..(204): n is a, c, g, or t
actatgaaatccttggtgtttcaaagaacgcttctcaggatgatttgaagaaagcttacaagaaagctgctatcaagaatcatcctgataagggtggtgatcctgagaagttcaaagagctagcacaagcttatgaggttttgagtgatcctgagaagcgtgagatatatgatacatatggcgaggatgctcttaaggaagganatgggtggtggaggtggtggacatgatccatttgacattttctcgtctttctttgg

SEQ ID NO: 3952 - DNA, 249 bp, Cicer arietinum
acttggtcatttcccgaaatctctgcgatttgggactttcttgtgaatggcgaaaatatatatcttggccctagtgtttaagtttttaaatctgtgctggtttggtggaagttggtgttagctttgtaatacatctattccgtttcggattggtatctgcaatttacagatgatttaaagagcgtcctgcatgtgcttagattgtatttattgtggtctaataatggatttctctcgatagtagtttgt

SEQ ID NO: 3953 - DNA, 179 bp, Cicer arietinum
caactatccctgaaaatttcacacctcataaagcagtgaagaggatttatgaacagcgcgcacaaatgattgaaactggggaagatattgactggggatttggagaggcacttgcttttgctacgttgcttgttgaaggtaaccatgttcgattgagtggtcaggatgttgaaagagga

SEQ ID NO: 3954 - DNA, 362 bp, Cicer arietinum
acattggatgaaaacttctatccacataaaaatccatacattcacaagagacaacagagaaatagagtatcctcaacagagaagaggatcacattatcacaatacaagcatctctacaaatttcactcacttagaaacttagttccatcatagggatcgaaccgccagctgccactatctgctgctcaagcctcaataaattttcaagcttattcttgactaggaagtactcttgcttcacctgctgcaaacatctgaggcaagcatctatgttttgttcctcgcagaagttgcgaaaagcaatgcaggagcttttcaccctctgtgcacctatgcttgcactgctacccttaaattggtga

SEQ ID NO: 3955 - DNA, 405 bp, Cicer arietinum
acaaaaacgagaaccacagtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacgtgagtagcgagaaccaccatcaccaccaccatatccacgatctctgctaccaccataaccaccaccacctcctccgccatatccacctccaccaccatatcctccaccgccacctctgttatatccaccttcacgacgtccaccaccatatccaccgcctccaccatatccaccgccaccacggtcgcctccaccaccgctaccacgagactgagcttcgttcacggtaat

SEQ ID NO: 3956 - DNA, 432 bp, Cicer arietinum
ctacgggctatgcgactacacaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaac

SEQ ID NO: 3957 - DNA, 431 bp, Cicer arietinum
accaagattgcttctgaaggactcaaacatcgtgtgtttgagatctcattggctgatcttcaaggtgatgaggataatgctttcaggaagattaggttgagggctgaagatgttcagggcaagaatgtcctcaccaacttttatggtatggatttcaccactgacaagctcaggtctttggtccgtaaatggcaaactctcattgaagctcatgtggatgttaagaccactgataattataccttgagaatgttctgcattggctttaccaagagacgcagtaaccaagtgaagagaacctgttatgctcaatccagccagatcagacagatccgcaggaagatgagggagatcatggttaaccaagcaacatcgtgtgatttgaaggagcttgttcgcaagtttatccctgagatgattggaaaggagat

SEQ ID NO: 3958 - DNA, 380 bp, Cicer arietinum
gagtcgcatgctcccgttcgccatggcggaagcgggaattcgattagcgtggtcgcggccgaggtacaaagcctttggcgtctcttcccaaaggacggggtatcaaattgactgtcattgaggaggctagaaagcggattgctgctcaacaggtggcagctgcttaaatctgattacatatatattgttggacaatttagccatttagattgtttgagactgattttttattttaatccgctggtttccaggggaatggttgtgagaccgatttgtggctaatatgagattagttttgtttttaatgcaacatcacaattttgaactagacatggtgagttcaatttggcaccctttccatgttggacaacatttcttgt

SEQ ID NO: 3959 - DNA, 429 bp, Cicer arietinum
actatgaaatccttggtgtttcaaagaacgcttctcaggatgatttgaagaaagcttacaagaaagctgctatcaagaatcatcctgataagggtggtgatcctgagaagttcaaagagctagcacaagcttatgaggttttgagtgatcctgagaagcgtgagatatatgatacatatggcgaggatgctcttaaggaaggaatgggtggtggaggtggtggacatgatccatttgacattttctcgtctttctttggtgggaatcattttggaggaggtggtggtagccgaggacgaaggcagagacggggtgaagacgtggttcatcctcttaaggtctctttggaggacctttaccttgggacatctaagaagctttctctatcgagaaatgtcttgtgctcaaagtgcagtggcaaaggttcta

SEQ ID NO: 3960 - DNA, 179 bp, Cicer arietinum
ttctcatattaccagcggctactcccacagcctctgcaaaattcccaacctcactccaccatggctgaacagactgagaaggcttttctgaagcaacctaaagtgtttctgtgctctaagaaatctgggaagggaaagaggcctggaaaaggtggaaaccgcttctggaagtctattgg

SEQ ID NO: 3961 - DNA, 160 bp, Cicer arietinum
tccctttcgaacggccgcccgggcaggtactgcttcttttattgtctccaaaagtgcaaactttgttacctcaaaatgctcgtctactacatcgtttttaaaatgggtagcaccaagctttttcaagtttgattctctcacagttactttaccagccttc

SEQ ID NO: 3962 - DNA, 401 bp, Cicer arietinum
ttaaaatcaatacttgaaggccctaacattactgggtcactcactgcttgtgttattcgtgacataacaataacaacttatttgtttctacagaaacatggaagtgggtcagatgcggagacaatgggtggactacatcaaatccttgttcaccgaggagtttttggatggtcaatttctgcaacttcagcagctacaagatgattttaaccctgagtttgttgttgaagtggtttctcttttctttgaagattctgagaggattctcaaagatctctccttttctttggatcagcaaagtgttgacttcaaaaaagttgatgctcatgttcaccaatttaagggtagcagtgcaagcataggttgcacagagggtgaaaaactcctgcattgcttttcgc

SEQ ID NO: 3963 - DNA, 400 bp, Cicer arietinum
acattggatgaaaacttctatccacataaaaatccatacattcacaagagacaacagagaaatagagtatcctcaacagagaagaggatcacattatcacaatacaagcatctctacaaatttcactcacttagaaacttagttccatcatagggatcgaaccgccagctgccactatctgctgctcaagcctcaataaattttccagcttattcttgactaggaagtactcttgcttcacctgctgcaaacatctgaggcaagcatctatgttttgttcctcgcagaagttgcgaaaagcaatgcaggagtttttcaccctctgtgcacctatgcttgcactgctacccttaaattggtgaacatgagcatcaacttttttgaagtcaacactctgctg

SEQ ID NO: 3964 - DNA, 432 bp, Cicer arietinum
accaatgttattccctttttaaatactttgagaactggtgccaagatgagaataggcatggagatttcttctctgccttgatgaaagcacagccacaatttcttaatgactggaaggcgaagttgtggtctcgattcttctgtctatcggtttatgttacaatgtatctcaatgattgccagcgcacggatttctatgaaggaattgggcttaacacaaaagaatttgacatgcatgtcatcattgagacaaaccgaaccaccgccagaattttcccagctgttcttgatgttgagaacccagaatttaagcgaaagttggaccggatggtggtgataaacgagaagattcttgctgttggtgagagtgatgacaattcattggtgaagaacttaaagaggattccactgattgctgctttggtgtctgaac

SEQ ID NO: 3965 - DNA, 435 bp, Cicer arietinum
acgcaatgacgcttgcgagaatcagtgaaatcagagaaaaaggtatgaaagactttgcaattgagaagcttcaatttgaggcagctcagcttgaagttgaagctgctactagtgctctacagaaacttgcagaaatgagtcaacaacttctgaacaaggccatcctgagtgttgaagctgatagctacatcagtgtcatgcaaaacaacaatgattttaaactcgatttgatcacaaatatgaattgcattgactgtttttctgtggtaaaagcaggagctgctcgactctcagcattgaccgagcaacttgtaatggatgcgggtctcgctgctgcaaactagaagatatgttgaaggacgtcgcagagggatattgtatgttgttgttatttttacgggcccaagccattgctaggttagccaggaaaaatgt

SEQ ID NO: 3966 - DNA, 205 bp, Cicer arietinum
  misc_feature (21)..(21): n is a, c, g, or t
  misc_feature (43)..(43): n is a, c, g, or t
gattagcgtgggtcgcggccngaggacgcaatgactttcccanagaatcagtggaaatcagagaaaaaggtatgaaagactttgcaattgagaagcttcaatttgaggcagctcagcttgaagttgaagctgctactagtgctctacagaaacttgcagaaatgagtcaacaacttctgaacaaggccatcctgagtgttgaagc

SEQ ID NO: 3967 - DNA, 427 bp, Cicer arietinum
actaaggcgaaagaagccatggataagggagagcttgtttctgatgacttggttgttggcattattgatgaggccatgaagaaaccatcatgtcaaaaaggtttcatcctggatggttttccaagaactgtggttcaagcacagaagcttgacgaaatgctggaaaagcagggtgctaaaattgacaaggtgctcaattttgcaattgatgatgcaatccttgaggagaggattactggacgctggatacacccatccagtggcagaacctaccatacaaagtttgctccttccaaggttcctggggttgatgatgttactggtgaaccccttatccagcgcaaggatgacactgcagctgttcttaagtcgagactggatgcatttcacaggcagactgaaccggttattgattactattcaaaga

SEQ ID NO: 3968 - DNA, 340 bp, Cicer arietinum
ctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttc

SEQ ID NO: 3969 - DNA, 111 bp, Cicer arietinum
tcgcatgctccttcccgccatggcgaacgcgggaattcgattagcgtggtcgcggccgaggtactgttgcacaaatgggttctgtgtctcgagtcattggcatgattcctg

SEQ ID NO: 3970 - DNA, 396 bp, Cicer arietinum
gaaagtcacggtggaccgcccgattgtattcttctctgcagacttcgtgagctaatacttagagaattgggattcatagatatcttcaaaaaagtcaaggatgaagaaaatgaaaaagccatctccctatttgagaatgttgttcgagctaatgacgccattgaagatgaaggcaagcgaattgagaatctagttagggacatttttgcaggaaacatatttgatcttggttctgcacagcttgcagaggttttctctaaggatggaatgtcctttttggctagttgtcaaaatctcgttcctcgaccttgggttatcgacgatctcgacactttcaaagtgaaatggagcaagaagtcatggaaaaaggttatcatatttgtagataactctggt

SEQ ID NO: 3971 - DNA, 403 bp, Cicer arietinum
gaaagtcacggtggaccgcccgattgtattcttctctgcagacttcgtgagctaatacttagagaattgggattcatagatatcttcaaaaaagtcaaggatgaagaaaatgaaaaagccatctccctatttgagaatgttgttcgagctaatgacgccattgaagatgaaggcaagcgaattgagaatctagttagggacatttttgcaggaaacatatttgatcttggttctgcacagcttgcagaggttttctctaaggatggaatgtcctttttggctagttgtcaaaatctcgttcctcgaccttgggttatcgacgatctcgacactttcaaagtgaaatggagcaagaagtcatggaaaaaggttatcatatttgtagataactctggtgctgata

SEQ ID NO: 3972 - DNA, 351 bp, Cicer arietinum
acctctgtagagtttcccaaaagctccttgagcaaaagcctcgcccatatttagcttcctcaaatcaattgtccactcatcaaaattttcaagcccctcagtaggagaattattgtccatcagagcttgagctaaagcatcgtcactcaatgcatgtgtgactcttcctctacgattgacactgtgtgcaacagagtagttatcattggcacgcctcttcaacccttggtggtccaacatgcgggtatgggaatcattggacccaacactgctgttatcaatagacattgcaaccgatcctccaccattgcttgtttgcaagctaccaacgctgtcgattgacatattggt

SEQ ID NO: 3973 - DNA, 326 bp, Cicer arietinum
cgggcaggtacaaaaacgagaaccacagtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacttgagtagcgagaaccaccatcaccaccaccatatccacgatctctgctaccaccataaccaccaccacctcctccgccatatccacctccaccaccatatcctccaccgccacctctgttatatccaccttcacgacgtccac

SEQ ID NO: 3974 - DNA, 427 bp, Cicer arietinum
aaccaattatacgttccccttatccaaggggatactataggtgtagcagttcaaagagttgtccggcgagaaaacaagtggaaaggaaccatgtggaccccactgtgctccttgtaacatactcctccgatcacaaccacgccgtgccgcttcctagaaaccaccgcaacaataacaacgaatctgctaaatcaaacaaggattccgaatcggaacacgaacccgaaccagaggagagatttacggatcttggagaggaatctctgatcgccgtcgcggatgagttaggaggatggttgggagaagtggaatggataaggaactgtgagagaatggaacttgaaaaaacttggtgctacccattttaaaaacgatgtagtagacgagcattttgaggtaacaaagtttgcacttttggagacaataa

SEQ ID NO: 3975 - DNA, 411 bp, Cicer arietinum
atcagctttctatctggaagtcgaaatggaaggatcaactatggatattccagtttcaagggtaaaagatcttcaatggaggatttctttgagaccaaaatatcagaggttgatggtcaaatggttgccttttttggtgtttttgatggccatggaggttcgcggactgcagaatacctgaaaaataatttattcaagaatttgagtaaccatcctggctttatcaaagacacaaagacggctatttttgaagcatttaaacaaacagatgtcgattacctcaatgaggaaaaggggcatcaaagggatgctgggtccactgcatcgacagcggtgttgttgggcgaccgaattcttgttgcaaatgttggtgattcccgagtagttgcatctagagctggtttagctgtt

SEQ ID NO: 3976 - DNA, 128 bp, Cicer arietinum
actttgaggagccaagaaattcgtaaggttcttaatgttatggctaaaagtgctcaaactcaagagtcacttaatgtgacagaggaacttttgaaatggacaaatagcactatttctaggatgatgtt

SEQ ID NO: 3977 - DNA, 404 bp, Cicer arietinum
tacgagagtaataaatgttgatgttggagattctgaagtggaagagtataaaaaggccaccaaattaaacacgagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcagaaaactattgttaatatgccttcatcaccatatcaatcaacattagatg

SEQ ID NO: 3978 - DNA, 404 bp, Cicer arietinum
actccctactactacaaatcccctccaccaccaacgtcgtctcctccacctccttaccattatgtgagtcctcccccacctataaaatctcctccacctccataccactacacatcaccacctcctccatccccatctccggctcccacatacatttacaaatcacctccccctccagtgaaatcaccgccaccaccagtttacatttatgcttccccgccaccaccaatctacaagtaagctgggaattcgaaagtactgttccctataaatcatgttttagttttcatcaaggaataaatgcaacctccatttggaacagagtgaaacatttagcttcctgcccaagttctttcaataaaagtctgaatgtatcatctcagagctatatttgtgattcagac

SEQ ID NO: 3979 - DNA, 249 bp, Cicer arietinum
tgttcgcggccgaggtacactcttccctacctgattgaacttatgttctcagacaccattcggggctgggatctaactctcctcaattctccatcatggaatattcatcctgtttacagcagcaacattattgtgcaaggaatcactattattgctcctgtctcatctcctaatacagatggtatcaacccagactcttgcacaaatacaagaattgaagattgtttatatagtttctggggatgactg

SEQ ID NO: 3980 - DNA, 257 bp, Cicer arietinum
acacgtattacctcatcaaattataatccattaattgggtggatgcatggagctcagatggttgcatttaacatgcaggggtatgggagatctctttggttgatgcagggaatgtttaaagccaatggaaggtgtggttttgttaaaaaaccagattttctattaaagactggtcccaataatgaggtttttgatcctaaagctcctttgcctgtgaaaactactttgaaggtgactgtgtatataggagaaggatg

SEQ ID NO: 3981 - DNA, 185 bp, Cicer arietinum
acccctcaccggatgagctggtgctccatatgattagataatactcacttcgcataagtagtatatctccatcattcaattgattgattattttctgtagaataattgtgtatattggaattatctgattatgatagatgtggattatcgttaatttaattgatgagtttttttttttattaatt

SEQ ID NO: 3982 - DNA, 408 bp, Cicer arietinum
acccttaaggcatggtctggaaaaggagagaatgtgaagaatgcacaagatgctttgttgacaagggctaaggctaattcagaagctactcttggaacttacaagggtaactctcaacttggtgaaggtgcctcagagagtctccatgttaaggactacaagtattgatcaaagttggtgcatcccttaaagagggtaggtttggtatttaagggtataacaactgaacattgtgagggttgaattttcttgttattgagtattgtggaataattgcttggagtttttctttttgttttctctctgtttgtttgatcatagctttagtctatttggtcaaaacccgagcaaaagggtggacataagacactattctaagtcaggttatttgcttattttgcacttatc

SEQ ID NO: 3983 - DNA, 361 bp, Cicer arietinum
tagcattaaccccgaaatcgaaaaatgagaaagttcgatccatggcccgttttcttcaagcgagaatggaaacgtaactggccattcctcgttggattcgcagtcaccggagctgttatcaccaagttatctcttggctttaccgaggaagatgctaagaattcgaaattcgttcaggcgcacaagaggtaatttcggaatggggacactgcactggccttgcacctcatgttagttgtgtcaagattactcgtcttgattttttgcattgtaataacagaagagagatattctatatactccctctatcatcatattattattttcagttttggtcctttacctaaatctgcttgaaaag

SEQ ID NO: 3984 - DNA, 420 bp, Cicer arietinum
ccgataaccaggccggcgttgagttcgacgaccaaatcacccttactgctagcttcgaccacaaggtcgttgacggtgccgtcggtgctgagtggctcaaggagctcaagcaggttcttgagaaccctcttgagcttcttctgtagatcaggggtaggacgtcaagtggcccctgaaaaccgaattatgctgggaaagacgaaatggctggtcgagcgaggaatgacttttttatagaacaggaggagatgacctctgagggacggagatgcggtaaggagtttacttgggatatcgtggggacacccatgagagcattcctgggtaaggatcggtgaatcacgacgatgatgagcatctatgaggacacccacagagcttcttcgcctgatcacgccgcagcattcgtggaagatttac

SEQ ID NO: 3985 - DNA, 191 bp, Cicer arietinum
gttattcatatcttatttctaacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatg

SEQ ID NO: 3986 - DNA, 422 bp, Cicer arietinum
ggatggccttgggcggagcaatgtggaaaacaagctggtggtgcgttgtgccccggtggattatgctgcagcaaatttggttggtgtggttcaaccagtgactattgcggtgatggttgccagagtcaatgtggaagcggtggtggtggtgttggtagcatcatatcgagggacaccttcaaccagatgctgaagcatcgagacgatagtggttgtgaggggaaaggattctacacctacgaagctttcattgcagctgctaagtatttccctgatttgggtaataacggagatactgcaactaagaaaagagagattgcggctttcttgggacaaacatctcacgaaacgacaggtggatggtcaagtgcacctgatggtccatacgcttggggatattgtcttttgagagaacagaaccc

SEQ ID NO: 3987 - DNA, 167 bp, Cicer arietinum
caagttcttgtcacatctgaaggctttatgaacactttgatgctcgactacctgttttttattttgtaacgttggaatgtcaaactcgctgtgtggtatatatgcaacaaagaatcaaaatgtgcggcgcctgtgtaggtgtaaacttattgcaatgtctttcgttc

SEQ ID NO: 3988 - DNA, 420 bp, Cicer arietinum
tgtatgatcaatatggtgaagatgcccttaaagaaggaatgggaggaggaagttcatttcataatccatttgatatatttgaatcattctttggtggagcaggctttggtggtggcggtccttcacggggaagaagacagaagcaaggagaagatgtggtgcattctttgaaggtttccttggaggatgtttacaatggcactacaaagaaactatctctttctagaaatgtgctgtgcccaaaatgtaaagggaagggttcgaaaagtggaacagctggaaggtgttttggatgccagggcacaggtatgaagattaccagaaggcaaattggactgggcatgattcagcaaatgcaacacgtctgtcctgaatgcaaaggaactggtgaggtcattagtgagagagatagatgccctc

SEQ ID NO: 3989 - DNA, 342 bp, Cicer arietinum
acttgaaggtgttcaagtctgcagaccctgcttggttttatcttcatgttacctgccaaacagctgcttacatagttggtgttgctggatggggaactggtctcaaactcggcagcgactcgcctggcgttacatattcaactcatagaacactcgggatcgtcctcttctgccttggaacccttcaggttttcgctctgctactaaggccaaacaaagatcacaaaaccagattctactggaatctttaccattggggaatcggatacgccactataatcatcagcatcgtcaacatctttaaagggttcagtgcattggaggtgtcagcaggtgatcggt

SEQ ID NO: 3990 - DNA, 326 bp, Cicer arietinum
acttgaaggtgttcaagtctgcagaccctgcttggttttatcttcatgttacctgccaaacagctgcttacatagttggtgttgctggatggggaactggtctcaaactcggcagcgactcgcctggcgttacatattcaactcatagaacactcgggatcgtcctcttctgccttggaacccttcaggttttcgctctgctactaaggccaaacaaagatcacaaaaccagattctactggaatctttaccattggggaatcggatacgccactataatcatcagcatcgtcaacatctttaaagggttcagtgcattggaggtg

SEQ ID NO: 3991 - DNA, 430 bp, Cicer arietinum
ggccacctcaattgtagctcctgctactctctacaaagctctagttacagatgctgacaaccttactccaaaggttattgatgccattaagagtgttgaaattgttgaaggaaatggtggccctggaaccatcaagaaattcaccttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttg

SEQ ID NO: 3992 - DNA, 206 bp, Cicer arietinum
actttctgctaatgacggttccgtttctaaccactacgaagctgttgtttgggagaaggtatggctgcgctttaggaacctcacttcctttgttcaagttcatgcttaaattcttaaatgttgcttattatttcatcttataatagcatcattcctctgtatgacttattgttataccataaataaaagtttatgctatgttctag

SEQ ID NO: 3993 - DNA, 206 bp, Cicer arietinum
ctagaacatagcataaacttttatttatggtataacaataagtcatacagaggaatgatgctattataagatgaaataataagcaacatttaagaatttaagcatgaacttgaacaaaggaagtgaggttcctaaagcgcagccataccttctcccaaacaacagcttcgtagtggttagaaacggaaccgtcattagcagaaagt

SEQ ID NO: 3994 - DNA, 418 bp, Cicer arietinum
acattcttcaacagactttcccctgttgtggaccccacaatggacaaaactttagcaaaaaaccttaaatcgacttgtcctaatgcaaattcaggtaatgttgcgaatttagacattagaacaccgacagtgtttgataacaaatattatcttgatttgatgaataaacaaggtttgtttacatctgatcaagatttgattaatgataagaggacaaaagggttggttaatgactttgctgttaatcagaatttgttctttgagaagtttgttgatgcttttttaaaggttagtcagttggatgttttgactggaaatcaaggtgaaattcgtgctaaatgtaatgtggtaaatagtaagaaatctgttttggaagatttggttgaagaggggatgagattaattaatcagttttaat

SEQ ID NO: 3995 - DNA, 428 bp, Cicer arietinum
acttactcgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccactttgtgcaacacaaacttggtttc

SEQ ID NO: 3996 - DNA, 426 bp, Cicer arietinum
acataaaacttgaatcagcaacaaaatgcagcagggaggaggatccgacacggaagtcacatgggaggaccagcagaacatcaacaaattcggaaggttgaataatcgcttacacgagctaaacgatgagatcaaattcgccaaggaaacaaatgataatttagaggatgcaagcaatgagctgattctcacagatgaagaggtcgttcggtttcaaataggggaggtttttgctcatgtgcctaaggatgaagttgagaacaggatagaacagatgcaagaggtgacaagccagaaattggcaaagcttgaagaagagaaagcaaccgtggtcgctcagatgtctgaactgaagaaaattttgtatgggaaattcaaagactctatcaatcttgaggaggattagtaacttgttgatagatttct

SEQ ID NO: 3997 - DNA, 344 bp, Cicer arietinum
cgagcagccccatgaagaggagcctgagacctaccacatccgaaccctcaccgcggttctcggcagtgaggaggctgcaaaggaggctttgttgtatagttacaagtcggctgctagtggtttctctgctaagcttactcctgaccaggttgctcaaatttcaaagcaaccaggtgttcttcaagttgttccaagccagaaacttcagctccattcaggaccaaataagctgctctagagaatctatcttcatttgaagacgtatgtgtatgtgattgtgggtccaaactgttaactacatcatgtattaataaataaacttactcaaaaagaataaaatccgt

SEQ ID NO: 3998 - DNA, 217 bp, Cicer arietinum
acaagattacccctggatgctgcccgccagatcgtcgccaaggagggtgttaagtctctcttctagggtgctggtgccaacattctccgtggtgttgccggtgctggtgtcctctccatctacgatcagctccaggtcctcctcttcggcaaggccttcaaataagcgctttgtataacataccctgtatagacgagtgtgtgggggataaggaatt

SEQ ID NO: 3999 - DNA, 404 bp, Cicer arietinum
acacgaacaagaaccagaaagccataacaaaacagataccataacagagactactagatcccaccatctaaaatctcaactaaacataattaaccataaaaacttcatcacgagacttagcttacaaaactactctctccagtttccaccaccaccgccaccgccgctgccacgtgagtaacgggaaccaccatcaccacctccgccaccgtatccacggtccctaccaccaccataaccacctccaccaccatagcctccaccaccaccactgcttcggttgtatccaccttcacgacgacctccaccgtaaccacctcctccaccgccacttgaacggttttgagcttcgttaacagtaatgttacgtccgtccatgtcctgtccgttcattccttcaatag

SEQ ID NO: 4000 - DNA, 318 bp, Cicer arietinum
acctttgcctcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtg

SEQ ID NO: 4001 - DNA, 110 bp, Cicer arietinum
aagatcaggagcgatccgagacagaactactctttcatcatgttggtttaccaggatctccttaccggtgatgagcttctctcagactctttcccatacaaagaacttgc

SEQ ID NO: 4002 - DNA, 175 bp, Cicer arietinum
acagcaaacgctcgagcatgtatacggctccgatccaagaggccttgcagatgatccgagcgagaatcagcacggcagcgattgtagatagtttagctcagcacgtcctgtgttccaataggagacttttcggggccaatggccccccggacgaaaaatatacataacatttctt

SEQ ID NO: 4003 - DNA, 430 bp, Cicer arietinum
actgaccaggggaatccgactgtttaattaaaataaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgc

SEQ ID NO: 4004 - DNA, 311 bp, Cicer arietinum
actgtcctaggttgcagctactgacgatcttaggggatcatggacttcctgcctcagggtatggaaagctacttgatttatccgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctatgagtagagaggtgcctcttgggggtaatgagt

SEQ ID NO: 4005 - DNA, 427 bp, Cicer arietinum
acacctagccgtgatcttgggttctctgccaaggacggtatctacttcgacaagctaccggaactcggtccctcgccacttgttagcaaggaagaggtggactactacgccaaagaatatgcctcgaaagaaccccctgagctgcgtggccctctaaactattaccgcatgcaggagctcaaccaccgcgacgatgcagaggtagtcaagaagggtggccacaagttcgagatgccagctttgttcatcactgcaactgacgattcggctctcccaccgtctatgtccaagggaatggactcagcctttaccaacttaactcgggaggaagtcaaagcgtctcactgggcgttatggcaggcttctgaggccgtgaaccaacatatcacgaaatggcttgatgtggtgctggatggtgccttgaagg

SEQ ID NO: 4006 - DNA, 342 bp, Cicer arietinum
acaaagccttcctcggagagatcttcacaatgactgatctcggacccgccaaacacttcctcggcgtaagaataacccgcgacaggaacgcaaggctaatctatctttcccaggatgcatatttcaatagaatactgaagagattcggcttagaaaactgccgaccggtcaagacccccatggagcgaaattcgctctcgacactgctaccaatagacgatggctactcggcttctccagaagagcgagaagactatagctcgaaaaccggctcactcatgtacggaatgacccagacaaggcctgacttagcatttctgctctcgatactctcaagataca

SEQ ID NO: 4007 - DNA, 428 bp, Cicer arietinum
gacaatcttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtggtggtcttttcaaggcacttgagggttattgtttggccaatcctaattacaattaagtgctcttattatacctggtgtgttgttttgt

SEQ ID NO: 4008 - DNA, 254 bp, Cicer arietinum
actatgatgaagcccttgtgtcacaggagaggcaagaactcggccgcgagctaagaagtgagctcttgacagctgaaaagtttgtgctggtgattagtggacatgagaaacttcagcagaataataggagcttgaggaggctggttgagaatagacttccatttctcaatcctatgaacctggtgcaggtggagatactgaagagggtaaggcccgatgatcacaaccttaaactcagggatgctttgcttatt

SEQ ID NO: 4009 - DNA, 423 bp, Cicer arietinum
actatgcccatagattatgaaaaatcagaatatttacaatgaacgcaagaaatttgatgctggcaggcaacacataagcacaagaactaagctataagaaacatagtaggtgttggtgaatactaataaccaagcaattaagcaaagagaaataagatagatttaattaaacacttagattggtaaatcacatgacagcacaggcggctgggttctcgtcgctgaaagcggtggtgtagcggacttcggtggagcttgcacgcgctagatttggatactgagactcaccgtatgtattccgaacgtaacctgaaggggctttcctatcgtaaacaccttgtgcgtagggatgagcaacggcgtcgtatgggatatatggccatatctctgccctcttcccagtgcggtgagcgatacgcgcca

SEQ ID NO: 4010 - DNA, 406 bp, Cicer arietinum
tggctttggatgatcatggaaagaatgaaagttgggaatgccaagctagaagaaattgatatgcttcaggagttgactaagccaattgaaggtcacacaatctgtgccttgggtgatgctgctgcatggccagtgcagggacttatcaggcatttcaggcccgagcttgagagaaggattagagagaatgcacaaagggagctgctgcaggcctctggttaggcctagactaaggggtgtgactgtactggtggatagcacaaatcaaaataaggcagtgccagttatcatttaggaaagatgagtggctcaagttgctgtggatttattgctacttttatttgtttttatgctgtagcaattatggctggaccatatcagagaaaccttctgggaggatttaaac

SEQ ID NO: 4011 - DNA, 427 bp, Cicer arietinum
acttgcatgaccaatatgctggtgattacctcctccatgaggatgctcaacaggattcatagcaacaccacgaaccttaggccagcagtttctcttaaccctaaacttgtggtaagcattaccagctttcaaaagtggcttctcagttcttcctccaccagcaacttgcccaatcattgccctacattcacttggcacaaccttcttggcaccagaaggaagcttgatcctagatgtatcattatcagggttgtgactgataacaatagcgtaatcaccagaggctctagcaaaagcaccacggtcaccaacatgatgctcgacattacaaataacagcaccttcagggatagaacggagaggaagaacattaccaacaacgagagtcgcttttttaccgcagtaaatgaattgaccggtgtataaa

SEQ ID NO: 4012 - DNA, 420 bp, Cicer arietinum
tatggaaagaaaaccagttggaaggaaagcaagttttattaccaaaccaatgtggaggaatatttttggtcaaagtttgtatcaactaattgtccttgcagttctcaatcttgatggcaagaggttactgggactaagtggctcagatgcaactgctgtgctcaacactttgattttcaactcctttgtattttgccaggtgttcaatgagataaacagcagagaaattgaaaagataaacatattcaaaggcatatttgacagctggatatttttaagtgttattctctccacagcagtatttcaagtaatcattgttgagttcttgggaacatttgcaagcacagtgcctctaacatggcaattctggttactcagtgtgttatttggtgcacttagcatgcctattgctgctatcct

SEQ ID NO: 4013 - DNA, 438 bp, Cicer arietinum
tatggaaagaaaaccagttggaaggaaagcaagttttattaccaaaccaatgtggaggaatatttttggtcaaagtttgtatcaactaattgtccttgcagttctcaatcttgatggcaagaggttactgggactaagtggctcagatgcaactgctgtgctcaacactttgattttcaactcctttgtattttgccaggtgttcaatgagataaacagcagagaaattgaaaagataaacatattcaaaggcatatttgacagctggatatttttaagtgttattctctccacagcagtatttcaagtaatcattgttgagttcttgggaacatttgcaagcacagtgcctctaacatggcaattctggttactcagtgtgttatttggtgcacttagcatgcctattgctgctatcctcaagtgcattccagttga

SEQ ID NO: 4014 - DNA, 420 bp, Cicer arietinum
actacttttactacccttcttttctttctcctaataataactttcctttcaattgcaatttcaacaccaacaaatttcatcaaatcatcatgtagcacaacacaatacccaacactttgtgttgaatcactttctacctatgcatcaacaattcaacaagaccctcatcaattagtccaaacagctatatcaataagcctcaacaaaacccaatccactaaagattttgttacaaggtgcaaaaatatcaagggtcttaaagcaagagaatatgctgccttacatgatcgtagtgaagaaattagtgatagtgttgataggcttatccgttcattaaaagagcttaaaatttgcaagatcaaaggtgaggatttcaattggcatataagtaatgttgagacatgggttagctcagctttg

SEQ ID NO: 4015 - DNA, 400 bp, Cicer arietinum
acagtgtgaagcaaaacaaaagctgttttcacacacaacatttatttcattacaaaactataaattaactttgaactttcaaggaagtaatattaatgaaaaagcatttcattacctatgtagaacaatgtcaagaagttggcccaactaccaacaatagacaaaacccataatccagcaatcaccgagagaaactttttgagatcctttccagaagcaatatcccttaatacagcaaaaacccggttgatctcaattctaagagcagcggcaatctgtaaaacaggttcctcaggaatgtgcacttgtgggatctttggtggtgccttgttgatgaaagtggatgcatttgaccataagaacaatacagccagagcaagtatcgctaagtggcaaacca

SEQ ID NO: 4016 - DNA, 407 bp, Cicer arietinum
accaaggatgatctgaagcttcccacagatgacgccctgcttactcagattaaagaggggtttgctgaaggaaaagatcttgtcgtttctgtcatgtccgcaatgggagaagaacagatatgttccttgaaggacattggtcctaaaaattaaaatgttgctctggttgtggctatggacgatggcacaaattttcttcttatgtttcttcttatgttgctaacaggtagtattttttcttatgcatgtatgcaaaataaacttgaaaaaatgcaaactgccttgagcttgaacctcataaagcttgagatggggaaactggcaccatatttagctttcgtccttttaattattgaaccctgcggttttggccggatgaatttatcataaatgttccttttaacttt

SEQ ID NO: 4017 - DNA, 391 bp, Cicer arietinum
agaatatggccaccttggagaaaaaaggtttcacagaagagcaagaagctctggtagttaagtcatggacagcaatgaagaagaatactgcagagcttagtctcaaatttttcttgaaaatatttgaaattgctccatcagctcagaaactgttctcattcttgaaagattcaaaagttcctttggaccaaaatcccaagctcaagccacatgccatgtctgtctttctcatgacatgtgaatcagcaatccaactgcggaaggctggtaaagtaactgtgagagaatcaaacttgaaaaaacttggtgctacccattttaaaaacggtgtagtagacgagcattttgaggtaacaaagtttgcacttttggggacaataaaagaagcagt

SEQ ID NO: 4018 - DNA, 424 bp, Cicer arietinum
acagagcttacctggagaccgtggaatgaggcgactacctcgtccacagagcagcgttctaaccgtcttggggttttctcctgcaagggttttccccaaggatgcacggttctagggttgcagctactggcgatcttaggggatcatggacttcctgcctcagggtatggaaagctacttgatctatgtgtgcaagagaattctaggctggagaggaatagttcccgctgacgggatgacctcttgaaagtaaagcgcctttgtgccgatgatatgctggatgaactagatggaatcgcagttgcatggggatatgtcctgaatcacctgctttgacatccaagatgatgtgcttgaacctaccgtagggctggctacgagtaggaaggtgccctcgggggaaggagctcgagaggctctccgt

SEQ ID NO: 4019 - DNA, 386 bp, Cicer arietinum
acattgttgggtgctggggaggatttatatgcgctttttgctggagttctaacaatgagaccttggaatagagttgttgacccatccatggatcatttagttatacagggaagtgagagtgaccgttcagaactgcagatgtatgcttctgaatatttccatgaaatctcggagcttctaaggagattaccacgtgtgattcttctaatgatgaagacaaacgactgtttacgggcagtcaacaatacgctgttacagggatcatctctggagacatttttaatcactggaaaggtttcttctgaggctgtcattgaagcaaaaatgtcacaaagcaaatcacttttaacttggcttaacgtgaaattggataagattttgctgga

SEQ ID NO: 4020 - DNA, 356 bp, Cicer arietinum; identical to SEQ ID NO: 1353

SEQ ID NO: 4021 - DNA, 420 bp, Cicer arietinum
acaacctctacaccaagatcacaggtggtcagcgtatcgacttgtttggtgcccagaagcaggaccttctcgacatctggggccagcttgttgctggtggtatggagtccggtcatgcttatgccaagtctctgcgaaccgtcaagagttgcgttggttctacatggtgtcgattcggtctgagtgacagtgttggtatggccgttcgtctggaggagcgatacaagagtattcgagctcctcataagatcaagggtggtgtgagtggttgtgtgcgagagtgtgctgaagctcaaggcaaagatttcggtttgattgccactgagaagggctggaacatcttcgttggcggtaacggtggtgcgaaccctcgccatgccgagcttctagccaaggatgtgcccccagctgatgtcgtga

SEQ ID NO: 4022 - DNA, 270 bp, Cicer arietinum
ttttttttcgagaaagtttactgaacctattcgaagactaattatgcatatatatataaccaacttcatagatggacaagacagaacagcaaataattactcagagtccacttctaaggacaccttccgagctaggtcgtaagataatttcaataacgtctttatgcccgtcatggtcgcttgtctgggcgtagaatttttgagctttggcatagtcctccgggtcgttgagcttgtagctcaatgcatcttcttcaatgctccgaagta

SEQ ID NO: 4023 - DNA, 409 bp, Cicer arietinum
ctttaacaaactcaacaaacaaccataacaatttcatttcctttacttcaaaaaaaaaaaaaaacgataaacgctaaacgcaaacgcacttaatcactatgcaaaccgtttcggtttcacctcgcagcgaggtttctggaaagttcgaaaatgatttttttgaaaaacttaaaatcgaagatgaaaatgtagaaaacgaagttaagcacgatgaggtagaagaggaatacgacgaagaagaagagtttaccttcgttttcgcagatcctaatggctcgccgatttccgctgacgatgtgttcgatcacggtcagatacgtccgatttttcctattttcggacaggatctaatgttcaccgacgagtatgacagcgaatctggtaaccgctcgtcagtgaagaagatctt

SEQ ID NO: 4024 - DNA, 226 bp, Cicer arietinum
actgttggactctcaggtggtcacataaatccagcggtgacatttgggttatttttggcgaggaagttgtcattgaccagggcactgttctacatggtgatgcaagtgttgggtgctatttgtggtgctggtgttgtgaaagggtttgaaggaaaaacaagatttggtgatcttaaaggtggtgtcgactttgtgaaccctggttacaccaaaggtgatggacttg

SEQ ID NO: 4025 - DNA, 399 bp, Cicer arietinum
gctgatagtatcaacaataatgttggtcaaagaagtgacaacataaacagcttccgtcatcaagactctgtcaacaatttctctgttagctggccaatggcagttactggacaaaatgcagcaacccctcagtttgccatgctctataatgggagtatgtgtgtatatgatggaattcctgctgaaaaggtgcatgaaataatgatgatggcttctgctaatgccaagtcttctgaaatgaaaagtggaattcccttcacttctctcatttccactagcccttcttctccacaaggaggaacctctaataatttggcttctcttcaatcagtctcttttcctgttgagaagagttccatttgcaggattcaagaatttccaataactcgcagacaatca

SEQ ID NO: 4026 - DNA, 248 bp, Cicer arietinum
catatacaacactaccaaatcaaatcaatggccactatcgccggtcaacatgttcgtgctcccccgttgacttcaacttccgaacaaccacctcttttcgatggaaccaccaggttgtataccaggtatagttgcccttttgcacaacgtgtatggatcactaggaactactaggggttacaagagaagatcaaattggttcctattgaccttcaaaacaggtctgcttggtataaggaaaaagtata

SEQ ID NO: 4027 - DNA, 102 bp, Cicer arietinum
acattatttaattgccttgtttttcttaacaaagaaaaagaaggataaaaataaaaatataaaataagaacccattggtcacctttataaaaaaaaactact

SEQ ID NO: 4028 - DNA, 354 bp, Cicer arietinum
accattctcgctccgccactgcccgtcgtggtgccatcgactggagcccccgcttcaaggacgccctgaagcccgtcttcaactccctctacgacgccgtcaaggatggttccgagaccaagcgatctctcgagtacaacacccagcctgactaccgtgagaagtacgaggcagagatgaaggagatccgtgatctcgagatctggcgcgccggcaaggccgtccgatctctccgacccgagaaccagaagtaagcggctattaatgttgaatgataatttgtgagcgggagatggacatgggatgggatgcctaggaaacggcttttatgaaccacatgaactttctgtctgt

SEQ ID NO: 4029 - DNA, 432 bp, Cicer arietinum
acatacatatacctacccatacagaagaaaagtattttttttacagaaaaaacaaaagaagcaaattatatattgtcttctccagcggttgattttggtttcttcactatcaaaacagggcacttcacattctgtgcgcagtgattgctcacgcttccaaggaaagccctcttgatgacaccatagccgtgacttcccatgaccaaaatatcaacacccaatttttgaaccgcatgacatatcacgtccctcggatcgccattctctatcttggtctccacattttggaggtctttacaaactctcttggctttctccaagacacaatcggcaacttgttggctatacttctccatggttgcagttatgtcagatgaaaaaaggtatcctgtgccatcaaaggccgaataaacggcacgagggggcttaaca

SEQ ID NO: 4030 - DNA, 344 bp, Cicer arietinum
aagatcaggagcgatccgagacagaactactctttcatcatgttggtttaccaggatctccttaccggtgatgagcttctctcagactctttcccatacaaagaacttgcgaatggagtcttgtgggaagttgaggggaagtgggatgatcacgaacacgacgaatcaaagggtgaatctttgttagacaagatttcagggaaaatccacgacttttattcttcgtcttcatcggattccgataacgagaaaaagaatccatccccttctactctcaagtcaaaggttttcaggcttttcggaagggaaaaaccacttcacaatgttcttggtggaggaaaacc

SEQ ID NO: 4031 - DNA, 429 bp, Cicer arietinum
acttttgctagagctgctgttcctagcggtgcatccactgggatttacgaggcccttgagttaagagatggaggatctgactatcttggcaaaggtgtatcaaaggctgttgacaatgtgaacagcatcatcgccccggcattgattggaaaggatccaactcagcagacagaaattgacaaccttatggttcagcagcttgatggaactgttaacgagtggggttggtgcaaacaaaagcttggggcaaatgccatattggcagtgtcgcttgcagtgtgcaaagccggtgctagtgtcctaaaaattccactttacaagcatattgcaaacatcgctggcaacaaaaacttggttttgcctgttcccgcattcaatgtcattaacggtggatcacatgcaggaaacaaacttgccatgcaggagttt

SEQ ID NO: 4032 - DNA, 260 bp, Cicer arietinum
acaaaagtacctttttccattttacacttacattcttatcttagcaatagcattgtaaacaaaggatttaaatgaagatgccaataatatataatccttgcttcgaaaactatatatacctcttatttttcacattttcttaatataacaagttttagaaacgattgtcatcatcggcaggaggataccctgggtggtgaggtggcttctcatatggaggataccctgggtagtgaggtggcttctcatatggaggcccg

SEQ ID NO: 4033 - DNA, 487 bp, Cicer arietinum
  misc_feature (7)..(7): n is a, c, g, or t
atgaagncgcatgctcccgtccgccatggcggaagcgggaattcgattagcgtggtcgcggccgaggtacggacaaggtgcatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttgttttacttattccgtgaatcgg

SEQ ID NO: 4034 - DNA, 274 bp, Cicer arietinum
ctgcaaaagattctccccgccgctcaataggaattgcgtttcaaggtgtcccgcaaggctcatccgccttacgaggtccaccatcgacacgtgcctctggggggccaaggccccctactgctggtcggcaagcgaacgacgggcacacgcatcgcttctagcccggattctgacttagaggcgttcagtcataatccaacgcacggtagcttcgcgccactggcttttcaaccaagcgcgatgaccaattgtgcgaatcaacggttcctctcgt

SEQ ID NO: 4035 - DNA, 430 bp, Cicer arietinum
actgagctgttccagaaaatttacaagcttggcaagtctggagaagagacccatgatgcccaaactgattatgataggactgagaaagacatcaccccaatgggtggattcccccactatggtgttgtgaaggaggattatctgatgatcaagggaggtgttgttggtcccaagaaaagggttattactttgcgtcagtctctactcaagcagacttctcgcaatgccttggaggatatcaaacttaagtttatcgatacctcttcaaagtttgggcatggtcgcttccagacaacacaagagaaacagaagttctatggacgcctcaaagcttagttatggctgctgctttgaaatgttggaaatcgttatttatgttatttttgttgccatccttttaaactctgttgtggtgtcttccgttagctat

SEQ ID NO: 4036 - DNA, 433 bp, Cicer arietinum
cggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacattgtctggtggggagtttggctggggcggcacatctgttaaaagataacgcaggtgtcctaagatgagctcaacgaga

SEQ ID NO: 4037 - DNA, 383 bp, Cicer arietinum
accaacggctagacggtaagaccccgtgcaccttaactatagcttcgcagtgacaaccttgatcgaatgtgtaggataggtgggaggtgatgacacagaacgaccaatcctgaaagaccactctttcgtctaaggatgcctaaccgccgcaccgaaaattcggggggggcgggacactgcgaggtgggtagtttatctggggcggatgcctcctaaagagtaacggaggtgtgcgaaggtaggctcaagctaagattctgctcgtgagcgtaatggtataagcctgcctgactgtgagaccgactggtcgaacagagacgaaagtcggccatagtgatccgggagtcccgtgtggaagggctctcgctcaacggatcaaaggt

SEQ ID NO: 4038 - DNA, 404 bp, Cicer arietinum
actgtatccccattcgttgtcataccaagaaacaacctttacaaagttatcattcaaagcaattcctgccttggcatcaaatatactagacctgctatcaccaacaaagtcagtagataccacatcatcttcagtgtaacccaaaattcccttcaacttgccctctgattcctccttgatagcagccttgatttgttcataggttgctttcttctcaagccttacagtgaggtcaacaactgaaacatcgacggtagggactcggaaagacattccggtcaatttaccattcagttctggaagaacctttcctacagccttggcagctccagtgctgctgggaataatattgaaggaagcagctcttccacctctccagtccttgcttgatggaccgtcaacag

SEQ ID NO: 4039 - DNA, 412 bp, Cicer arietinum
tttggagtgtgaaaatgataaatttaagcaacaacctaccacgatgaatgcttttcatattatatctttatcggaaggttttgatttgtctccattgtttgaggagaagaagagggaggagagggaggagatgaggtttgctacggcggggactccgagcagagtgatatccaaattggaacaagttgccaaagctgttaagtttgatgtcaagagtagtgatatgaaggtcaggctgcaaggacaggaaagaggtaggaaagggaaattggctattgcggcggatatttacgccgtgacgccgtcgtttttggtggtcgaggtcaagaaagataaaggtgatactttggagtataatcagttctgtagtacagagcttcgtcctgctttgaaagatattttctggacttct

SEQ ID NO: 4040 - DNA, 222 bp, Cicer arietinum
aactagaacaggggaatatatttatttggtttgtcagtcaacttgataaaccaaactttgaaaattacaacgcatgcacgccactgcagacacgtggatgctggggcagtgccttatagctgtgctaatacaacaaaaaacaaaaattaaataaataaacgcagctctcttaacaatattaatcaaactctgacgaaatatatgtgagaagaatcccctcaa

SEQ ID NO: 4041 - DNA, 355 bp, Cicer arietinum
acctcaagcttccccctgtggaggagcttgatgccgccttgggcacaaagaagtggatggtcaagaagggcgaggccggtgaggcgcctcttgctaagcttgacagcaagatcaagtttgttgggttgaggggaaagaagccatatgtcaagccgactggtggtgcgaagatgaccactaagccacttgaccttatgatggcagcgaatggttgtggcggcggtgcgccggaatggtagagaaaagaaacatagaggatagacgtgcttaagatatcatggttcggcgttggggatataccggaatggtttgggtcattatgagttatgttatgtagagcatatataaatacctc

SEQ ID NO: 4042 - DNA, 284 bp, Cicer arietinum
acaacataataaaataaagctttatcatcttcagaaattagaactattaatgccacaggaaatatttcatccaagaacaatccacaaattatcatgtatgcatagtccagaaactacatggagggtttgtattccctccggctttctatgactaccttcttccttgtgtcaaaatcaacttgttcaagatcaaaagcagtccctagatagccatacaaaaccctcattttctctccttttttctcatcaaccttaacaaggttcggattattctcatcatcctt

SEQ ID NO: 4043 - DNA, 107 bp, Cicer arietinum
gcggtcgcccgggcaggtactttgaataagaaataagccagttcacagaaggaaaatgcttcctctgagcaagctttttgtccaatccccagaaaacctgaactatg

SEQ ID NO: 4044 - DNA, 398 bp, Cicer arietinum
acacacttgactcacaatctcacacttccacaacaaaatgaaaagaagaagagagtatgacatttggcaaccaaattaagcacactaaatataataaaatgtgtcacaaaacaacacaccaggtataataaaagcaattaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgc

SEQ ID NO: 4045 - DNA, 432 bp, Cicer arietinum
accaagattgcttctgaaggactcaaacatcgtgtgtttgagatctcattggctgatcttcaaggtgatgaggataatgctttcaggaagattaggttgagggctgaagatgttcagggcaagaatgtcctcactaacttttatggtatggatttcaccactgacaagctcaggtctttggtccgtaaatggcaagctctcattgaagctcatgtgggtggtaagaccactgataattataccttgagaatgttctgcattggctttaccaagagacgcagtgaccaagtgaagagaacctgttatgctcaatccagccagatcagacagatccgcaggaagatgagggagatcatggttaaccaagcaacatcgtgtgatttgaaagagcttgttcgcaagtttatccctgagatgattggaaaggagatt

SEQ ID NO: 4046 - DNA, 428 bp, Cicer arietinum
gaaaagtatagaaaagaaaagagaaagaaatcaaaagaaaaagaaaaggtaggttggagagaatatagcaaaactgcataaagcatcttcatcatcatcaccacaagaaaccgttgttcgatagatctgtggagaacaagatgggacacaaccagaaccaaaaatctctgatctacgctttcgtttctcgaggaagcgtgattcttgctgaattcaccgaattcagcggtaattttaattcgatcgcgtttcagtgccttcagaagcttccagcttcaaacaacaaattcacttacaactgtgatggccgcaccttcaattacctcgtcgataatggatacacgtattgtgttgttgcggatgaatcagttggaagacaggttcctgtggcttttctggagcgtgtgaaagatgattttgttgtgaaa

SEQ ID NO: 4047 - DNA, 292 bp, Cicer arietinum
actagtttgccttactattgcgacactgtcatcagtagggtaaaactaacctgtctcacgacggtctaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 4048 - DNA, 250 bp, Cicer arietinum
tcaatttcaactttccagctttttggtgaaagaggccggtgctggaagtgttgttgtatgctttgatccatagtgtttgtttgtgtatataagaaaaatccaataggagtggaaaggttaaaaaagtagaaaataaaacatgtgtgaagtatagtttgataaaaaaggaatggtgtaggaaaataagcacagttcctttagagaccaaaattaaagattgtgatcacaacagtataggttggttttctag

SEQ ID NO: 4049 - DNA, 345 bp, Cicer arietinum
acaggggaggtattaatcctcaggaaaaagttaaacttcagaaagaacccatgaagcttttcatggaaggtgggattcatgatttggctaatatgtctcttgaggaaattgaaagctctaagcttacaaaagatgatattgatgttagactcaaatggcttggtctttttcacaggagaaaacatcactatggtagatttatgatgagactgaaacttccaaatggggtatcaacaagtgaacaaacacgatacttggcgagtgtcataagaaagtatggaaaagatgggtgtgctgatgttacaacaagacagaattggcaaattagaggtgtagtgttacctg

SEQ ID NO: 4050 - DNA, 236 bp, Cicer arietinum
acacgaacaagaaccagaaagccataacaaaacagataccataacagagactactagatcccaccatctaaaatctcaactaaacataattaaccataaaaacttcatcacgagacttagcttacaaaactactctctccagtttccaccaccaccgccaccgccggtgccacgtgagtaacgggaaccaccatcaccacctccgtcaccgtatccacggtccctaccaccaccat

SEQ ID NO: 4051 - DNA, 249 bp, Cicer arietinum
acaaaaacgagaaccacagtaacacaaaaccataacatgataaataccatagccaaaccactaatttcttaaacctactaaagtgacatgacaaggagaagattcttaatcataaaccccaacaagaagaacttaaatctagtccctccagtttccaccaccttcaccgccacgtgagtagcgagaaccaccatcaccaccaccatatccacgatctctgttaccaccataaccaccaccacctcctcc

SEQ ID NO: 4052 - DNA, 408 bp, Cicer arietinum
  misc_feature (13)..(13): n is a, c, g, or t
  misc_feature (16)..(16): n is a, c, g, or t
  misc_feature (31)..(31): n is a, c, g, or t
  misc_feature (129)..(129): n is a, c, g, or t
  misc_feature (257)..(257): n is a, c, g, or t
  misc_feature (259)..(259): n is a, c, g, or t
  misc_feature (265)..(265): n is a, c, g, or t
  misc_feature (396)..(396): n is a, c, g, or t
ggaattcgattancgnggccgcggccgaggnacttagaacatgctattattactagaaaggcactcccaaacctatattattattactaaaaaggcacccccaaacctaatttatagcgtcacgttacnagagaataaagaataaatgatgaaagcacgagagataaacattctttgaacggatgcaacttcaagttcaagccttgaagtgaaatttgcctggctcagagtatttcgcttccacttgttcaactttntnaaattnaaaacccctgattctcaatacctcaggctccgaggcatctttgaagtctaccggttcaagagtccaacctttgttctgaactgatccacccacggttacctctgtatcatcaacagcgactatgataaganccccacctgccc

SEQ ID NO: 4053 - DNA, 464 bp, Cicer arietinum
  misc_feature (11)..(11): n is a, c, g, or t
  misc_feature (28)..(28): n is a, c, g, or t
ctcccatatgngtctacctgcaggcggnccgcgaattcacttaccgatttcgagcggccgcccggcaggtactcataggtgatatcgatgccatctattatgttaaagctccaaggatccttggcttcgttgtattgctggatgatctttttgagtgagtttacagcattgtcaggccattctacttttgaagcaggattgaatggatgtttatcaccacgaccaccgatgcttattacaaccttcacatttttatgattttgcttgagttccttcactttttcaggactgaagaaatgaacgttccaactggggttgaaaactcctgtgccttttccactatcatcgtaagtctctgtggcaaagcctaaaatgaagtggaattggtggatcttggagttgatgatatcagctgggaaattatgtaaagtgtctggatatggattcacgccaatgtattctcg

SEQ ID NO: 4054 - DNA, 306 bp, Cicer arietinum
ggccacctcttttgccgctcctgctactctctacaaagctctagatacagatgctgacaaccttactccaaaggttattgatgccattaagagtgttgaaattgttgaaggaaatggtggccctggaaccatcaagaaattcaccttcgtcgaagagggagaaaccaagtttgtgttgcacaaagtggacgcaatagatgatgctaattgggcttaccactacagcatagttggaggtgctgggcttccagacacagctgagaagatctcatttgaggctaaattgattgcaggcccaaatggagg

SEQ ID NO: 4055 - DNA, 406 bp, Cicer arietinum
actggaaatcagaatcaaacgagcttttacccttttgttccacacgagatttctgttctcgttgagctcatcttaggacacctgcgttatcttttaacagatgtgccgccccagccaaactccccacctgacaacgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggacagtggga

SEQ ID NO: 4056 - DNA, 428 bp, Cicer arietinum
accaacaaggttgctttgcaggtggcacggtgcttcgtttggctaaggatttggctgagaataacaaaggtgcacgtgtgttggttgtttgttctgaagtcactgcagtcacatttcgtggtcctagtgatactcatttggatagtcttgttggacaagctttgtttggagatggagctgctgcattgattgttggatctgatccaattcctgaaattgagaaaccaatatttgagatggtttggactgcacaaacaattgctccagatagtgaaggtgctattgatggtcaccttcgtgaagcaggactcacatttcaccttcttaaagatgttcctgggattgtctcaaagaacattgataaagctttgattgaagctttccaaccattgaacatatctgattacaattcaatattttggattgca

SEQ ID NO: 4057 - DNA, 311 bp, Cicer arietinum
actcattacccccaagaggcacctctctactcatagctcgccctacagtagttgtcggtgaagcacgtcccattggacatcaatacagttgatcctcgcagagcttccctccagcagcgtctcccatctagttcatccagcatatcatcggcacaaaggcgcatttactttcaagaggtcatcccgtcagcgggatctattcctctccagcctagaattctcttgcacggataaatcaagtagctttccataccctgaggcaggaagtccatgatcccctaagatcgtcagtagctgcaacctaggaccgt

SEQ ID NO: 4058 - DNA, 185 bp, Cicer arietinum
acctcgatgttgccagcttcaatttcctctcgtatgtggtgttcgactaaagggatatgctttgctcgttgatgtagctcgggatttctgcagagtttcagagaaccctgattatcgccattcaaaaggatcggaatgtctagtgatagttgtagttctgagaacagattccgaatccatgttaa

SEQ ID NO: 4059 - DNA, 407 bp, Cicer arietinum
gcggccgcccggcaggtactcatagttgatatcaatgccatctattatgttaaagctccaaggatccttggcttcgttgtattgctggatgatctttttgagtgagtttacagcattgtcaggccattctacttttgaagcaggattgaatggatgtttatcaccacgaccaccgatgcttattacaaccttcacatttttatgattttgcttgagttccttcactttttcaggactgaagaaatgaacgttccaactggggttgaaaactcctgtgccttttccactatcatcgtaagtctctgtggcaaagcctaaaatgaagtggaattggtggatcttggagttgatgatatcagttgggaaattatgtaaagtgtctggatatggcttcacgccaatgtatt

SEQ ID NO: 4060 - DNA, 285 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataagagcacttaattgtaattaggattggccaaacaataaccctcaagtgccttgaaaagaccaccacccttggctttgccacttttgagctcctcttcagaaggagtaaaatctcctttggtgtgatacttcacactcaactttgcaatggatcct

SEQ ID NO: 4061 - DNA, 403 bp, Cicer arietinum
accattttcatatgcattacacgtcaacctcttcaacccactaccgtccaacctgactacaaacaaatccccatacggctgaaattgatttggcatagacactggctctgccatcaccccacccaaatttgctgtaaacaacaaccattctccgtcaccactaaaacacacatgattcaacctctctctctcaccatccacacccttccccacctcaaccctccttaaatcactcccatcaggcctcaccacataaatcccaaacacttcactgtttccagcatcatgtctattcgatgaaaacgctatccaatcaccctttggagaccaacatggcatcgtatcaatccattccccttccgttaacctcctcaaaccaccgttaaactctccatccaatgca

SEQ ID NO: 4062 - DNA, 330 bp, Cicer arietinum
accaccaaacaccaagcaataaacaaagatctaggtgctctcgctcctattcggcttcgtagacacgaaaatcagatgttggtcaaggttgggaacccagtcatttgtagcaggattacttttatatcctctgaattgaatttcaccaacatcaacatagcttgcaggtaacttaatctcatatccatcttcaccaccttctctcaccgcttttataaacccacttcccgtcgcatgatgctgtttatcaatggacaacaactccttgtaatagtgagtctccacaaactcatcttgcggatccaccaaattctctgaggaaagtatagc

SEQ ID NO: 4063 - DNA, 292 bp, Cicer arietinum
acgaatacgaaccgtgaaagcgtggcctatcgatcctttagtccttcggaatttgaagctagaggcgtcagaaaagttaccacagggataactggcttgtggcagccaagcgttcatagcgacgttgctttttgatccttcgatgtcggctcttcctatcattgtgaagcatatttcaccaagtgttggattgttcacccaccaatagggaacgtgagctgggttagaccgtcgtgagacaggttagttttaccctactgatgacagtgtcgcaatagtaattcaacctagt

SEQ ID NO: 4064 - DNA, 166 bp, Cicer arietinum
cgcggccgaggtacttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaactt

SEQ ID NO: 4065 - DNA, 201 bp, Cicer arietinum
acaagacaacattctttttcctaccaaaaatacattggtaaaatgttgtgtgtggattttcgtccacttttaccgtgagattaatttctcaaaaactacaaatcaaaagacaaaaagcatgcacaccctcaaaaaaggccaaaatttcatccatgtttgcacacaacaaatttaatcagagggaaaaatcaatcttcctaa

SEQ ID NO: 4066 - DNA, 293 bp, Cicer arietinum; identical to SEQ ID NO: 671

SEQ ID NO: 4067 - DNA, 403 bp, Cicer arietinum
actgtatccccattcgttgtcataccaagaaacaacctttacaaagttatcattcaaagcaattcctgccttggcatcaaatatactagacctgctatcaccaacaaagtcagtagataccacatcatcttcagtgtaacccaaaattcccttcaacttgccctctgattcctccttgatagcagccttgatttgttcataggttgctttcttctcaagccttacagtgaggtcaacaactgaaacatcgacggtagggactcggaaagacattccggtcaatttaccattcagttctggaagaacctttcctacagccttggcagctccagtgctgctgggaataatattgaaggaagcagctcttccacctctccagtccttgcttgatggaccgtcaaca

SEQ ID NO: 4068 - DNA, 368 bp, Cicer arietinum
cacaaagcatcacaaagattcatattttctttatatatagatgtaattacacattacacatcatatcacataaaataaaacaaaacaaaaaaagcaacaaaaaaaaaaaagagccacattaaagtgtttctcaacaacctcaaaagaaaaaacttggattcctataatggttaatttcttcttcctagtgattactagcatagtgattgacaagtgcaagagcattacttgtaacttgagcaacattaatcattctagatctaatggaagctttaattctcccattaagtgcttttccaccaaacccatcaccacaagttgtttcatcagtcaaagctgagctaacccatgtctcaacattacttata

SEQ ID NO: 4069 - DNA, 429 bp, Cicer arietinum
acatttaacaacattgtctgcagtcatgatatgactcttcaaaggtaatatacaatacacgtttcagtaaaaaaaaacaataacaggagcaacaaagcaaagtaaccatgatcaatgatgcagaggacacttcacatgtcagacaaaaaagaaccgaaaacaattttgaaattaaacttgatgcaagttaacagctcgccgttgtcattcttcaatgtcatcttcagagaataaggtcccggtggagtaattgaaggcagtgtttgggtgtgagaaatcaagaaattgccatttgcaacgggacaagatacttccttacaaagatcaatggtttcagaatggacaggcaccccaacataggaaactgaaattaccacctttccaccagaaatagcttttccagaagtagctgagatcttaaagttagct

SEQ ID NO: 4070 - DNA, 426 bp, Cicer arietinum
acaagcttttttcacccactcttgagaaagagggagtttcttattccttctagaaacaaaaacgcttctttcggaaacggagatttagggttttcatttatcggcgatcgaaaaaagcgagatttgaaattgtgagaagaaatggcagagcatcacgaacacgacgaatcaaagggtgaatctttgttagacaagatttcagggaaaatccacgaccactattcttcgtcttcatcggattccgataacgagaaaaagaatccatccccttctactctcaagtcaaaggttttcaggcttttcggaagggaaaaaccacttcacaatgttcttggtggaggaaaacctgctgatgtttttttatggagaaataagaagatatcagcaacggtgcttggagtggccacagcttcatggattctgttt

SEQ ID NO: 4071 - DNA, 418 bp, Cicer arietinum
caaactcctagaattccgaattactgaaaggcctagactacttattctttgctcaccatctaacccaacaggataggtctatcctaacgcagttacttgaacagatagcccaaattgtagcaaagcgcccaagggttctggatatctctgatgaaatttatgaacacataatttatgcaccagcaacacatacaagctttgcatctttaccgggaatgtgggacagaactctaaccgcgaatggattttctaaggcctttgcgatgaccggttggcgccttggttatattgctggcccaaaacatttcattgcagcatgtggaaagattcaaagtcagttcacttcaggggccagtagtatatctcagaaagctgcggttgctgcattatgactaggctatgctggtggggaggctgt

SEQ ID NO: 4072 - DNA, 260 bp, Cicer arietinum
acttttctggatcttcattgtaggaacctccacaaaattcttctagagaagatgcatatcggaagaagttcatcagattcaagatttcacaatcagtaattttcacagagactaagttgggacaattttttgctataagttcgaggtcctgaattctgacattggcaatatcagtcaggtatcaattaagtgtctcaagaactgtattattcaaagcaagcacatgcagccattcaccatctttctcgacaactgagctt

SEQ ID NO: 4073 - DNA, 422 bp, Cicer arietinum
accactcttaccaatttggacctaaccactcctgatacatttgactctgcctactattccaatcttaaaattcaaaagggattgtttcagcgtgaccaagagttgttttcaaccagtggtgcagacactattgacattgtcaatagtttcaatgacaaccaaactcttttctttgcaaactttaaggcctctatgattaaaatgggtaatattaatgtgttaactggatctcaaggagagattagacaacaatgtaactttattaatggaaactctgttgaccttgctactactgtgactagagagtcgtcagaagatggcatcgttagttcatactaagtaatttaattagcaaaagtaaggaacctaataaagattaaagagtgtggtctatcttctagaggcatatacatgccctgttc

SEQ ID NO: 4074 - DNA, 402 bp, Cicer arietinum
accaaggatgatctgaagcttcccacagatgacgccctgcttactcagattaaagaggggtttgctgaaggaaaagatcttgtcgtttctgtcatgtccgcaatgggagaagaacagatatgttccttgaaggacattggtcctaaaaattaaaatgttgctctggttgtggctatggacgatggcacaaattttcttcttatgtttcttcttatgttgctaacaggtagtattttttcttatgcatgtatgcaaaataaacttgaaaaaatgcaaactgccttgagcttgaacctcataaagcttgagatggggaaactggcaccatatttagctttcgtccttttaattattgaaccctgcggttttggccggatgaatttatcataaatgttcctttta

SEQ ID NO: 4075 - DNA, 445 bp, Cicer arietinum
accaggatcaaatcaatgagaagatgcatgtgatacatgggattattcacccacagtatcaaaagattcatagcattgttttgagcataattccaaaacgtccaaacaaggacaagaaggtgcagtagtcttgttaggagcgcacagatggatgcttaacacattgaatacttgagcttttcgttttgttgggaagttgtagctgttttaattgataattagcagtatgctaattcttcaggagccaaatcgaaaaagagctttgatgtagatgattatactcttgtgaattttctgtataccccattggaaagttctttatgtctgataaatagttctgtgcccttgttgaggttcactttggattagattgccacaggagggggaaaaagaaaggacttgagaacttgaacgtgattttgtttttaggatggtaacatggcat

SEQ ID NO: 4076 - DNA, 399 bp, Cicer arietinum
ggaccatttcggaggcggccgcccgggcaggtactgagatgaaaatctatatattcagcactcacatcctgttgcccgttgttgattgctgttcccaacatcaattgtgtctggcaggtatagttcttcctcttccccacttttcagggcattctttgctatgcattggaatgcttcttcaacattaataccccctttggcagatgtctcataatatgggatatttccttttgatgcacaccatgcccgggacttcttttctgagaccactctactgttcccaccgccaatatctatcttgtttcctataacaacaaaaggaaaattctctggatcggatggatttgcttgaatcacaaattcctccctccagttgttaaggttttcaaatgatttcat

SEQ ID NO: 4077 - DNA, 434 bp, Cicer arietinum
acttagttttattcactccaagttacaaggatgctatgatgttggttggagaaagttacccttttgttaaaggaaactattacatgactattcttggtgaacaacaagaggattatattaaagaatttgcttcttttaaggaatctaaggttatcatagcacctaggacttggttggatttgaggattagagggtcacagttaagtcaaaattttaggaggaaatgtaagattggtccaaaagggttgtttgcttatgcagcagatgtgaatggaacaatgcattgggtttctgaggcacatagaaactattggcatgttttgcttgatgcttcttccttggttgtgggaaaggataggttacatgttggacttcataggcctgattttttagtatgttgtcttgataacacacattcaaatccttcaagaatc

SEQ ID NO: 4078 - DNA, 371 bp, Cicer arietinum
accaaggatgatctgaagcttcccacagatgacgccctgcttactcagattaaagaggggtttgctgaaggaaaagatcttgtcgtttctgtcatgtccgcaatgggagaagaacagatatgttccttgaaggacattggtcctaaaaattaaaatgttgctctggttgtggctatggacgatggcacaaattttcttcttatgtttcttcttatgttgctaacaggtagtattttttcttatgcatgtatgcaaaataaacttgaaaaaatgcaaactgccttgagcttgaacctcataaagcttgagatggggaaactggcaccatatttagctttcgtccttttaattattgaaccctgcggttttgg

SEQ ID NO: 4079 - DNA, 350 bp, Cicer arietinum
  misc_feature (74)..(74): n is a, c, g, or t
aatttccttagcgtggtcggaggccgaggtacgctaattcagctacagatgatcccacccacgttcctcccggncgtcgctgtagtatcaacccagaacaaggtattttggacgacgaaaaaggtggggggcttccagacctgtcaaaaagttggtggtatccagaacccccctcttaaccaatatagggcagaacttttctaaaaagcgccttttggtggcggcttaatatgtctttcgccttttggatctggattactctgacagccaactcccacgccaaatgttccttctgtgtcacaccaccactctgttatgaccgttgctgcctgatcgtctgctgataccca

SEQ ID NO: 4080 - DNA, 189 bp, Cicer arietinum
acgaggcagatatcaaggagatccgtgatctcgagatctggcgcgccggcaaggccgtccgatctctccgacccgagaaccagaagtaagcggctattaatgttgaatgataatttgtgagcgggagatggacatgggatgagatgcctaggaaacggcttttatgaaccacatgaactttctgtctgt

SEQ ID NO: 4081 - DNA, 138 bp, Cicer arietinum
aagatcaggagcgatccgagacagaactactctttcatcatgttggtttaccaggatctccttaccggtgatgagcttctctcagactctttcccatacaaagaacttgcgaatggagtcttgtgggaagttgagggg

SEQ ID NO: 4082 - DNA, 420 bp, Cicer arietinum
acatatctggtggaaatcacaatggtcgttaccttagtgatcttcatgttttggatttgagaagttggacttggtcaaaggtcgaggctaaggctggagatgagtcccctacaactttgaacccttgtgctggccattctttgattgcatggggaaataagctcctgtcaattgctggtcacacaaaagatccttccgaaagtatccaagcaaaagagtttgatctacaaacagcaacatggtcaactctaaagacttatgggaaagctccgatatcacgaggaggccaatcagtgacccttgttgggaatagcttagtaatttttggtgggcaagatgcaaagaggactctattgaatgacctgcatattcttgacttggaaactatgacatgggatgaaattgatgctgttggagcgc

SEQ ID NO: 4083 - DNA, 151 bp, Cicer arietinum
gaaagaaaacaacaaagattaataaaaatatatgtaacaacagccaaaaatctttagctctcattttcattcaatgttattttgagaaagaggtcaacttctactatgacaatttggcttatggttgttgtgaagaacacaagtcctacca

SEQ ID NO: 4084 - DNA, 433 bp, Cicer arietinum
acatagatgatgtaacagtgtttggggtgatgtaaaggatgcaattttggatcctaatatcgaaaatattttccaaagccttaatgggaggtcgttttatgaatatacgaagatggataaagagttgaataatattgttaataaggcaatggcccatgctggaccattagaaattaaaagggtcctacaattatataagggatttgagggaatctcaacattggttgacgttggaggtggagtgggagggaccttaaaactcatcatctctcaatatccttcaatcaaaggaattaactttgatttgcctcaagttgttcaagatttacctcctcatccaggtatagtgcatgttggaggagatatgtttgaaagtgttccaactggtgatgccattttattaaagctcgtatgccacaattggtcagatgaa

SEQ ID NO: 4085 - DNA, 238 bp, Cicer arietinum
acacactctagctttggaagttgctaaaggaatccggagacgtaaaaagcccgtgatcaatttaaagggttacattgtgggaaatggtgtcacggacccaaaatttgacggcgacagtgctttttatccatttgtgcacgggatgggtctcatttccgactctatctatgagagtgtgcaagcttcttgcaaagaaactgactataactttgaatccgatagtgagggtagtagtagt

SEQ ID NO: 4086 - DNA, 436 bp, Cicer arietinum
actggatgtatgcgaattatctctacacctgcttcggtcaaaccggcgaggtaacatctctgaaagtgattaggaataagcaaaccagtcaatcggaaggttatggttttatcgagtttaattctcgtgctactgccgagagagtgcttcagacatataacggagccattatgcctaatggtggccagagctacagattgaattgggcgactttctgtgctggggagaggtcgtctagacaggatgatggtcctgatcataccatttttgttggtgatttggctgttgatgttactgattaccttcttcaggagacttttagggctcgttataactctgtgaagggggcaaaagttgtgattgataggcttacttgtcggtctaagggttatggttttgttagatttgctgacgagagtgaacaaattagggctat

SEQ ID NO: 4087 - DNA, 293 bp, Cicer arietinum; identical to SEQ ID NO: 702

SEQ ID NO: 4088 - DNA, 441 bp, Cicer arietinum
gtgcttcgtttggctaaggatttggctgagaataacaaaggtgcacgtgcgttggttgtttgttctgaagtcactgcagtcacatttcgtggtcctagtgatactcatttggatagtcttgttggacaagctttgtttggagatggagctgctgcattgattgttggatctgatccaattcctgaaattgagaaaccaatatttgagatggtttggactgcacaaacaattgctccagatagtgaaggtgctattgatggtcaccttcgtgaagcaggactcacatttcaccttcttaaagatgttcctgggattgtctcaaagaacattgataaagctttgattgaagctttccaaccattgaacatatctgattacaattcaatattttggattgcacatccaggtggaccagcaattctagatcaagtagaggaaaag

SEQ ID NO: 4089 - DNA, 310 bp, Cicer arietinum
taaaaagggaaaataaataaccggtaataatcgtcgttcacacaaaagctctaaataaaaaggtcgaagagaggcactgccggaagggaacaaccaccgtctttcaattttccggcgatctcctcgtttcttccacctgcgatctaatatcccaacaatcaaacatgactacatcaagacgccttgcagttaggaaggtggagaagtttgagaaaaacatcacaaaaagaggaagtgtgccagaaaccactgttaagaaaggaaaagactatcctgttggccccgtgctgcttggtttcttcgtctttgt

SEQ ID NO: 4090 - DNA, 188 bp, Cicer arietinum; identical to SEQ ID NO: 24

SEQ ID NO: 4091 - DNA, 462 bp, Cicer arietinum
acaagccgctagttgttaaggatctgaggaaaatttgggagaagcatgatcctaatcttccttggaagaagggatactacaatgaatcaaatacgttgctcttggatgactctccctacaaggggttacttaaccctccatataactcaatctttccgcattcattcacttataagaatcaggacgacaaatcattagctgttggaggtgatctacgtgaatatctggaaggattagcaaatgctgaagatatgttgaagtatgttgagcagcacccatttggtcaagagcgtttaactgaagaaagtaaatcttggaacttttactcaaaggttattgataagctttctgccggtcaacctaagcgttctggtgttttatatctggaatatcaatttacacaatctgattatttagaagaaattgagatatagaagactctgattatctctaactctaacc

SEQ ID NO: 4092 - DNA, 467 bp, Cicer arietinum
agaagaattgggtcaggcacaatttgctcagcttctgcagtctgtattgcaagatcttgaggaggaactttccaaaaagaactttgctttcttccagaatatccaaatcataaatggctctaagctaagacagctattggccaatgaaaaggaattaaacagaattgtggagaaagcattccaggaaaaatccgatgcaaaggatgatttaggaagcacagaaataataaggagcttcctcaagagaaacactaaggagttgggtttacctttatttgaagctggcgatgcagctgttcttctttatgatactgtttttgctgatatagccaaagaaaaagatggtgtggagttggataaagaaaagctgacaaaacttatgaaggatgtcctacagaaattggctgagcaacttgagttgaatcctgtatatcaggactttgcttgagggcttgaggccaatgaat

SEQ ID NO: 4093 - DNA, 289 bp, Cicer arietinum
gcaaaagattctacccgccgctcaataggaattgcgtttcaaggtgtcccgcaaggctcatccgccttacgaggtccaccaacgacacgtgcctctggggggccaaggccccctactgctggtcggcaagcgaacgacgggcacacgcatcgcctctagcccggattctgacttaaaggcgttcagtcataatccaacgcacggtagcttcgcgccactggcttttcaaccaagcgcgatgaccaattgggcgaatcaacggttcctctcgtacctgcccgggcgccgc

SEQ ID NO: 4094 - DNA, 222 bp, Cicer arietinum
gcggccgcccggcaggtaccctgttacagaggcttaggttctatttttttcacttttaaatttcttttgtcatgaatagcatagggtgaatgctccttcctagttaaaattttgttcaagttccctttgattctgtatttcctatggtgatgtattttaaaaaactggcctattttatcaatgtaggctgatgtaatatttattatagaattcaaattacgc

SEQ ID NO: 4095 - DNA, 184 bp, Cicer arietinum
acaagtatattaaaaatgtgaaacctgcttctagcggatgtgtgacagacgagtagagaggaccccattttggtggctttgcagagcgaaatccgattatttgtctattttgatgaggtagcttaaccggtgcatttctatgtatcttgatgtatcttaattttgatcttcattattttttggt

SEQ ID NO: 4096 - DNA, 342 bp, Cicer arietinum
ggtttctttgcctttattttggattctggatttctttcggatcgttctgagggtagtgttctcactgcggctcaaaaaaccaccgtcctcaaacttcaggttgggttgttagggctgggccgttcacttcaaagggatctgaataggattgccgaagttgcagacacatcatcttcagaaggtttgagctacgtattgacagagacaacatttgttttgcttcggcatcctgattattgtatctcggcatattcatctgtggacataaagcggggtatagaagatggggagaaacgatttaatcaactttcaattgaagaacggggaaaatttgatgaagag

SEQ ID NO: 4097 - DNA, 272 bp, Cicer arietinum
gcaaaagattctacccgccgctcaataggaattgcgtttcaaggtgtcccgcaaggctcatccgccttacgaggtccaccaacgacacgtgcctctggggggccaaggccccctactgctggtcggcaagcgaacgacgggcacacgcatcgcttctagcccggattctgacttagaggcgttcagtcataatccaacgcacggtagcttcgcgccactggcttttcaaccaagcgcgatgaccaattgtgcgaatcaacggttcctctcgt

SEQ ID NO: 4098 - DNA, 442 bp, Cicer arietinum
ctgaacttcacaaaccaaagcaatggctcctaaccatgctttcatctttttggttctattatccttttcaccacaactcttcttcactctttcttctgcacaacaagataatggtcttcttatgaactactacaaagaatcatgtcctcaagctgaagaaatcatcaaagaacaagtcaaacttctttacaagcgtcacaagaacactgctttctcatggctcagaaacattttccatgactgtgctgttcagagttgtgatgcttctttgttgctgacttccacaagaagaagcttatctgaacaagaacatgacagaagctttggtttgaggaatttcagatacattgatacaatcaaagaagctgttgaaagagagtgtcctggagttgtttcttgttctgacatccttgttctttctgctagagatggcattgtttcg

SEQ ID NO: 4099 - DNA, 340 bp, Cicer arietinum
acttggaggatgttcttgcacacaaacaggccattccattcaggcgtttctgtcgtggtgttgggaggacagctcaggccaagaatagacactctaatggacaaggaaggtggcctgccaaatctgccaagttcattctagatttgctcaagaacgcagagagtaatgctgaagtgaaaggtttggatattgatgctctttacgtttctcatatccaagttaatcaagcacagaagcaaagacgtcgaacatacagagcccatggaagaattaacccttacatgtcatctccatgccacatagagttggtattatctgaaaaggaagaggcggtcaagaa

SEQ ID NO: 4100 - DNA, 337 bp, Cicer arietinum
aattactgttactgttacttcctctggatccatccagtttcgagtcagaaaacaagcctcgaagcttcgagaacaagtcgctcgtcaacaacaggctgttctgaaacagtttggagctggcggttatggaggttcagataacatggttaccgatgagagagggcttcacctacaccagagacttgaaaaactttatatatcaacacgtgcggggaagcattatcaaagggacgttgttcgtggagttgaaggttatattgttacggggtccaagcaagttgaaataggaacaaagttgtcggaagatagtaggaaatatgggtcggaaaatacgtgt

SEQ ID NO: 4101 - DNA, 398 bp, Cicer arietinum
accaaacaagacaattcatagaaatttatattaaataagttagacaattctctagaacaagtgcacagtctgaatctctagcgagcgcccctaacagatgaatatcaaaaggttcaacatgatcctaacgaaagcaattgtaattctcgacagcaaggtcagtctcttgcctctcataaacacaacctccccaatatgggcgaatcctacatagaattgtcgtttcacgattaagcacgattaaccattcatattgaagctttaactcagcgcccaataaccattaataacagcgtgagcgagtcgaaatgacagcattaatcacctgcggattgcataattcaacgcttgccacgatgcccgccacctgacctcgcaccagggtagcgagcgaattg

SEQ ID NO: 4102 - DNA, 185 bp, Cicer arietinum
caccacctttttattctgatcattctgatatcaaagacagaggtgtttttgattttctaggtggtaagaaaaaggatgaagatcacaaacatcaacaagaggatgtgatcgccactgagtttgatcataaggtcactctgtctgatcaactggcagagaccaagaaagacgaagatgaagttcaa

SEQ ID NO: 4103 - DNA, 432 bp, Cicer arietinum
acaacacgtttccgaaattcactgaataagtcaaaacagtatgaaatagaaaagagtttaaacatttcctacaaatatctgatacaaataatggatttaaaattaacatgcgcaggcatgaagagcttaagccttcttcttgcttggtgccaactgagtctcaggctctttcttgaccgcctcttccttttcagataataccaactctatgtggcatggagatgacatgtaagggttaattcttccatgggctctgtatgttcgacgtctttgcttctgtgcttgattaacttggatatgagaaacgtaaagagcatcaatatccaaacctttcacttcagcattactctctgcgttcttgagcaaatctagaatgaacttggcagatttggcaggccaccttccttgtccattagagtgtctattcttggc

SEQ ID NO: 4104 - DNA, 437 bp, Cicer arietinum
taataatatcttctcttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctga

SEQ ID NO: 4105 - DNA, 426 bp, Cicer arietinum
gtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacgccaaaggagattttactccttctgaagaggagctcaaaagtggcaaagccaagggtgatggtcttt

SEQ ID NO: 4106 - DNA, 293 bp, Cicer arietinum
actaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaggcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 4107 - DNA, 442 bp, Cicer arietinum
acgtcagtaaaacagaccttgcctgaggtccttaacagtctcgcttccgccatactctttccggaaccgggagatgacaataacttacttcgccggatcaaaaattccgtcgccgacaacgcttcacttcttccagaagcttctagaaattctgcacgtgatattcttctatggactcgtcgcggtagccacctacgcgctatcctcgttatctccgttggggcggttacttttgtttctcttacaggattgcttgtatttacgcttttctttctggccgcaaccataaatgccattgtcatatcgctgctgatgtcattggctgcagctggagggttcttggctcttttctttgcttgtgctaccgctatatacattggagcactatcaatagccatatttgcaatttcagttactacattttggacaattgtggctattc

SEQ ID NO: 4108 - DNA, 209 bp, Cicer arietinum
aattgtttaaaaaatgcttttattgatcgtgaggcgttcccatgtttaaggagactgtgaacccataaaagttcactagttcccatggccatgaggcgatgcatagatagtttaaattcatagtattatgtgcttttctagcacatggtcaatgtatcaatcccaatatctcattttcatatgagatgcaattatttcagacttcaaaa

SEQ ID NO: 4109 - DNA, 335 bp, Cicer arietinum
acgattcattttagcactatgacaagtgccagctaagatacgacctcggatggaaacatttccagtgaatggacacttcttgtcaatgtaggttccttcggtagcttctctgggagtcttaaacccaagaccaatagatttccagaagcggtttccaccttttccaggcctctttcccttcccagatttcttagagcacagaaacactttaggttgcttcagaaaagccttctcagtctgttcagccatggtggagtgaggttgggaattttgcagaggctgtgggagtagccgctcgttttgtgagaattcagaggccctagtttcactttgtc

SEQ ID NO: 4110 - DNA, 405 bp, Cicer arietinum
ccatttcattgtcgccgcggtaggggtagaactaaattattcgggatgggtagggttatcagggcacaacgtaagggtgcgggatcagtcttcaaatcccacacccaccaccgtaagggaccagccagattccgcagtctcgatttcggtgaaagaaacggttacctcaagggagtaatcaccgatatcatccatgaccctggtcgtggtgcacccctcgctaaggtctctttccgtcatccttttaggtataagaaacagagtgagcttttcgttgctgctgaaggaatctacactggacagtttatttactgtggaaagaaagctactcttgttgttggtaatgttttgcctctcagatctatccctgagagagctgttatttgcaatgttgaactccatgtt

SEQ ID NO: 4111 - DNA, 351 bp, Cicer arietinum
acattgaaactacttcattccgtggtcaagtcagcatactgccatggattgaattcaattgatttaacatcagcatcaatgctgttggaattatctgcagcagcccgatgttcgtcgtatttgccattatattggtagatttccaactcaccccaaggtgtcggtgtaacttcttcggttaagtcaaaccatcttggtgtgaatttatgccctttttcctcccgggctctcttttcagcacgctgcctctcctccaaactgctcttttctgttccagattttgacagatcacccatctcaagtgcatatctatctgggcgtagtcgagagtctgatgccaacaacttttta

SEQ ID NO: 4112 - DNA, 421 bp, Cicer arietinum
gagtgatttagacagagagatttcgcaattacacaaaccctaatttcaaagagatcggcgatggcttcttctaaggatcgtgaaaacttcgtctacatcgccaagctcgccgagcaagctgagcgatacgaagagatggtggattcaatgaagagtgttacaaatctagatgttgaactgactgttgaagaaaggaatttgctttctgttggttataagaatgtgattggtgctcgcagagcatcgtggaggattctgtcttccattgagcaaaaggaagagacaaagggaaacgatgtaaatgcaaaacggattaaggagtataggcataaggttgaatcagagctttcaaacatctgtaatgatgttatgagagtgattgatgaacaccttataccttcagctgcagctggtgaatcaa

SEQ ID NO: 4113 - DNA, 281 bp, Cicer arietinum
accgtcccttgagccccaaagaaaggcatgacggcctgtcttttgtgccgccccataatcacgctactgtaaactccaggactttcgccctgtatctcataaatggtcgtttcggctgcctatgtgccatcctcaaatactgcccatgcatcgttccttggatgtttggcagcatcctcctcaacaaaagtattccgtaaccactcgagtcatttacagatcgtcgtcggaaagctcaccaggcagaggcatggcggcggcctcgtccatctccttgcggt

SEQ ID NO: 4114 - DNA, 107 bp, Cicer arietinum
acggacaaggggaatccgactgtttaattaaaacaaagcattgcgatggtccctgcggatgttgacgcaatgtgatttctgcccagtgctctgaatgtcaaagtgaa

SEQ ID NO: 4115 - DNA, 340 bp, Cicer arietinum
accaaccgtttccggttagagcatttgggatgcttgctggagggtctggaatcactccaatgttccaagttgctagagcaatattagaaaatccaaatgacaaaaccaaggtgcatcttatctatgccaatgttacatctgaggacattcttttgaaggaagaacttgatggtcttgctaccaactatccggatcaattcaaaatatactatgtgttaaatcagcctccggaagaatggaatggtggtgtcggatttgtatcaaaggagatgattgaaactcattgccctcctccagcacaagatgttaagatattgagatgtgggccaccaccaatgaa

SEQ ID NO: 4116 - DNA, 278 bp, Cicer arietinum
gattactactgtggaactggtggtggttacggtgttcctaccagttatggcggagggtatggtcaaggtgtgactagtgcttgggattaggttagtgtgacatcactaattcattctcatgttgagtgtatataaacttaagactttaacattgtaaagttgtatcttctctaccatggtttgcctgaatccatgcattccttactacaggaaatcttttttcataggaaagatctacaattggcttggttttgctggttaggcacataggggttggt

SEQ ID NO: 4117 - DNA, 406 bp, Cicer arietinum
actcattacctccaaggggcacctctctactcgtagcccgctctacagtagttgtcggtgaagcacgtcccatggacatcaatacagttgatctcagcagagattccctccagcagcgtctcccatctagttcatccagcatatcatcggcacaaaggcgctttactttcaagaggtcatcccgtcagcgggaactattcctctccagcctagaattctcttgcacagatagatcaggtggctttccacgcccaaaggcaggagaaccatgatccctaagctcgccagtagctgcaaccctaggactatgcatccttggggaaaccccttgcaggggaaaaacccaaggcggccagaacgctgctctgtagacgaggcaattgccccgttccacggtctccaggta

SEQ ID NO: 4118 - DNA, 396 bp, Cicer arietinum
acagatcagacctaaacaagcaagtgatgagatgcatgcattttattcttctaaagcttcaacatatatcatcacacatttccaacttcaagtatcccggagttgagagtggtggtttatccttgcaacccaataataccacaagctactctgccgccagcatttccagtagttttgttaagctcgtgaccacctttcccaagatcatcaggatcagcatgaacaacaacagcccttcctatgatggagtttggtccagtgagagggatctgattgtcagtaatagagaagcttacagttccatcatcaccgacattgatatttcctaaatcgccagcatgtcgaatcgggtcctcaggggaaccatgttctttcccattaggattgaaatgtggt

SEQ ID NO: 4119 - DNA, 142 bp, Cicer arietinum
ggccaactatcccatatgagtaagcttcagagtgatgctttgagagaagccatctcaggaatcacggctgattccaaggagaaaaacaggaaatttgtggagactattgaactccagattggtcttaaaaactatgatccac

SEQ ID NO: 4120 - DNA, 450 bp, Cicer arietinum
gattttccgagcgggccgcccgggcaggtcgatttagcttgacacactttcgaccaagatgcagatcttcgtgaaaaccctaacgggtaagacgatcaccctcgaggtggagtcttccgacacaatcgacaatgtcaaagcaaagatccaagacaaggaaggaattccaccagaccaacagcgtctcatcttcgccggaaagcagttggaagacggccgcactctcgccgactacaacatccagaaggaatcaactctccaccttgtcctccgtctccgcggtggcgctaagaagcgtaagaagaagacctacaccaagccaaagaagatcaagcacaagcataagaaggtgaagctcgctgttcttcaattctacaaggttgatgattctggaaaggtgcagaggttgaggaaggagtgtcctaatgctgagtgtggtgctggaacttt

SEQ ID NO: 4121 - DNA, 430 bp, Cicer arietinum
acactcgtccctacctgattgaacttatgttctcagacaccattcaaatctcaaatctaactctcctcaattctccatcatggaatattcatcctgtttgcagcagcaacattattgtgcaaggaatcactattattgctcctgtctcatctcctaatacagatggtatcaacccagactcttgcacaaatacaagaattgaagattgctatatagtttctggggatgactgtgttgctgtgaagagtggatgggatgaatatggcataaaatttgggatgccaaccaaacaactagtaatcagaaggctaacatgcatttcaccatacagtgcaaccatagccttgggaagtgaaatgtcaggagggatacaagatgttagagctgaagacatcacagccattcgaacagaatcaggtgtcaggattaa

SEQ ID NO: 4122 - DNA, 325 bp, Cicer arietinum
tgaaattgttgaaggaaatggtggccctggaaccatcaagaaattcactttcgtcgaagagggagaaaccaagtttgtgttgcacaaagtgggcgcaatagatgacgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggt

SEQ ID NO: 4123 - DNA, 420 bp, Cicer arietinum
ccaagatgtgaagttgcttaactttttgttgagcccagttggtcgtagggttgagtgggccttgaaacttaagggtgttgattatgagtatatagaagaagatatattcaacaaaagcaatctccttttggaattgaacccggttcataagaaagttccggttcttgttcatggacagaaatcgatggcagagtcactaattattcttgaatacattgatgaaacatggaagcaatatccattgctacctcatcatccttatcaaagagctcttgctcgcttttgggctaagttatctgatgagcttgcgctgggtgcatggagggcaatggttaggagaggtgatgaacgggaaaaggttctgaaggaagcgatagaagtaatggagaagatagaacaattgattaaagggaataaatt

SEQ ID NO: 4124 - DNA, 402 bp, Cicer arietinum
acactatttagtcaaagaattcccaattgaactttggatgaactgaattattggtggatgagctggatgatgatgttgaattgacaggaattaatggtggtagagaatcaaatgtctcccattttgtagtaactacaacttctgaggtagaagaatttctagaaggtttgtgttgaagctgctcaaatactaaagaattcccatttgagttcctttgaggttgttgttccaaatttagttgtaatctatgatgcccatttgacatttcttgtggttgttcttgaattggagctagtcttttcccattttgttgaggcttcttcattggggcatgactcccattacaattcttaattttcaacaaatccaaagtttcaacatacttttgaactctttttacct

SEQ ID NO: 4125 - DNA, 264 bp, Cicer arietinum
acttagggttgtgaacaatgttcttggaggtgtgtcttttgtgatgttggcaaggttgacagggtcacaaggtgttggtagtgaagagaaggtgtcaaaattggaggttggattagatgagaaggtggaagaggctttggagaatagcaaccagactaatccatcaaagtgatagcatcacttagttttggttttattatctcttgctttgactaatgtttttgatcagataggcgagggctttttagttttatttttagaatt

SEQ ID NO: 4126 - DNA, 236 bp, Cicer arietinum
tgcacagtttcgcccagggtatttcaagttcagctcttccttataagaggactcctccaagttggctcaagatctctactcaagatgttgaggagaccatctgcaagtttgcaaagaaaggtctaactccatctcaaattggtgttattcttcgtgactctcacggaattgctcaggtcaagagtatcgccggaagcaagattttgcgcatattgaatgctcatggtcttgctccc

SEQ ID NO: 4127 - DNA, 206 bp, Cicer arietinum
actaggtatccacattctgtcagggcaataacaccaggattaccattatttctttataactatactacccatcagcttcatggcatttttgaggcagcaagttttgggggctcaaacatagatccaactgcatgggaggataaaaaatgcaaaggcgagtcaaggtttccagctcaggtaagaatccgtgtcaggaaagtttgcaa

SEQ ID NO: 4128 - DNA, 425 bp, Cicer arietinum
cacttgtttgtttcaatcatcatccatgtcgactactgctggtcaagtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaagggtcagactcctatgtttcctcgtatatttggtcatgaagctggagggattgtggagagcgtaggggagggtgtgactaatctgaaaccaggggatcatgctctgcctgtattcactggggagtgtggggaatgtccacattgtaagtctgaggaaagcaacgtgtgtgatcttcttaggatcaacacagataggggtgtcatgatcaatgataaccagtcaagat

SEQ ID NO: 4129 - DNA, 100 bp, Cicer arietinum
agttggaatacgaccaaatacaagtctgtttgaaggtcaacttactttggagaaaggtgggatcaaagtaaatggaatgttgcagtcaggcaatagctca

SEQ ID NO: 4130 - DNA, 387 bp, Cicer arietinum
atgaatatgaatgttgcttgtgaggagtcaatacgtgactcaccagactatgagcaattttttcaagaaggttattgtaaagcatcagttgactgtcatgaatcaacagaagctactactgatgtggattgtagcagtccctgtggcagggagaaatctgatgaagatggtgatgatgatgacatgcttggtaatgtatttgacttctccgaggaaggtgatttcgatgcaacaagctaaatgctactgaccattgattcaaggaatttaatgttcttcactcacaatattcccagtgcggttattcttctgaccttctaattttcttgtaaatgatgtatattgaaatgcataactataaattatatgtgtgggcactgggtaggt

SEQ ID NO: 4131 - DNA, 130 bp, Cicer arietinum
actcctctatccttcgtggggactgtaattagaatgttgaggaattctggttaggaggctgatgtggagagaatggaaatgccaatttgggcaacggaggttaagggtagtgggaattagggttcatggt

SEQ ID NO: 4132 - DNA, 288 bp, Cicer arietinum
aatgggccttcaaaacttattagtaggctttcagaaaaggaaaatttaaatgggccatatagtttggttttggagcccaaagggttggctttgtattacaaaagtcaaaattcacctaggccaattctttattggttttcatctgattggttttcaattgaaaaggggtcattggaaaatgtcacactcaaatctgatttagacacttttgagattggatttgatttttttgttgctaattcttcaacttttggtaatagaattattggtaggccagtgaataatagt

SEQ ID NO: 4133 - DNA, 351 bp, Cicer arietinum
acctctgtagagtttcccaaaagctccttgagcaaaagcctcgcccatatttagcttcctcaaatcaattgtccactcatcaaaattttcaagcccctcagtaggagaattattgtccatcagagcttgagctaaagcatcgtcactcaatgcatgtgtgactcttccacgacgattgacactgtgtgcaacagagtagttatcattggcacgcctcttcaacccttggtggtccaacatgcgggtatgggaatcattggacccaacactgctgttatcaatagacattgcaaccgatcctccaccattgcttgtttgcaagctaccaacgctgtcgattgacatattggt

SEQ ID NO: 4134 - DNA, 332 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgcatgtcgtggcggcagggaaaatccttgggaaggaatcagaggccggcggtgcggcttgccttcaaaggggaaaaacccatcgcaatcggcgtcgttgatcggaaggatgtcgctaccgatgccacgggcaccgtcct

SEQ ID NO: 4135 - DNA, 397 bp, Cicer arietinum
gagtgatagagagagagagatttcgcaatttcacaaaccctaatttcaaagagatcggcgatggcttcttctaaggatcgtgaaaacttcgtctacatcgccaagctcgccgagcaagctgagcgatacgaagagatggtggattcaatgaagagtgttacaaatctagatgttgaactgactgttgaagaaaggaatttgctttctgttggttataagaatgtgattggtgctcgcagagcatcgtggaggattctgtcttccattgagcaaaaggaagagacaaagggaaacgatgtaaatgcaaaacggattaaggagtataggcataaggttgaatcagagctttcaaacatctgtaatgatgttatgagagtgattgatgaacaccttatac

SEQ ID NO: 4136 - DNA, 280 bp, Cicer arietinum
acggtgttgggatcctatgcgcacttcatgtgggaagcagcggaggaggaagaggaatcagaagtggagttgatagttgctttttaatgggtttgagaatgacacgtgtatgtttctaactggcgttgaatgtgaaaggttatggagtgacaacaataaatagtctcactctcgcatctaatataactgaaactcccataacagagagggaccgaaagtctaacctttctgtatcttgttcttttctacttgttttatttcttctactggatgtaactat

SEQ ID NO: 4137 - DNA, 193 bp, Cicer arietinum
acgagaggaaccgttgattcgcacaattggtcatcgcgcttggttgaaaagccagtggcgcgaagctaccgtgcgttggattatgactgaacgcctctaagtcagaatccgggctagaagcgatgcgtgtgcccgtcgttcgcttgccgaccagcagtagggggccttggccccccagaggcacgtgtcgttg

SEQ ID NO: 4138 - DNA, 371 bp, Cicer arietinum
gaaaattaagctaggaagtttcttacatttattccacaagcagccaaaccccctttacataaagaccattggaaaagccataaaataactacgcaattaagactcttaaaaacatttattgtgacatacactaaaagaacaaggactctaatttaattaaaaaaaacacatcatttggcgcatttattgagactcctaacaaagaacctaacaatgggataaatagcaataacaattacaacaaaagcaacccaaacaataacaacaacaccaaacgcatttccagcaatagagttccaaatagagtttggtgtgaccatagaagcagcaaacaagtaagtaagagcaagacttgtgagtgagacacacat

SEQ ID NO: 4139 - DNA, 191 bp, Cicer arietinum
actagcaagataatgtgttgtagtgatcatgtgttaggcaaagcatgaccaaaattctacagattataaactttttcggtatatgtgaaatgggttgtccctatctatctccctccatgaaagaattcattcaaagtaacttcttgaatatcgatggacacgcctcttattcctctttccttttctttaca

SEQ ID NO: 4140 - DNA, 192 bp, Cicer arietinum
ggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatcca

SEQ ID NO: 4141 - DNA, 437 bp, Cicer arietinum
actggatggatgagaattatctctacacctgcttcggtcaaaccggcgaggtaacatctctgaaagtgattaggaataagcaaaccagtcaatcggaaggttatggttttatcgagtttaattctcgtgctactgccgagagagtgcttcagacatataacggagccattatgcctaatggtggccagagctacagattgaattgggcgactttcagtgctggggagaggtcgtctagacaggatgatggtcctgatcataccatttttgttggtgatttggctgttgatgttactgattaccttcttcaggagacttttagggctcgttataactctgtgaagggggcaaaagttgtgattgataggcttacttgtcggtctaagggttatggttttgttagatttgctgacgagagtgaacaaattggggctatg

SEQ ID NO: 4142 - DNA, 412 bp, Cicer arietinum
gagcttacctgcagaccgtggacaaggcagtcgcctcgtccacagagcagcgttctggccgctttagggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgcgggtaatgag

SEQ ID NO: 4143 - DNA, 251 bp, Cicer arietinum
acactggagctcatgctattgctggaaggcacactcctggaaccttcaccaatcagctacaaacttccttcagtgaacctaggttgcttatcctcaccgatccaagaacagatcaccagccaatcaaggaagctgctcttggaaatattcccaccattgctttctgtgacaccgattctccaatgaattatgttgacattggaattcctgctaacaacaagggaaagcatagcattggttgtctcttttgg

SEQ ID NO: 4144 - DNA, 307 bp, Cicer arietinum
acaatcgcaaagagagggtttggaaagatgttgtttgaaggagagtagtgaataaaactagacaaaaactaaaaaagctaataaaaaaatgcttgcatgcacgggacggaatatcagtagggaatatcaggatggcttgcgagcacagttggagtaggcagctgatctgaatttcttgattccaccgttaggacgaatgtcttcaatgctgtatccgagggggacttcgtagaataatgatgatgatgaattactactactactactagacttctttttacctcctttagactccattagctcattc

SEQ ID NO: 4145 - DNA, 343 bp, Cicer arietinum
ggtgaaacatgagcgagcgaaggaagctttgtgtggtgtgagttagattcgttagatcaaagaagagaaatggagatgacagcacagcaactcagccaatacaacggcacagatccatccaaacccatatacgtctccgtcaaaggccgcgtcttcgatgtcaccaccggtaaatcattctacggtcccggtggaccctacgccatgttcgccggtaaagacgccagcagagcactcgcgaagatgagcaaaagtgaagaagacatcacttcttcccttgacggcctcactgagaaagagatcggagttctcaatgattgggagaccaagtttatcgctaagt

SEQ ID NO: 4146 - DNA, 138 bp, Cicer arietinum
aaactgttttttccatctggttgtgttacaaaggtaagaacttttggtgaaaaggaagaaccttttgttactgataatgggaactatattgttgatttgtatttcgagaagagtattggtgatttgaaggttgcaagt

SEQ ID NO: 4147 - DNA, 288 bp, Cicer arietinum
aatgggccttcacaacttattagtaggctttcagaaaaggaaaatttaaatgggccatatagtttggttttggagcccaaagggttggctttgtattacaaaagtcaaaattcacctaggccaattctttattggttttcatctgattggttttcaattgaaaaggggtcattggaaaatgtcacactcaaatctgatttagacacttttgagattggatttgatttttttgttgctaattcttcaacttttggtaatagaattattggtaggccagtgaataatagt

SEQ ID NO: 4148 - DNA, 377 bp, Cicer arietinum
ctaaaaattgggaaaaccccgaagagctcattccagagagatttgaacatagtccaattgattttaaaggccaaaattttcaatttttaccatttggttttgggagaaggggatgtcctggaatgaattttggaatagctcttgttgaatatgtgttagctaatcttctttattggtttgattggaagttacctgaaactgatttaggcacgcaagatttagatatgagtgaggttttcggacttgttgtgtcaaggaaaaaaccacttcatattaaaccaattctacattttcgtctctaaatatagaattatattgatcaaattataatctattttcgaatgtatttcgtagttagattgattgtttattgttgt

SEQ ID NO: 4149 - DNA, 426 bp, Cicer arietinum
ggaacttgtgctgtttgtgtggttggtggtgaaaggtctcttattgccaacttatcagctgcaaattgctacaaggttgatcatttgaagaaacctgaaaattgggcattagttgaaaaggccaaatatttttatattgctggctttttcctcactgtatcccccgaatccatacaattagttgccgaacatgcagctgcaaataacaaggtcttctcgatgaacctttctgcaccctttatttgtgagttcttcaaggacgcacaggagaaagttcttccatatatggactatgtttttggaaatgagacagaagcaagaacattttctaaagttcatggctgggagactgataatgtcgaggagatagctatcaagatatctcagtggccaaaggcatcaggaacacacaaaaggattactgtt

SEQ ID NO: 4150 - DNA, 190 bp, Cicer arietinum
acaggagagctacacctcatatgcagaagcttatgctgtgggacgacacattcgtatgtctgctgataaagctcgaagagtaatcgatcagattcgtggacgtccgtatgaagaaacacttatgatattggaactcatgccttatcgagcatgtgaggccattcttaagatagtgttttctgctggagca

SEQ ID NO: 4151 - DNA, 399 bp, Cicer arietinum
aaataaaaaggtcgaagagaggcactgccggaagggaacaaccaccgtctttcaattttccggcgatctcctcgtttcttccacctgcgatctaatatcccaacaatcaaacatgactacatcaagacgccttgcagttaggaaggtggagaagtttgagaaaaacatcacaaaaagaggaagtgtgccagaaaccactgttaagaaaggaaaagactatcctgttggccccgtgctgcttggtttcttcgtctttgttgttattggatcatctctctttcagataatcaggacagcaacgagtggaggcatggcataatggagctttgagttggactgtgtcatcttctctttcttagccctgtagaaaatatgactatacttttctacatgtacctg

SEQ ID NO: 4152 - DNA, 309 bp, Cicer arietinum
acgattaaagcttctgatgatttggcttctagtgatggtggtgttgcgacttatttgggaagaccgtggaaggcatattccagaacagtttatatgcaaacatttatagataatgtggttgatgcttctggttggcgtgcatgggatggtgattttgcattaactacattgtattatgctgagtttaataatagtgggccaggctctaacactgatgggagagtgacgtgggaaggttatcatgtgattaatgccaccgatgctgctaattttactgtggcaaatttcttgcttggtgatgattggttg

SEQ ID NO: 4153 - DNA, 284 bp, Cicer arietinum
accacgcatctgcaacaccatcctagccaaaagccaaaagagacaaccaatgctatgctttcccttgttgttagcaggaattccaatgtcaacataattcattggagaatcggtgtcacagaaagcaatggtgggaatatttccaagagcagcttccttgattggctggtgatctgttcttggatcggtgaggataagcaacctaggttcactgaaggaagtttgtagctgattggtgaaggttccaggagtgtgccttccagcaatagcatgagctccagtgt

SEQ ID NO: 4154 - DNA, 406 bp, Cicer arietinum
aaataaaaaggtcgaagagaggcactgccggaagggaacaaccaccgtctttcaattttccggcgatctcctcgtttcttccacctgcgatctaatatcccaacaatcaaacatgactacatcaagacgccttgcagttaggaaggtggagaagtttgagaaaaacatcacaaaaagaggaagtgtgccagaaaccactgttaagaaaggaaaagactatcctgttggccccgtgctgcttggtttcttcgtctttgttgttattggatcatctctctttcagataatcaggacagcaacgagtggaggcatggcataatggagctttgagttggactgtgtcatcttctctttcttagccctgtagaaaatatgactatacttttctacatgtacctgcccgggc

SEQ ID NO: 4155 - DNA, 398 bp, Cicer arietinum
ctctcaaagacagaaacacaagacgaagacagaaacacaagacaaagacaagctactcttcttcatcttcatccttccagcatttgagagttgatctaggcgagccacagtcagaagtcttaacaaatttttggtagacaacagaaccacccattccaagtccttcgtggctcctctcttcacgacagtatcccttaacatccagcaaacagccctgttcaaatgatttgcttgcgttgtccacatgaacagctacagaaaactcagttggttcgaaacaatcaagcactctcaccaccaattcgttcagattcattgttttcaaattgtatcccacagtctcaaagcttgcatagctgaaaccatcttcaggagtaacatgaatggtagaaacagca

SEQ ID NO: 4156 - DNA, 312 bp, Cicer arietinum
gattggttgattgttgggccccgtgtctgactctgtgctgctatgtgtagtgtttcgttatttggacggagggaactagagttctacttgtttggttgtcctctctggatacttcctctcaggggagccattggtttggttgggtggtttcacagtctcctccttaactgatacatggacatgttgtaatataattcttttcctgatacatatgtttagtatatgtgtcattgtctctgtgatacatttattctatgtaatgggtgaccattagttagccgtgtggtttgatgaatttcttcttgtcgtaac

SEQ ID NO: 4157 - DNA, 222 bp, Cicer arietinum
cgggcaggtacctccaggagaagctcaaggcagaaggcaaagaatccacaggccccatcatcgccgacaccgaagaggctattcgtcaggtcatcacaaagcgggctgctcagggtcaacatgagacacccaagttcgcttcagaccctgttggtctctctcgctcatggcatctcagggccgagacttactctaccaacgatgtcaactcctttgggacga

SEQ ID NO: 4158 - DNA, 417 bp, Cicer arietinum
acaaagtgtagaatgtagtctgtggaataatacacaaggactcctgggggcaatcctggaagatcatgcacaagtggggggtttctcttgtcagtgccctgctggattcctattccatgacaaatatgagggatctccaagttgccttggcttgacgaaatatacaacagtaaaaaccatggccaaaaagaagctcaatcctccttctctgagataagcaatgccaaggaagtcattcttcccaccaagccagctagtagttgacaatacaagcttcttcttgccactaaaactatacgtgttgtagcgattctgcaataccacatttatcacatcgcctttctcaagatccacctcaatctttccatacaacttcctgaaggtcggcaaagcagcagttcgcatccagacgataag

SEQ ID NO: 4159 - DNA, 170 bp, Cicer arietinum
tggtactatcattttatccaccacttcagccaactttttaggggtctttacccagtcagggatagggataccaaatgtttctgctcgtagtatagaggctgccatcaaaaactggagatgacttggatcagaggaggagaactgtagcggacgagggaatcgtttcggtg

SEQ ID NO: 4160 - DNA, 319 bp, Cicer arietinum
acagtacgcttttcgtcgtattcgtaacaatgctaggaaccttcttactcttgatgagaagaatccacgtaggatttttgaaggtgaagctttgcttcgtagaatgtttcgttatggattacttgatgagactcagaataagcttgattatgtcttagctcttaccgttgagaatttccttgagcgtcgtcttcagacacttgtttttaaatctggtatggctaagtctattcatcatgctagggttctcatcagacagaggcatatcagggttggtaggcaggtggtgaacatcccctctttcatggttagggttgac

SEQ ID NO: 4161 - DNA, 405 bp, Cicer arietinum; identical to SEQ ID NO: 1195

SEQ ID NO: 4162 - DNA, 417 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatgggaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 4163 - DNA, 405 bp, Cicer arietinum
accctaccaaaattcaaaacactgcatactacccacaatatgaacccacttatatcagcccttaccactttagtctccaaagcaatcagtttacactctctcttctacagaaactcagatgagtaatcaagtcagaaattttcgggctgtttacacattttctctttctccatatgcagcatttcccaaccaacccctatgtgcctaaccagcaaaaccaagccaattgtagatctttcctatgaaaaaagatttcctgtagtaaggaatgcatggattcaggcaaaccatggtagagaagatacaactttacaatgttaaagccttaagtttatatacactcaacatgagaatgaattagtgatgccacactaacctaatcccaagcactagttacaccttgac

SEQ ID NO: 4164 - DNA, 208 bp, Cicer arietinum
gccgaggtacggacaaggtgcctccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacacgcatgaa

SEQ ID NO: 4165 - DNA, 315 bp, Cicer arietinum
acttagatcttgccattattactagaaaggcactcccaaacctatattattattactagaaaggcacccccaaacctaatttatagcgtcacgttacaagagaataaagaatagatgatgaaagcacgagagataaacattctttgaacagatgcaacttcaagttcaagccttgaagtgaaatttgcctggctcagagtatttcgcttccacttgttcaactttgttaaatttaaaacccctgattctcaatacctcaggctccgaggcatctttgaaggcgaccggttcaagagtccaaccattgttctgaac

SEQ ID NO: 4166 - DNA, 358 bp, Cicer arietinum
agaaactcttttcaaaactgatttagatagtaatggaaggattcaagttgatgaatatttgagagttaagggtaggagtaatatttttgcaattggagatattactgatattcaagaaatcaaacaaggagtgtatgcacaaggtcatgctcaattggtagccaagaatctaaagctattgatagaaggaggagggaaagaaaataaattgggaatttacaaagcacaaccaccaatgtctattgtttcacttggaagaaaacatggagttgcacaattccctttcatgacagttgttggaagatttcctggtatgatcaaatcaggagatttgtttgttgggaaaacaagaacctcg

SEQ ID NO: 4167 - DNA, 402 bp, Cicer arietinum
acaataaaacttatcatacttttatttcattaagaacccaagcaaaccgcgaccacatatatattacagcacacatttattacattaattattaactagcgaaaagcaaacatcaacaacaacattctttatttattctcttaattatgatattattattttaaaaggttataattaatcttgtgcagcttttccagcacgatgatcataaccatgaaccccaagattaattattttgaggtattatgccacgaagagatggccaatagtcaagagttttcttcacaccacccataatggtatcatttgttgatccaggtgtaaaattgatacgtgcataatattctcctttgaaaagataagcttcatttgtcttatgagaagcaaaagctgaatccattc

SEQ ID NO: 4168 - DNA, 423 bp, Cicer arietinum
acattagtgttgcgtttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagttaataattaatgtaataaatgtgtgctgtaatatatatgggggcgcggattgcttgggttcttaatg

SEQ ID NO: 4169 - DNA, 471 bp, Cicer arietinum
acatacatatacctacccatacagaagaaaagtatttttttttacagaaaaaacaaaagaagcaaattatatattgtcttctccagcggttgattttggtttcttcactatcaaaacagggcacttcacattctgtgcgcagtgattgctcacgcttccaaggaaagccctcttgatgacaccatagccgtgacttcccatgaccaaaatatcaactacccaatttttgaaccgcatgacatatcacgtccctcggatcgccattctctatcttggtctccacattttggaggtctttacaaactctcttggctttctccaagacacaatcggcaacttggtggctatacttctccatgggtgcagttatgtcagatgaaaaaaggtatcctgtgccatcaaagggcgaataaacggcgcgagggggcttaacatagaagaggataagatggtcgtttgaattttggaaaa

SEQ ID NO: 4170 - DNA, 280 bp, Cicer arietinum
acagtatacttgtgcaaagagactcacacaaagaagtgcactacaggaagcaaatgtgtgaagataaagtcaaccctaagaatgattgatcgttgatttgatcagttacatgtgttgaataactttatatataggaaacttgtcgccaccaggttcgactaaacacaactttaatttgttgtgtatgtgtatgtatttactttccaatgccaagttctttttagatatctcttgacaagctaaattgcaaagtgtgatgccatggaaataaggtgcgggt

SEQ ID NO: 4171 - DNA, 266 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggtcggcggtgcggcttgccttcaaagggga

SEQ ID NO: 4172 - DNA, 358 bp, Cicer arietinum
acgggagatgtcgtgacggttgagctcgaggagaatcgattgatcaatcacacaaccggaaaggagtataagttgaagcctattggagatgccggtcctgtcattgaagccggtggtatctttgcctatgctaggaaaaccggcatgattcctactcgatgagagaaagtcatgttggcagcagcagatgttttgggaggctgactagaattgtttgttcgcctgcattcaaggattctattcagattctctaatcatgcagcttttataaaaatgagtattgtaatttggagttagaattgttaactattttaggaatataaaatgtcaaggctttctattagaacatttgaaaggt

SEQ ID NO: 4173 - DNA, 245 bp, Cicer arietinum
acatgttttaacataaaggccttgtgactgtatggtctgcacctaattactgttaccggtgtggaaatgtagcttctattcttagtttcaatgaaaatatggagagagaagttaagtttttcactgaaacagaggagaacaatcagatgagagggccaaggacaggtgttccatatttcttataacttggcaaaggtttgaatgaatttattgtttaattatgcagtaaatgacttactagtttg

SEQ ID NO: 4174 - DNA, 219 bp, Cicer arietinum
acattacaagaacgtaaacttcaccaaaaacacataatgaaaccgaattaaggtcactttccgggaacaaagttggtggcataggcccatgcattgttgttgacagggtcagaaagatggccagcaaggttctccaaagggccctttccagtgacaatagcttgaacaaagaatccaaacatagagaacatggctaatctaccgatcttaagctctttg

SEQ ID NO: 4175 - DNA, 238 bp, Cicer arietinum
  misc_feature (25)..(25): n is a, c, g, or t
aagggaattcgattttcgaggcggncgcccgggcaggcgctatttccctgttaataatataaaatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaa

SEQ ID NO: 4176 - DNA, 404 bp, Cicer arietinum
acttagcatatataaatctacattgaggatttttggtgaataaaacaaacataatagccattaatccactttgcaaatctctgtgtgagatttgaaacacatcattcaaatgcccattgattctccctacgaacttcctcctcttcctcaggtgtgaagtcattcttgatgttaaaagtcttgcgaatttcttcaggtgtcttccccttaatcatgtctgcaactgtctggcaggtaagatcaagaaggctcttgatgttcaagtagtttgcagccagtatgagatcgaacagcgtagcctggtcaaccttaacaaaatcagcatcccaagccttaagatcatcctcagtaggtttatcatcagaactcgcagcctcaacatgtttcttacaatactcgattac

SEQ ID NO: 4177 - DNA, 447 bp, Cicer arietinum
actttgatctacgccttccttatcgtgatgagactgatgataaagttacagttgaaagtgcagaagcaactctcaagtataacgtagcaatcaagtgtgcaactatcactccagatgaagctcgtgtcaaggagtttggcctgaagcagatgtggaagagtccaaacgggacaattagaaacattttgaatggaactgtcttcagagaaccaattatttgcaaaaacgtccctcgccttattcctggttggacaaagccaatatgtattggaaggcatgcttttggtgatcaatatcgggccactgacagcgtaattaaaggagctggaaagttgaagctggtgtttgttccggaaggccaaggtgaggcgaccgaattggaggtttataacttcactggtgaaggaggtgttgcattggctatgtacctcggccgagaccacgcta

SEQ ID NO: 4178 - DNA, 293 bp, Cicer arietinum
acgaatacgaaccgtgaaagcgtggcctatcgatcctttagtccttcggaatttgaagctagaggtgtcagaaaagttaccacagggataactggcttgtggcagccaagcgttcatagcgacgttgctttttgatccttcgatgtcgactcttcctatcattgtgaagcagaattcaccaagtgttggattgttcacccaccaatagggaacgtgagctgggtttagaccgtcgtgagacaggttagttttaccctactgatgacagtgtcgcaatagtaattcaacctagt

SEQ ID NO: 4179 - DNA, 147 bp, Cicer arietinum
ttcaccaattcataaaactattaaggacactcataagtgtttcaatgattgttcttcttttatgcttgagaagattgctaatggacctggtggggttgttcttgcaactcataatgttgaatcaagaaaattggctgctgcaaaagc

SEQ ID NO: 4180 - DNA, 430 bp, Cicer arietinum
gattactacggtggaactggtggtggttacggtgttcctaccagttatggcggagggtatggtcaaggtgtgactagtgcttgggattaggttagtgtgacatcactaattcattctcatgttgagtgtatataaacttaagactttaacattgtaaagttgtatcttctctaccatggtttgcctgaatccatgcattccttactacaggaaatcttttttcataggaaagatctacaattggcttggttttgctggttaggcacataggggttggttgggaaatgctgcatatggagaaagagaaaatgtgtaaacagcccgaaaatttctgacttgattactcatctgagtttctgtagaagagagagtgtaaactgattgctttggagactaaagtggtaagggctgatataagtgggttcatatt

SEQ ID NO: 4181 - DNA, 304 bp, Cicer arietinum
ttgaacagttttccatcagagaaggaagacactgctcaagaacttgtgtctcataagaacttacttgctgaattgaatgatgcgcaatcaaaatccttcgaaattcattctgccaatgaagcacgcgtcctcgaagtcgaatcacagttacaagaagcattgcagaagcacactgagaaggaatcagaaaccaaagaattgaatgagaagctgatttctcttgaaggacagataaagatttatgaagaacaggtgcgtgaaactgttacaacctctgaaactcataaagctgagctggaggaga

SEQ ID NO: 4182 - DNA, 197 bp, Cicer arietinum
acaaattctactacgatctacataagttctgatattgacaaaaatattattaattatgcatatgatgaatgcttctcaacagaaatgatggaaaaatggataaaaacaacagagttcattcctaagattgaagctttatatataaaaaattatggaactgcaatttagttccatttggtggtggaacttgatgagga

SEQ ID NO: 4183 - DNA, 304 bp, Cicer arietinum
acaagctttgcctcaaaaaaagatgatattagccccttggtgtgatgagaaggatgttgaagtagatgtcaaagcaaggacaaagggtgagatgggagcagcaaagactctttgtagtccctttgatcagccagaactcccagaaggcacaacgtgttttgcgtcaggtaagcctgcaaagaaatggtcatactggggaagaagttactagatcttgattctggtattttttgaagcttgttcaacatgtctgagtttgtggattatgcaaatattagttttcttctgcttggataactaattt

SEQ ID NO: 4184 - DNA, 424 bp, Cicer arietinum
acgcacatagatttctcatcccccaatgaaccaaatataaaggacttcaaattggcaaggggaatcgcatttcagaactccatgcatgcatgaactagaaccgtatatacaatgagcagtgtttgaacctccattcgcagctgacagaatgaaaggtgtaattctgcacctggaaccatggagtagtagccctagtagcgcaaactcgaatataaatcatgaaggttgttgcacgaagacacgacggatcatggtctgcaccatctgctatatgctcctttggtttaggttggggtgctcagatcggtggtgaacttatggattttataattattcttcacgatatgaaagctgtgaagacattctgcagtcgcatgcatttttcccttggtgctggttgtagtgctgccgcaggacctgttgg

SEQ ID NO: 4185 - DNA, 281 bp, Cicer arietinum
gcggcaaaacttcatatttgggaaaaggaaagtttaaaaaacaacatatctcaggatataattcctcacacgagaaacaaggatagaaaaattacacgagtcatgcatatgatagacaaaaaaatctacgacagataaaaaggttggtagaaggatctaaacaaaagaaattcataatctaatcttcatcctcctcatctccatcaccaccagcagccttcttagcagcagccttgaggttccttcgcttcacgcgaccaggacgaccaccaccaagagga

SEQ ID NO: 4186 - DNA, 181 bp, Cicer arietinum
gacagagtttacctggagaccgtggaacggggcaattgcctcgtctacagagcagcgttctggccgccttgggtttttcccctgcaaggggtttccccaaggatgcatagtcctagggttgcagctactggcgagcttagggatcatggttctcctgcctttgggcgtggaaagccacctg

SEQ ID NO: 4187 - DNA, 333 bp, Cicer arietinum
taactcgcgcctctgtctaagaccttcgttcatccaaccgatctcatggctccaaagaaggataaggctcctccaccttcctccaagccagccaaatctggtggcggcaagcagaagaagaagaagtggagcaagggaaagcaaaaggagaaggtgaataacatggtgctctttgatcaggctacctatgacaagctcatatctgaagcacccaaatacaagctcatcactccttcagttctctctgatcgtttgagggttaatggttctcttgcaaggaaggctattagagatttgatggctagaggtttaatcaggatggtatcttcccat

SEQ ID NO: 4188 - DNA, 268 bp, Cicer arietinum
gcaagcagcgtgaaaggtctcactggcggtgatctatccaagccaatcaaaggttacaatatcttgccccagagttggatttaagggtagttatcatttctgttgttgtggtttccttatttaacaaattttattagcattttatctttgttattccctttgacgttagatttttgacgattagttttattctgtcatccattgaaattgagagaatacccaagtcgtttaacaatctaacgtaggggatatcaaagtaggatattgt

SEQ ID NO: 4189 - DNA, 424 bp, Cicer arietinum
ggtgaagaaggttctggtcgtgttaggttaccaccgtgacatttgtgtagttagttgcggctgaaacagaaatcgttggaatctgttatagaaaagaaaaacaaagatgggtagttctggattctcatggaagttaccagatcatcctaagcttccaaagggaaagccaattgctgttattgttttggatggttggggtgaggccaaggaaaatgaatacaactgtattcacatcgctgaagcacccacaatggattcccttaaaaagggtgcacctgaacattggaggttggttagggctcatggtaaagcagtaggtcttccaacagaagatgacatgggcaacagtgaagttggtcacaatgcactcggtgccggtcggatatttgctcaaggtgcaaagcttgttgaccttgctttagaa

SEQ ID NO: 4190 - DNA, 423 bp, Cicer arietinum
  misc_feature (1)..(1): n is a, c, g, or t
nacagcgttgatcgatcaccccttcatcgccaagctagagctcctggcagagatagtccctcatcagagggaaagaattcctatgacagcagccgtggtataccgggaagatcccggttaagacctgctaatcgagtggatgaaactcctgataaaggtgctgctgttccaaagttcggggagtgggatgtgagtaaccctgcatcagctgacagctatactcacattttcaacaaagtgagagaagagaaacaaggcggggccggatatgcacccggaacacctaacgagaggccgcatgttatccgcaggcaacctgcaaatggcaaagcacagtgttgctgctttgcttggggcaaaaaatgacttgtttggaaagtttgaattctaagaaggtgaaaaatggtgttgtgaatgttcatg

SEQ ID NO: 4191 - DNA, 343 bp, Cicer arietinum
gataaaatctatatcacttttacattatggtgatgaaagaacagagaaaattagtgttaatgttacttatggtaatggtaataattatgggttgtatgttgaaaggttcaaatgggtttagtttgtgtgatctgcctgaacttccataaggaacaacgtgttttgcgtcaggtaagcctgcaaagaaatggtcatactggggaagaagttactagatcttgattctggtattttttgaagcttgttcaacatgtctgaatttgtggattatgcaaatattagttttcttctgcttggataactaatttttcaattgatagtttttacttcgattttatacagt

SEQ ID NO: 4192 - DNA, 180 bp, Cicer arietinum
ctacacaataattctcacttgtttgtttcaatcatcatccatgtcgactactgctggtcaagtcatcaaatgcaaagctgcgattgcatgggaggcggggaagccgctggtgatataataagtggaggtggtgccaccacaagtcggtgaagtccgccttaagatactcttcacctccct

SEQ ID NO: 4193 - DNA, 249 bp, Cicer arietinum
cggacgattaacaccatttcgagtccaaggctgatgctggagcatcaaagacatatccacaacaagctggcaccattcgcaaaaatggtcacattgttatcaaaaacagaccctgcaaggtagtggaagtttcaacttcaaaaactgggaagcatggtcatgcaaagtgtcactttgttggtattgacatcttcactggcaaaaaacttgaagattttgttccttcttctcataactgtgatgttcctc

SEQ ID NO: 4194 - DNA, 271 bp, Cicer arietinum
accaaccctgccgttgtcaccgctgctgccggtcgcattgcccccgccggcgtcctcgccgtcctcggtgccattgctctcttctaagcaactcagaacctctgctctacatgtcatggatatatctcgtaatgagcttggacgacaagggaaaagcattggtctttaatgattaatttcacacatgatgaactaaggatggaagcgttgggtatataattcatttctacaacttgcacatagatctcttgatagaggtgcatagacctta

SEQ ID NO: 4195 - DNA, 127 bp, Cicer arietinum
atggggttgttgctcctagtgtgcctctctaaggtttcatctgatcatgagatagaaaaggctgaagacgaagaactacacttatctgataagccgcttattgtgcgatccgggaacagaaggctga

SEQ ID NO: 4196 - DNA, 453 bp, Cicer arietinum
acttggatttgcgaaaaaatgcgatcatggaaaaagctgcaagatcaatttcacaaattagcttggaagtagataggcttgcagggcaggtgattgctcttgagacaataattagtaaaggtggaaagttgtagagacggatgtgcttagcttgattgagaaattgatgaatcaattgattaaattggatggtataatggtcgatggggatgttaaattacagaggaaaatgcaggtaaaaagagttcaaaagtatgttgaaactttggatttgttgaaaattaagaattgtaatgggagtcatgccccaatgaagaagcctcaacaaaatgggaaaagactagctccaattcaagaacaaccacaagaaatgtcaaatgggcatcatagattacaactaaatttggaacaacaacctcaaaggaactcaaatgggaattctttagtatttga

SEQ ID NO: 4197 - DNA, 403 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtga

SEQ ID NO: 4198 - DNA, 392 bp, Cicer arietinum
acttggttattatcactgaaaaagattaccaaagaaaaaagaataagtttctgcccaaaattcatgcatgggtccaggaacatggaggtgggcaaatgattcctttcagctgtgtcttagagaagaatctttcagatatgcctcctgatgaggcagctaaatattgtgaagcgaacaacgttcaaagcgctcttcccaaaataataaagactggattttcagctatcaatctcatttactttttcacagcgggacctgatgaggttaagtgttggcaaattagacgcctaacaaaggctcctcaagctgcaggggctatccatactgattttgaaaagggatttatatgtgctgaggtgatgaagtttgaggatctaaaggaacttggtacc

SEQ ID NO: 4199 - DNA, 120 bp, Cicer arietinum
acttggttttcccaaaaaatgcgatcatggaaaaagctgcaagatcaatttcacgaattagcttggaagtagataggcttgcagggcaggtgattgctcttgagacaataattagtaaag

SEQ ID NO: 4200 - DNA, 434 bp, Cicer arietinum
agctggaattggtagtgatttaaggaagagcacactgaagaatgaaacagtcagccgcaaatttgctttacaagataagctttggtccatttatgccgctggtaatactgtgcctataccattcttaagggctacagatatatctcctattgctctcctttcagacaatgtgcttggcggcatgcaacaggaaaccagtggggaatatcaggatggcttgcgagcacagttggagtaagcagctgatctgaatttcttgattccaccgttaggacgaatgtcttcaatgctgtatccgaggggggcttcgtagaataatgatgatgatgaattactactactactactagacttctttttacctcctttagactccattagctcattcagtcctgatttgataagatcaaattataaaatgccgcagctttcaa

SEQ ID NO: 4201 - DNA, 118 bp, Cicer arietinum
acaagatttcacccctatctagaaacaagaggactgtgaaccgtgcttatggtggagttttatctggaggtgctgtcagagaaagaatcattcgagctttcttggttgaagagcagaa

SEQ ID NO: 4202 - DNA, 349 bp, Cicer arietinum
tcagagctttcatccagaccgtggaatgaggcgactacctcgtccacagagcagcgttctagccgccttggggttttctcctgcaagggttttccccaaggatgcacggtcctaggttgcagctactggcgatcttaggggatcatggacttcctgcctcagggtatggaaagctacttgatctatctgtgcaagagaattctaggctggagaggattagttcccgctgacgggatgacctcttgaaagtaaagcgccttcgtgccgatgatatgctggatgaactagatagaaacgttgctggagggaatctctgctgagatcaactgtattgatgtccaatgggacg

SEQ ID NO: 4203 - DNA, 198 bp, Cicer arietinum
acatggtcgtttctcctggtgtctcctacaggtattttggtgctgcaattgggaagggcaggcaggctgctaaaacagagattgaaaagttaaagcttgccgatatgacctgccgacaaggagttattgaagtagctaagattatatatggagttcatgacgaggcaaaggataaagatttcgaactcgaaatgagct

SEQ ID NO: 4204 - DNA, 399 bp, Cicer arietinum
aaaaattctttcctggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgtccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactgggaaaaaccttgggaaggaatcagacct

SEQ ID NO: 4205 - DNA, 268 bp, Cicer arietinum
gggttttttcagcttctcgttgaaatcgaaaacacaaacaaacaatatgggcagaaaattcttcgtcggcggcaactggaaatgcaatggcaccactgatgaggtgaagaagattgttactactttgaatgaagctaaggtccctggtgaagatgttgttgaagttgttgtgagccccccttatgtgttccttcccgttgtgaaaagtttactcctctctgacttccatgttgctgctcaaaactgttgggttcgcaaaggtggtgct

SEQ ID NO: 4206 - DNA, 194 bp, Cicer arietinum
aatgtgaataaaatcttttctcagaatagaacttctgattctccatctgaatcatcatcaccagataagaaaaagaaactgttagagtttttcaaagaaagtctcaaagataacacaaatgatgaaggtaaagaaaagaaagaactgaaaacaactatacaagatgttcttcctaaatcttcacactcaactcc

SEQ ID NO: 4207 - DNA, 286 bp, Cicer arietinum
gttatgagaatcactggagtgttgtgaaacgaggatgggatgctcaagctcttggtgaagcgccttataagtttacaagtgctgttgaagctgtcaagaaactgagggcagaaccaaaggccaatgaccagtatctgcctccatttgttatcgttgacgagagcgggaaatctgttggtccgatagttgatggggatgctgtggttacattcaacttccgggctgatcgtatgactatgcttgctaaggctcttgaaaatgaaaattttgacaaatttgatagagt

SEQ ID NO: 4208 - DNA, 382 bp, Cicer arietinum
aaacgagttaccacctattccactcactcagccatgaaccgattcagacgagttgaattcatcgaacacgaacctttaatacccttacccttatgtcactactcatcttcaccgttcttcataactgaaaccctagcattcccttccttcgtcgaacaatctctaccgttcgatctaggtcacgatctaggtcacgatctatctcttctcccgagtccattccacgcggacctggtgcgcgtggatcgcacacactcgtttcaattgcagagtttaagcgaccgagtcgccgagttagagtcgcgattcgaccgaatcatcgacgggaagaagaaagagaagaagaagagtagcggcggcggtggaggatgtaatcggaagt

SEQ ID NO: 4209 - DNA, 437 bp, Cicer arietinum
acatggtcgaaccttctggtgtctcctacaggtattttggtgctgcaattgggaagggcaggcaggctgctaaaacagagattgaaaagttaaagcttgccgatatgacctgccgacaaggagttattgaagtagctaagattatatatggagttcatgacgaggcaaaggataaagatttcgaactcgaaatgagctgggtgtgtgaggaatcaaaccgccaacacgaaaaggtcccagaagagcttctacaagaagctaaggcagccgcaaaagcagctcttgaagaaatggatgcagattaaaaatgtttatcccaaagagatgtatttcataaacttgtaatagagagcattttggaacatctatagaaaatattcataggcttcaaaaattggatttttgtatgtttcttgatgattcaatgctgccccttg

SEQ ID NO: 4210 - DNA, 158 bp, Cicer arietinum
actagcaagataatgcgttgtagtgatcatgtgttacgcaaagcatgaccaaaattctacagattataaactttttcggtatatgtgaaatgggttgtccctatctatctccctccatgaaagaattcattcaaagtaacttcttgaatatcgatgga

SEQ ID NO: 4211 - DNA, 351 bp, Cicer arietinum; identical to SEQ ID NO: 1179

SEQ ID NO: 4212 - DNA, 364 bp, Cicer arietinum
acaagctttctcctcggccgctccgccgccgtgcagcaacgccacaagaagcgcccctcaacacagggtgcttccgaggatgctcagaacattccgtccaacatcaaaggacccgaacagttcgtttttgaaggccgccgtgcttcagctaaggacggcacacccaaagatctcaaacttggtaagaagggcaagggtaagggcaggtccagcttgttccaaaaccggggcgcaaggagagctgccgagtggaagaagaagagctgagcgttttatggtgaatagcgctcatatcgctagtggttggcatatgggatgtgtgctcttttcatacgtgagatgaggacgaggatggtgttaaaaa

SEQ ID NO: 4213 - DNA, 424 bp, Cicer arietinum
tagcgtgtcgcggccgaggtaactggatgaagataacaagcccgccgggatggaacaggatgcagataagcccgccgcgattgaacaggatgcaaataacaagcctgcagtggagaggaattcgacggtggggatgcatgtagatgccgtcgacaaagggaagaaaacgatgaagaagcggtggacgttgaagttcgatgaatacatctatgaggttctgaagcaggtgcaccctgatattgctatatccggaaaggccttggatatgatgaacaatatcataaacaagatgatgttgctataaaacctactactaaactagtcacaacctacacacgaaattgattttgtaataacattacaattagattgactgactatttaaagattttgatatgatacaaatgaggtcaagaggactttt

SEQ ID NO: 4214 - DNA, 109 bp, Cicer arietinum
ccgcggaacttggaggctttccatttaggagaattttactcctttctagtgacctagagccaccatcaaaagacttagatgcacctttagcatgcttcaaaactgtgct

SEQ ID NO: 4215 - DNA, 368 bp, Cicer arietinum
cgaaaccactgtcaacggaacgggcttggaggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgatttcggttggccaatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgatt

SEQ ID NO: 4216 - DNA, 317 bp, Cicer arietinum
accttgcttaaatgatagaatgagctagcttgtttcggatacggcaaagtgtctgtccttccattgtgagtaatggtaatataaccttcctcgatatcaatatttggagtcccgtattcacccatcgtcccaagcttaactagatgacaatcctctctgaactcttttatagcaaagagcacattcagtgtcccgacaacattgttttgctgtgtatacacagctcttgaccgatctatcatagagtaaggagcagatctctgttccccgaaatggacaacagcgtcaggttcgtaggacttgaaggtttcagataa

SEQ ID NO: 4217 - DNA, 198 bp, Cicer arietinum
actatcttttgcgcaaccaaaagacaatggagccaataagaaactatggaagaatattacataagaggaccagttcaatatgtggtagttaaaactcaatgttcaaattgcagcattttaagagcaacaaccaccatcttgtgatgcttgaggttcctgtttttgctttaaaatattccttttcactgatgttgatcc

SEQ ID NO: 4218 - DNA, 368 bp, Cicer arietinum
acctttcaaatgttctaatagaaagccttgacattttatattcctaaaatagttaacaattctaactccaaattacaatactcatttttataaaagctgcatgattagagaatctgaatagaatccttgaatgcaggcgaacaaacaattctagtcagcctcccaaaacatctgctgctgccaacatgactttctctcatcgagtaggaatcatgccggttttcctagcataggtaaagataccaccggcttcaatgacaggaccggcatctccaataggcttcaacttatactcctttccggttgtgtgattgatcaatcgattctcctcgagctcaaccgtcactacatctcccgtacctgtccgg

SEQ ID NO: 4219 - DNA, 168 bp, Cicer arietinum
  misc_feature (13)..(13): n is a, c, g, or t
ggcccgttcgccntggcggaaaagggaattcgattagcgtggtcgcggcctaggtactaggtttaatccctattgcgacactgacatcagtagggtaaaactaacctgcctcacgacggtctaatcccagctcacgttccctattggtgggtgaacaatccaacactt

SEQ ID NO: 4220 - DNA, 243 bp, Cicer arietinum
  misc_feature (141)..(141): n is a, c, g, or t
actcattacccccaagaggcacctctctactcgtagctcgccctacagtagttgtcggtgaagtacgtcccattggacatcaatacagctgatcttggcagagcttccctccagcagagtctcccatctagttcatccagnatatcatcggtacaaaggtgtatttactttcaagaggtcatcccgtcagtgggaactattcctctccagtctagaattctcttgcacagatagatcaagcag

SEQ ID NO: 4221 - DNA, 405 bp, Cicer arietinum
gtttataaatacaaatctccaccaccaccatacaagtacccatccccaccaccgccaccatacaaatatccatcaccaccacctccagtttacaagtataagtcccctcctccacccgtttattcaccacctccaccacattatgtttatgcttcacctcctcctccggtctattcccctcctccaccgcattacatctatgcatcacctcctcctccttaccattaatagagagtggtttaccatatcatccatggatttgaggaatatatcgaaaataaagcgaagatagtgcacataaggaatatgcattgtgcaattatacaaaggaaaaatagtggaagcaaagtttctgaagatgtatcgcacaattattaatttgtctcataaaaagaaaaaagtgtc

SEQ ID NO: 4222 - DNA, 346 bp, Cicer arietinum
caaccgatcttatgcctccaaagaaggataaggctcctccaccttcctccaagtcagccaaatctggtggcggcaagcagaagaagaagaagtggagcaagggaaagcaaaaggagaaggtgaataacatggtgctctttgatcaggctacctatgacaagctcatatctgaagcacccaaatacaagctcatcactccttcagttctctctgatcttttgtagggttaatggttctcttgcaaggaaggctattagagatttgatggctagaggtttaatcaggatggtatcttcccattcaagtcagcagatttacaccagggctacaaacacctaagtgtagt

SEQ ID NO: 4223 - DNA, 427 bp, Cicer arietinum
gcagttttcagagaaggaattttggagagttcaccttctccgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggta

SEQ ID NO: 4224 - DNA, 435 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcatgagagaattctggtcggtggaaaaagt

SEQ ID NO: 4225 - DNA, 423 bp, Cicer arietinum
agaagttagaggcaaagttttgggagagagtaagatggcacagtggtcgctactcatcgtgttgttctgcgtcgccaccgccgccgccggattgagcttcgacgacaccaaccctattcggatggtgtcggacatggaggaacagctacttcaagtgatcggagaaagtcaccacgctctctccttcgtccgcttcgctaatagatacggaaagcgatatgataccgtggatgagatgaagcgtagatttaatatcctcaccgataatcttgaacttatcaaatctactaacaagagacgcctcggttacactctcggtgttaatcattttgctgattggacttgggaggagttcagaacacacagacttggtgctgctcaaaattgctctgctactcttaagggtaaccataagattactga

SEQ ID NO: 4226 - DNA, 176 bp, Cicer arietinum
acacaagaagactcccgtgctagttcatgatggaaaacccatatgtgagtcaatgatcattgttgaatacattgatgagatatggccacaaaactcattgcttccagctgatccttatgatagagctcaagcccgattttgggttaaatatatcgatgaaatgatttcgacacttt

SEQ ID NO: 4227 - DNA, 360 bp, Cicer arietinum
acttggtcctaggtttcttggtcctcttgcaattatcagaatttggagtttctgtttgttctatgttatggctgaattgtgggggagtgtggtggtttctgtcctgttttggggttttgctaatcagataactactatcgatgaagcaaaacgtttctacccactgtttggacttggggccaacgtagcccttatattctctggtcggaccgtgaaatacttttctaatatgaggaagaatttaggtcccggagtctatggttgggccgtctctctaaaaggaatgatgagcatagttgttcttatgggttttgcgatctgtttcctctactggtggacgaacacttatgttcctcttcc

SEQ ID NO: 4228 - DNA, 228 bp, Cicer arietinum
acaccaaaaaggtttaaactacatggtgggtggtgataacaactctctgacacacaatggaaatcatttatcagcaacaagggcttcaattttgtttacaatgtgagcttcatgatcctcaaggcgacctttgatcgaatcattctcccaacggatcaacgttggcacacctgtgaacttgaacctaggatccaccctccatggatgttttgagttcctccgatgttg

SEQ ID NO: 4229 - DNA, 429 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacaggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctgcccgggc

SEQ ID NO: 4230 - DNA, 320 bp, Cicer arietinum
accgttgtttcgttggtggtctagcctggaccaccgacagtgacgccctagccaaagccttctcttcctacggcgaagttactgattccaaggttattaacgaccgtgagactggaatgtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtgga

SEQ ID NO: 4231 - DNA, 352 bp, Cicer arietinum
tcttgttttcccaacaaacaaatctcctgatttgatcataccaggaaatcttccaacaactgtcatgaaagggaattgtgcaactccatgttttcttccaagtgaaacaatagacattggtggttgtgctttgtaaattcccaatttattttctttccctcctccttctatcaatagctttagattcttggctaccaattgagcatgaccttgtgcatacactccttgtttgatttcttgaatatcagtaatatctccaattgcaaaaatattactcctacccttaactctcaaatattcatcaacttgaatccttccattactatctaaatcagttttcaaaagagtttct

SEQ ID NO: 4232 - DNA, 471 bp, Cicer arietinum
gatttcgagcgggccgcccgggcaggtacatctgttggagaagagctttgaggaagagaacaaattggagccagagagaaagacccaattggccaagaagctagggttgcaacctaggcaggtggcagtttggtttcagaaccgtagggctaggtggaagaccaaacaacttgaaagagactatgatgttcttaagtcttcctatgattccctactttcaacatatgattccattgttaaggagaatgagaaactcaaatctgaggtggtatccttaaatgagaagcttcaagttcaagctaaagagatgctaggagaacctttgttagacaaggaagctaatccactaccgatcgaaatagcacaaattttcagcatcaaggtggatgaccacatgagtgctggaagtgttggaagtgcagtggtggacgagggtagtccccatgtcattgttgacagtgttgatcctta

SEQ ID NO: 4233 - DNA, 408 bp, Cicer arietinum
cccaaaaaagaagaaggaaacctcgattttactttgaaaatgagacctgctgtagccgctcttattttcctcttccttttcttgtttgcagctacaatagaatcgagaaatgatctaaaggagtattggaaaactattatgaaagatgaagagatgccagtgggaattgaagggcttcttcaactgaaacctgagatagaacctgtgaagaactacaggatcaaagaagaacatgctaaaggtaaatgtgatcagcatcccataacaaacaccttaaatatcatagagaaaaaggtgatcactgaagaatttgaatcaaagcccactatttcaacttctggtgatgatggcaagattgaagattttgagccaagaccaaatgctacaagttatgatggtgatctaaaa

SEQ ID NO: 4234 - DNA, 176 bp, Cicer arietinum
acaacatctcctttacacatcaagcagcaagccatgtatttcccgtgccttggatcacacttggccatcatgctagcaggctcaaacacagcattggtgatttcaggcacagagagctgctcatattatgccttggcagcagagatcacaggtgcgtaggacgaaagcatgaagtg

SEQ ID NO: 4235 - DNA, 277 bp, Cicer arietinum
acaggataccccgcttccttcaccatccagcataccaaggcacaaaaggcgctgtattttctcgagcccgtcacccgtcagcgggttcgggggcatactgccgactttttccaccgaccagaattctctcacgcatcgctacatctgctgacgcagtccacaatctccagtaaccaagttgtagctcgtagtcgtatgtcgtggcggcagggaaaaaccttgggaaggaatcataggccggcggtgcggcttgccttcaaaggggaaaaacccatcg

SEQ ID NO: 4236 - DNA, 205 bp, Cicer arietinum
tacttcatgggattcacttcgaaaacgggcgagaaaactctaagctcaattggatgagcagatgaatgcttatcgtaaattagtttcttctaatatttcgacaaaagctgatgccgcagagagtgatctagagtcttggattgagcggttaataaaataactccatcaagtaaactcacagatgcaagcttgggtatcctctggt

SEQ ID NO: 4237 - DNA, 232 bp, Cicer arietinum
aatttccttttacaaatttctagcaattacatccatatggctttgggaagaggcagtgcattggttgttctactagtttgctttttggtgattcactctgagttggctcaggctgccatctacactgttggaggtgctggtggttggacctttaacactattgcctggcctaatgggaaaaactttaaagctggtgatacacttgtattcaactatattccgggtgcacaca

SEQ ID NO: 4238 - DNA, 405 bp, Cicer arietinum
acattacaagaacgtaaacttcaccaaaaacacataatgaaaccgaattaaggtcactttccgggaacaaagttggtggcataggcccatgcattgttgttgacagggtcagaaagatggtcagcaaggttctccaaagggccctttccagtgacaatagcttgaacaaagaatccaaacatagagaacatggctaatctaccgttcttaagttctttgaccttcaattctgcaaaagcttcagggtcgtcagctaagcccaatgggtcaaagctaccaccagggtagagtgggtcagtgacctcaccaagaggcccaccagcaatacggtaaccttcaacagcacccatcaaaacaacttgggtagcccatatagcaaggatactttgagcatggaccaaactt

SEQ ID NO: 4239 - DNA, 128 bp, Cicer arietinum
acgggctcggtcgccatctagcaagcactaaattatcaagcaacaagacaatcaaaaggattcgtgttcgagggggtaatgtgaagtggagagaaattagattggataccgataacttctcatgggac

SEQ ID NO: 4240 - DNA, 470 bp, Cicer arietinum
acgggctcggccgtcatctagcaagcactaaattatcaagcaacaagacaatcaaaaggattcgtgttcgagggggtaatgtgaagtggagagaaattagattggataccgataacttctcatgggacagtgaagcaataactcgcaagactcgtcctcaggatatggtttacaatgcctcaaataacgagctcgtccgaacgtagactcttgttaagagtgctattgtttaggttgatgctgcaccattcaagcagtatggtgttgaaattggtagaaacatcactatggtgttgaaattggtagaaaaaagaaatcagctgcaaccaagaaggattctgcagagtagttggcttttctttcaaatcggatgtcttttttctcaagatcgtcagctagattcccacattgaagagcagtttggtggtggtcgtttgttggcctgtatttcatctcgtccaggtcaatgt

SEQ ID NO: 4241 - DNA, 447 bp, Cicer arietinum
  misc_feature (6)..(6): n is a, c, g, or t
  misc_feature (9)..(9): n is a, c, g, or t
  misc_feature (12)..(12): n is a, c, g, or t
  misc_feature (134)..(134): n is a, c, g, or t
  misc_feature (150)..(150): n is a, c, g, or t
  misc_feature (260)..(260): n is a, c, g, or t
gattancgnggncgcggccgaggtacacccaacgatttagtggcgctgatattactgaaatttgccagcgtgcatgcaagtatgccataagagagaacattgagaaggacattgaaagagagagaaggagaagngagaaccctgaagccntggaagaggatgttgaagatgaggtagctgaaatcaaggcagctcattttgaggaatcaatgaagtatgcacgaaggtttgttagtgatgctgtatttcgcaaataccangcatttgctcaaacatttgcagcagcccagagggtttggatctgagtttaggtttgcagattccagctctggtggcactactgctgctgcagggacatctgacccatttacatctgctggaggagctgatgatgatgatctttactgttaggtcaaacttgtatgctcgatgttcatttaaagaata

SEQ ID NO: 4242 - DNA, 466 bp, Cicer arietinum
cagcaacaagctccctccacaatgggtatcgatttgaaggcaggaggtaagtccaagaagaccaaaagaaccgcacccaaatccaatgatatctaccttaagcttctcgttaagctttaccgtttccttgttcggaggactgaaagtagtttcaatgctgttatcctcaagcgtctcttcatgagcaaagtcaacaagccaccactatccctctctaggttgattcgcttcatgaagggaaaggagggtaagatagctgtagttgttggagctgtgacagatgacattagggtttatgaagttcctgcaattaaggtaactgctctaaggttcacagaaactgccagagctagaattgagaaggctggtggggagtgcctcacatttgatcagcttgctcttagagctccattgggccagaacacggttcttcttagaggtcctaaaaatgctcgtgaggctgtca

SEQ ID NO: 4243 - DNA, 468 bp, Cicer arietinum
accagttaagagcggtggacctgcaaaacaagtaaaggttgttgatccaaagaaagacgaagattctgatgaagatgaggaaattgcaagctctgatgaagagatggatgatgctgatagcgatgatgatgaggaggatgacagtgatgaagatgctgaggaagagactcctgtgaagaaggtggaccaaggaaagaagaggcccaacgaatctgcttcaaaaactccggtttctaataagaaatcaaaaaatgccacccctgaaaagactgatggcaagaaatctggacatgctgctactcctcaccctaagaaaggtgcaaagactcccaacagtgaatctaagtctcccaagtctggaggacatctctcttgcaaaagctgcagcaagactttcaactccgaaactggactcctacaacacagtaaggctaagcatggtggtcagtgagatattgctgtgttttg

SEQ ID NO: 4244 - DNA, 293 bp, Cicer arietinum; identical to SEQ ID NO: 4178

SEQ ID NO: 4245 - DNA, 431 bp, Cicer arietinum
acttgcaatgtcattagcaccaaaggatgaacatgaagctcaggttcaatttgctctcgagagggggattcctgctatatctgctgtaatgggcacaaagaggcttcccttccctgggagagtatttgatgtagtccattgtgcacgatgtagagttccatggcacatagaaggtggtaaacttctactggagttgaacagagtattgcgtcctggtggtttttttgtatggtctgctactcctgtttatcagaagctttctgaagatgttgaaatatggaatgccatgaaagcactaacaaaagcaatatgctgggaacttgtggcgatcagcaaggatcaagttaatggagttggtgtggccatatacaagaagccactatccaatgagtgttatgagaatcgattaaagaatgagcctccgctgtgtc

SEQ ID NO: 4246 - DNA, 306 bp, Cicer arietinum
acaaggatatggttgaatcctgtagcctacattattacatcccattaaactcacccccatcaacttaaaaaacagcagcttttactctcctaaccaactccttcctcatcagttgcctgtcaaagcctgatgcagccaaaacccctctattttcctcagcccttctcaagaggtaaggcataacagtctctacaggtccaaatggcatgtatttgctgacctgaaaccctgcattgctcaaaccaaaagaaagtgcctctgacattccatatagttgtgcaaattcaagcttgtggttcacctttc

SEQ ID NO: 4247 - DNA, 140 bp, Cicer arietinum
ggaggaagagaaaaacctaccataaaagcccgtctctcagaaggaaaagaattgtcatcgatggcgacattcattcattacataacaaagaagggtggcgggaggaaataaaaaatgaaaaatatataacaatggtatcc

SEQ ID NO: 4248 - DNA, 402 bp, Cicer arietinum
acttcttcactttgctttgtcaccaagtcttcagcggcattcttcgatgtgagtatctctttaactgtttcgtccttctcgacaagtgctgcggagagctttgactgtaaatcacttaatttggattcatagctagctaagtcctgaataagttttgatttttcctcatttattccagcagtttccttttcatggtgaagtgacttgttttgaagctcctcaactactgcttcaagattctttaattttatgagactctcctccagctcagctttatgagtttcagaggttgtaacagtttcacgcacctgttcttcataaatctttatctgtccttcaagagtattcagcttctcattcaattctttggtttctgattccttctcagtgtgcttctgcaat

SEQ ID NO: 4249 - DNA, 203 bp, Cicer arietinum
cacaaactctctccagaatatgggcaccttggagaaaaaaggtttcacagaagagcaagaagctctggtagttaagtcatggacagcaatgaagaagaatactgcagagcttagtctcaaatttttcttggaaatatttgaaattgctccatcagctcagaaactgttctcattcttgaaagattcaaaagttcctttggacc

SEQ ID NO: 4250 - DNA, 334 bp, Cicer arietinum
accaatgttttcccatttttaaatacttagagaactggtgccaagatgagaataggcatggagatttcttctctgccttgatgaaagcacagccacaatttcttaatgactggaaggcgaagttgtggtctcgattcttctgtctatcggtttatgttacaatgtatctcaatgattgccagcgcacggatttctatgaaggaattgggcttaattttaaagaatttgacatgcatgtcatcattgagacaaaccgaaccaccgccagaattttcccagctgttcttgatgttgagaacccagaatttaagcgaaagttggaccggatggtggt

SEQ ID NO: 4251 - DNA, 370 bp, Cicer arietinum
gcggcaaaacttcatatttgggaaaaggaaagtttaaaaaacaacatatctcaggatataattcctcacacgagaaacaaggatagaaaaattacacgagtcatgcatatgatagacaaaaaaatctacgacagataaaaaggttggtagaaggatctaaacaaaagaaattcataatctaatcttcatcctcctcatctccatcaccaccagcagccttcttagcagcagccttgaggttccttcgcttcacgcgaccaggacgaccaccaccaagaggacttgtgagtgagaagtcaatgtgcttctgtgaatcaactctcaccatgaacgatgggatgttgaccacctgccttccaaccctaatgtg

SEQ ID NO: 4252 - DNA, 468 bp, Cicer arietinum
caaagaccaacatggttatggtctttggtgagatcacaacaaaagccaatgttgactatgaaaagattgtccgtgacacatgtagaaacataggttttgtttcagatgatgttggtcttgatgctgacaattgcaaagtccttgtcaacattgaacaacagagtcctgatattgctcaaggtgttcatggccatctcacaaaaagacctgaggaaattggtgctggtgatcaaggtcacatgtttggctatgcaaccgatgaaacacccgagttcatgcctttaagtcatgtcctcgcgacgaaattgggcgcgaaactcaccgaggttcgcaagaatggaacatgcccttggttaagacctgatggtaaaacccaagtcactgttgagtattacaatgacaaaggtgccatggttcctattcgtgtccacactgtgttaatttcaacacagcacgatgaaactgtta

SEQ ID NO: 4253 - DNA, 446 bp, Cicer arietinum
tcaaaatttacaacaaaatcagctttctattcttggtctaatcctaaatccatgcctcttttgccattgaatgaggatcacgatgacggcgacgatgattattatgattataacgatgaagaagaaaaggttagaaaagtaccatctgcttcatcgtcttcttcttcctcttcattggctgaggataagaaacaagaagatgatcaagtggagtttcgtcaatcctatgctgctgaaatgaggcttagattgagaagtttcaagtcaaggagtttttctcttgcagatctgcaagaacatgatgatgaggaagatcatgatcgttaattaataattaacattaacatagactttttcttttattcttttttttttttgttaaataaattttttagtattcactactaagttactactactgaatattgaataacttgtatctttct

SEQ ID NO: 4254 - DNA, 470 bp, Cicer arietinum
cggccgaggtctttcctattcacatctgaatcagtgaacgaaggacaccctgacaaactatgtgaccagatctctgatgctgttcttgatgcttgccttgagcaagatccagacagcaaagttgcttgtgaaacttgcacaaagaccaacatggttatggtctttggtgagatcacaacaaaagccaatgttgactatgaaaagattgtccgtgacacatgtagaaacataggttttgtttcagatgatgttggtcttgatgctgacaattgcaaagtccttgtcaacattgaacaacagagtcctgatattgctcaaggtgttcatggccatctcacaaaaagacctgaggaaattggtgctggtgatcaaggtcacatgtttggctatgcaaccgatgaaacacccgagttcatgcctttaagtcatgtcctcgcgacgaaattgggcgcgaaactcaccgaggttcg

SEQ ID NO: 4255 - DNA, 371 bp, Cicer arietinum
caggtacatacttcttgggattcacttcgaaaacaggcgagaaaactctaagctcaattggatgagcagatgaatgcttatcgtaaattagtttcttctaatatttcgacaaaagctgatgccgcagagagtgatctagagtcttggattgagcggttaataaaataactccatcaagtaaactcacagatgcaagcttgggtatcctctggtggttcagatatggtttctcatactttgactagacaccaagaagttcttcaagatatcacgcaggggttttatcgtcttcgctcaagtcttcgagctaagaaagaacatgcttcacttttagatgattttaaagaatttgattggacgagattagactt

SEQ ID NO: 4256 - DNA, 189 bp, Cicer arietinum
actataatgctgtgaaggaaagtgggtggaaaggtgaagttgaacttgttcatgtggatggagaagaacattgttttcagatctatcatcctgaaactcagaattctattgatatggttaatcgtattgctgcctttcttgtttgatttgagggttatttttatgtagttttgttgttgtttgtggtaa

SEQ ID NO: 4257 - DNA, 408 bp, Cicer arietinum
ggttacaattaatacatttcactttaatacgctaattgcagaaatattatgacacaaacaaaaacaatacacatagaaaatagaaaatagataaggaattgaactcaaatggttaatattctagttaaagacaaattattaagaagaatttgagttcaaattctagccgaaataattttgatcgaaactttacttacatctagattattaaggccctattgccatgagaaatggagggtttaaaacaaaacaaaacacacacacacaaaatagatcaatgaaacaagcttagcagttatctggaggagtgagattacatttagcaggaagtgaagaagcaagaattgggtcaattccaaataaaggtaactctgatgagttcttataagaacaaagacatctcaagtc

SEQ ID NO: 4258 - DNA, 275 bp, Cicer arietinum
tgccattattacccttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactc

SEQ ID NO: 4259 - DNA, 405 bp, Cicer arietinum
gttatcttcgagttcagtcgccgtaacgcgagcgaagacgctgagatccaaatcaacttttcagaatgaagttcaacgttgcaaatccaaccactggatgccagaagaagctggaaatcgatgatgatctgaaactccgtgcattttgggacaagaggatctcgcaagaggttaatggcgatgctttgggcgaggaattcaaaggttatgtcttcaaaatcaccggaggatgtgacaaacaaggttttccaatgaagcagggagtgttaactcctggtcgtgttcgcctcttgctccaccgaggaactccttgtttccgaggatatggaaggcgtaatggagagcgaaggaggaagtctgttcgtggttgcattgttagtccagacctctctgtcttgaacttgg

SEQ ID NO: 4260 - DNA, 462 bp, Cicer arietinum
acgaatgggatgcagatgcagctctagaagcaatgatacgagacagtttggaaagttggattatgattgtatgtaacaagccaaatgaagtaacgattactgattagcaagggtggagaagctctgctgttccagcctggcattaatcattctacaatattggtcctgttagaagtgccaaatattgtttgtgtatatgttatttgatgatattccttgagtgtttgggctcgtgttaataaaattatgtctgattgcctgtctttgatagtgtcatttagatcaaagtcttgttacctcaaatttagagataaaactttggtagtaggttgtgtcacccaaagggtagacctttaatctgaatatcatttcagtgctgtcatggtgtgctagttcccatatttgatgaagtttaggcttcagcttctggactcttgtggagaacatttcgatacttcttac

SEQ ID NO: 4261 - DNA, 141 bp, Cicer arietinum
accgttgtttccttggtggtctagcctggaccaccgacagcgacgccctagccaaagccttctcttcctacggcgaagttactgattccaaggttattaacgaccgtgagactggaaggtcaaggggttttggattgtgac

SEQ ID NO: 4262 - DNA, 223 bp, Cicer arietinum
  misc_feature (66)..(66): n is a, c, g, or t
aaaaaagaatgccagagaagaagctttcaagagcatcccaagaagatcttattcaaaaaaaatggngaaagaagagactacttaggtgttcatccacaaaaacaagagggtttaagctatgttggtattcacattccagttggtagaatccaagcagatgagatggacgagctagctcgtttggccgacgaatatggcacaggggaactccggctaaccgtgg

SEQ ID NO: 4263 - DNA, 281 bp, Cicer arietinum
acagatcgttcgtgatgatctccttgttaccaacccaaagtgtgtggagaaagctattaaggagaagtcttgcaatgcccttttattgaaggtgaatcaaattggtagtgtaactgaaagtattgaagttgtgagaatgtctaagaaagctggctggggtgtcatggctagtcaccgaagtggtgaaactgaggataccttcattgctgatctctcagttgggttagcaacaggtcagatcaagaccggagctccctgcagatccgaaaggcttgctaagt

SEQ ID NO: 4264 - DNA, 467 bp, Cicer arietinum
cgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacgtccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgactggctcgagaaaatac

SEQ ID NO: 4265 - DNA, 301 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtgggtatggtgg

SEQ ID NO: 4266 - DNA, 278 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcattctcgtggtagcggtggtggaggcggccgtggtggcggtggatat

SEQ ID NO: 4267 - DNA, 401 bp, Cicer arietinum
agccctgtgatttcgatcttttctttcttattataatctttaactttagatcgttcttttctagggtttcgtttctctccgcgctttcccttctcccaagttcccactcgtatctgtaagatttcattcgatttgatctcggtgggttgaaggtattgaaagctgcggcattttataatttgatcttatcaaatcaggactgaatgagctaatggagtctaaaggaggtaaaaagaagtctagtagtagtagtagtaattcatcatcatcattattctacgaagcccccctcggatacagcattgaagacattcgtcctaacggtggaatcaagaaattcagatcagctgcttactccaactgtgctcgcaagccatcctgatattccccactggtttcct

SEQ ID NO: 4268 - DNA, 293 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtgga

SEQ ID NO: 4269 - DNA, 402 bp, Cicer arietinum
actcattacccccaagaggcacctctctactcgtagctcgccctacagtagttgtcggtgaagcacgtcccattggacatcaatacagttgatctcagcagagattccctccagcaacgtttctatctagttcatccagcatatcatcggcacgaaggcgctttactttcaagaggtcatcccgtcagcgggaactattcctctccagcctagaattctcttgcacagatagatcaagtagctttccataccctgaggcaggaagtccatgatcccctaagatcgccagtagctgcaacctaggaccgtgcatccttggggaaaacccttgcaggagaaaaccccaaggcggctagaacgctgctctgtggacgaggtagtcgcctcattccacggtctcca

SEQ ID NO: 4270 - DNA, 264 bp, Cicer arietinum
accctccagtttcaccaccttaccactactcctcaccaccaccaccaccaacaaagaaaccatactactaccattctccaccaccaactccaaccaagaagccttacctctattcctcacctcctcctccttaccgctattagatagtaaacaataatagtggtttattaccatagctctctatattatgaagaatatatgaaaataaagaaagtgatggaaggaagatacatcgaaagagaaaaaagggaagcaaagtttccg

SEQ ID NO: 4271 - DNA, 499 bp, Cicer arietinum
tcaagctatgcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccg

SEQ ID NO: 4272 - DNA, 253 bp, Cicer arietinum
acatcaggtttgacaaatggggggacaccatcatactccaatgtcatatctagaccagaatctaatggaagttcaaatacaccaaagacaaatgacttgggaaagaagggaaagaaaccaaaccgagttcttctgtcaacagctggtggcaggcgttattgattattagttctgtggattacgtgtattgtatgcagagtttattacttgtaggaaattagacctgtgtggaaaaataaatgttttcgtcagt

SEQ ID NO: 4273 - DNA, 454 bp, Cicer arietinum
cggcgggagtcactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtatgataagtgggagctggaaacagcgaaagtgaaataccactacttttaacgttattttacttattccgtgaatcggaggcggggcgctgcccctctttttggatccaaggctgacttcggttggccaatccgggcggaagacattgtctggtggggagtttggctggggcggcacatctgttaaaagataacgcaggtgtcctaagatgagctcaacgagaacagaaatctcgtgtggaaca

SEQ ID NO: 4274 - DNA, 317 bp, Cicer arietinum
acaagaagccaagaatctaatccaagctggctacatttatcttgatgttaggacggtggaagagtttgtgaaaggacatgtggatgctgctaagatcattaacattccatatttgttgggtgcacccaaaagcagggtgaagaaccaagattttctaaaggatgtttcatctgcttgcaacaaagaagatcctcttatcgtgggatgccaaattggggtgagatctctgaatgcttctattgatcttctagctgatggttttaagaatgtgaagaacatggaaggaggttatgtggagtgggttagaaacaactttc

SEQ ID NO: 4275 - DNA, 286 bp, Cicer arietinum
actctatcaaatttgtcaaaattttcattttcaagagccttagcaagcatagtcatacgatcagcccggaagttgaatgtaaccacagcatccccatcaactatcggaccaacagatttcccgctctcgtcaacgataacaaatggaggcagatactggtcattggcctttggttctgccctcagtttcttgacagcttcaacagcacttgtaaacttataaggcgcttcaccaagagcttgagcatcccatcctcgtttcacaacactccagtcattctcataac

SEQ ID NO: 4276 - DNA, 174 bp, Cicer arietinum
acgatccttgggatcttcctggcatggcttcttatggagaaaaggagtggtattttttctcgccacgagacaggaaatatccgaacggttcgaggccgaaccgggcggctggatccggatattggaaggcaaccggggcggataaacccataggtcacccgaaaccggttggga

SEQ ID NO: 4277 - DNA, 460 bp, Cicer arietinum
acctcagacgatgaaaccggcgctacccttcaaacaacacaggcagaaaccagccaccagtagttcaccagttacagaaagctcatattttccaccatagatgttaaaacagtgagtaaaatgctacataattttataataactacacaccaccactataaagtagggagataaaaaaattacaaaaatagataataaaaaaaaaagataacagaagtgaaagtcaggctttttagtcatgtatggccttgtgtaggcaaaggttaagtagtggtagtatatatatatatatatcaacaattaggatgcatggacgaaggtgtttatctcattcatgaggcaatagaaatgatcgttgttaggcaagaagtagaaaccaatagtggcttcctttaggtaaagaagtttgacatcttgtcctgaattttttagactttccacatattccaattgccaatct

SEQ ID NO: 4278 - DNA, 468 bp, Cicer arietinum
actctaatccccctgttcacggggctaggattgttgctaatattgttgggactcctgctctcttcgatgaatggaaagcagaaatggaaatgatggctggaaggataaaaaatgttagacaggcgctatatgatagtatttcgtcaaaagacaagagtggaaaggattggtcgttcatacttaagcagataggcatgttctcattcactggcttgaacaagaaccagagtgacaatatgacaaataagtggcatatatacatgacaaaggatggaaggatttccctggcaggattgtcgctggccaaatgtgaataccttgcagatgctattattgattcgtatcacaatgtcagctgaaactcagtgaaacgtgcttttgaagcaagcatatatttttggtgagtattataccaaatcatagtgattggcacacattgcaataattctattatgtatgcattgattg

SEQ ID NO: 4279 - DNA, 468 bp, Cicer arietinum
ccatttcattgttgccgcggtaggggtagaactaaattattcgggatgggtagggttatcagggcacaacgtaagggtgcgggatcagtcttcaaatcccacacccaccaccgtaagggaccagccagattccgcagtctcgatttcggtgaaagaaacggttacctcaagggagtaatcaccgatatcatccatgaccctggtcgtggtgcacccctcgctaaggtctctttccgtcatccttttaggtataagaaacagagtgagcttttcgttgctgctgaaggaatctacactggacagtttatttactgtggaaagaaagctactcttgttgttggtaatgttttgcctctcagatctatccctgaaggagctgttatttgcaatgttgaactccatgttggtgaccgtggtgctttcgctaggtgttctggtgattacgctattgttatcagtcacaacccc

SEQ ID NO: 4280 - DNA, 255 bp, Cicer arietinum
ctctgatttcgagatcgatgaagatgatcttttccatcaaatcgagccacgacacgaagatgaaggaggagacgggaaagaaatggtgaggttgcgagatttgaaatggagaggatgtgatggatgggctgaagttcctaggtatgcggaaaaggctccgaagattgttaagcccagagtgagcccacgggctattcatcagcctaggtagatgatgactagtggaaacaccgtttgcgttgtacctgcccgggc

SEQ ID NO: 4281 - DNA, 419 bp, Cicer arietinum
gattagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 4282 - DNA, 419 bp, Cicer arietinum
acatggaagcaagaccgttggaagatgggcttgcagaggccattgatgaaggcacaattggaccaagggatgaccccaaaatccgttctaaaatcttgtcagagcagtatggttgggataaggatcttgctaagaaaatttggtgttttggacctgagaccactggacccaacatggtggttgatatgtgtaagggagtccagtatttgaatgaaatcaaggattccgttgttgctggattccagtgggcatctaaagaaggtgctttggcagaagaaaacatgagagccatttgttttgaagtgtgtgatgttgtcctccacactgatgctatccatagaggaggtggtcagatcattcctactgccaggagagtgttctatgcctcacagctgacagccaaacctaggcttcttgag

SEQ ID NO: 4283 - DNA, 317 bp, Cicer arietinum
acagatattaaccatgcatgtgttggtcagtctggtttagagagttctagtaacttccctttgttatcaaatgtgcttgcgaacccgacagcaggagaagtggctatttcgtcggagcagatggtctatgatgtggtgctgaagcaggcgtctttggttaagaggaagctgagctctagcagtgaacttgaggtgaaaccggaaattgttttgttttggaaatttgagtttgttgagtgaagcctatgaccgttgtggagaaatttgtgcagaatatgctaaaacattttacctgggaactcttctaatgactccgg

SEQ ID NO: 4284 - DNA, 406 bp, Cicer arietinum
ccgcggaacttggaggctttccatttaggagaattttactcctttctagtgacctagagccaccatcaaaagacttagatgcacctttagcatgcttcaaaactgtgctggaggacacagaagaccttagttgaaaggatgatgttctcttaggtagaaacccattagagttcagtttggatatgttatcagctcctccaagagattgacgccgagaaggcccattgctaacacatcttccctctgaagttccgcggttaatactgttagaagtttctctcaaactctcctgtagcactttaagccgtaattgatatttttcttttaactgtgcttcatactttgcagtgcggtcagctgtagcaagcttatcccgaagttgttgcatctctcccatcaagaatcg

SEQ ID NO: 4285 - DNA, 406 bp, Cicer arietinum
acggacaaggggaatccgactgtttaattaaaacaaagcattgcgatggtccctgtggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttactta

SEQ ID NO: 4286 - DNA, 242 bp, Cicer arietinum
acttctcatgaatacgtttgagacctccatgagagattttgtcccaataagatggatcagccttgctcttctcaaagaactcaacgagagtctcagcggcaaggtcgccatggtaaggatcaatatggtaaccagattttccatgcacaattatctcagcaggaccaccattacaagtagcaaatgtgggcaatccacaagtcatagcctcaacaacagtcaaaccaaaagcttcataaatt

SEQ ID NO: 4287 - DNA, 409 bp, Cicer arietinum
acagagcttacctggagaccgtggaatgaggcgactacctcgtccacagagcagcgttctggccgctttggggttttctcctgcaagggtttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggt

SEQ ID NO: 4288 - DNA, 367 bp, Cicer arietinum
actcagggtaggtagcttccatgtttattcaaaaatcaactcatgagacccttctcagaaaaccctgattttctgattgaccaaatataacctggtcaatttggttccttttgtaaagaaccgagaccgtcattcgcgcgaagttttgttcaccttaatcaaggcatgggcgtcactgtatatagccacaatgtttgagaagactgcgaggactatcatgatgacacatagaactttgtctgatttagtagcgatgttgtagcgatccctacatggttgaaaagatggtggaagacatgttaatttagttatcagcgaaaacataaacacgaaggattagacggcgaaactacatcactggacctgc

SEQ ID NO: 4289 - DNA, 334 bp, Cicer arietinum
accattcactttaccgaaacagggaaagagaccatcagcagaaagcacaagtcttcctgtggactaacattttgagccttgttgcacatttaagtcacaacgaaaccctacatgtggcttcatatcatctgcagtatattttagcagtcgaaacaatctgttcatgtggtagctgagaaagattgctttgaggtttagcgtggacgtggaaatgtggtatgttcaattccttaatggacaactatttggacgtctttgacgccattgggaagatgttctgtaaaatcctttttatttattttgtttctatataggtgacaaattccaaactctt

SEQ ID NO: 4290 - DNA, 438 bp, Cicer arietinum
accacaattcacgccttcaacagtgaatccagcttcacactttccctcaaccgacacacagaagagttcaagtggaactaactcgtctactgagaaaagtgtgaacaaagtggtggataatagtaacaaggaagtaaaaggcaaagaagagaataagaagacagaaaatgcagtgtcatcatcatcatcttctgaaaagccaagtggtgttgtaggcgatcctctaggggatgcacgcaacaaggttcaagatgagattattaaagagtttgcttcaataatggcaagtggaacaatgcgtgctagtgaggctgcagcacttgctactagaagagttatggaaagatatggccaaattgctgtgtcacacagttagctgcaacacttgtttttttcataattataattttaactatttaatgttgctcaaagtgtttg

SEQ ID NO: 4291 - DNA, 469 bp, Cicer arietinum
acaaatacatcacaaagatgatgctaaagaactcattccttcagttctgttatctttgagcggtgacaatggttatagaaacaactcagtatctggggttggaggggcattcctattcgataatttgtttcctggaatgttctatctgcgtcctgttttgaaggaatatgctttctcaccttcggcacaggcaatagagcttggagcaggggaattcaaggaagttattttccaggccacacgagtagcttacagtgctactggctttgtcactctgttagctggccaacccaaaggaggagtttctgttgaagcccggtcagtgtcaaaaggctattttgaggaaactgttacagattcctctgggtattatcgtctgagaggactactgcctgatacggtgtatgttgtcaaagtagctaagagggatgttacaggaagttctaatatagagcgtgcatctccagat

SEQ ID NO: 4292 - DNA, 300 bp, Cicer arietinum
ttacgaatacggaccgtgaaagcgtggcctatcgatcctttagtccttcggaatttgaagctagaggtgtcagaaaagttaccacagggataactggcttgtggcagccaagcgctcatagcgacgttgctttttgatccttcgatgtcggctcttcctatcattgtgaagcagaattcaccaagtgttggattgttcacccaccaatatggaacgtgagctgggattagaccgtcgtgaggcaggttagttttaccctactgatgacagtgtcgcaatagtaattcaacctagtaccta

SEQ ID NO: 4293 - DNA, 262 bp, Cicer arietinum
ggaataactactcactttgaataagtggacaattgaaccattagttgaaacaagtttatatttacacgttttttaaaatctcaagccagacacatacatttttattacattggaaatgacattagaaacacagaaaatcctatgtaataatacataaataaactctacaatgactagtttcacacttccactcttcacacaattatgagtaaagctatttacatggccccttcatgcatgtcttactgggatcacaaccaaa

SEQ ID NO: 4294 - DNA, 398 bp, Cicer arietinum
gtatgagcaatgtatagaaagcattatgcctgccaatagattggaagattttgattataaagaactgtctgtggcacttgagcaactctcaaaattcgagaactcggcaaataatagggttgtcgagtcaggggttctcaagggtataaatatagaagatataaagcgtgctggagagcgtttgatccttcaagatggttgcaccgacttttttcggagagttgttaagaatgaaaatttaaatgccaatgtgcatgttctttcatactgctggtgtggtgacctcattaggtctgctttttcttcagctgatttaaatgagatgaatgttcatgccaatgagttcacttatgagggatctgtttccaccggtgacattgtgaagagggtggagtctc

SEQ ID NO: 4295 - DNA, 184 bp, Cicer arietinum
cagaacatatccccaaaacaaggactgaaagacttgaccaatacaaaggagaaaatacaaagataaaatctgcacgttcagttttgattattggaggaggtccaactggtgttgagctagcagcagagattgctgttgattttcctgataagaaagtaaccatagttcacaaaggatcaagatt

SEQ ID NO: 4296 - DNA, 466 bp, Cicer arietinum
acgagaccattaagaaccagtggcagagtatctcctcggctcaggctaaacgattcacgaaattcagggaaagaaaagggcttattgagaaagatgtggtgagaactgatagatcgatcactttctatgagggggatgataatccaaatgtaaatgttctgcgagatatcctgttgacatattcattctacaacttcgatcttggttattgtcagggaatgagtgatcttctgtctccaatattgtttgtgttagacgacgaatcagaggcattttggtgttttgttgctctgatggaacgtcttggacccaattttaatcgcgaccaaaatggcatgcactctcaactttttgcattatctaagttggtggagatgttggatagtccattgcataactattttaagcagcgtgactgcttaaattatttcttttgtttccgctggattttgattcaatttaaaag

SEQ ID NO: 4297 - DNA, 345 bp, Cicer arietinum
actacacttaggtgtttgtagccctggtgtaaatctgctgacttgaatgggaagataccatcctgattaaacctctagccatcaaatctctaatagccttccttgcaagagaaccattaaccctcaaacgatcagagagaactgaaggagtgatgagcttgtatttgggtgcttcagatatgagcttgtcataggtagcctgatcaaagagcaccatgttattcaccttctccttttgctttcccttgctccacttcttcttcttctgcttgccgccaccagatttggctgacttggaggaaggtggaggagccttatccttctttggagccatgagatcggttg

SEQ ID NO: 4298 - DNA, 380 bp, Cicer arietinum
tactgacttctttcggcctttgaaaaagcttaaggttgggaaatatgagaagaagattgaggaaatttttaacaggtttgaccctgtcattgaaaaggtcatcaagaaaagacaagatgttaggagaagaagaaaggagagaaatggtgaacttgaagagggtgagcagagtgttgtttttcttgatactttgcttgattttgctgaggatgagaccatggagatcaaaattaccaaggaacaaatcaagggtcttgttgtggatttcttctctgcaggaacagattcaaccgctgtggcaacagattggtgtttatcagagctgatcaacaacccaagagtgatgaagaaagctcgagaggaggttgactctgttgttg

SEQ ID NO: 4299 - DNA, 214 bp, Cicer arietinum
actgagacattgtcacaacaacaacccacaagagcttaaggggccccagggctggtatgatcttctaccggaagggacctaagccacccaagaagggtcagcccgagaatgcagtttatgattttgaagacaaaatcaactttgctgttttcccctcccttcagggtggtcctcacgaccaccagattggtgcccttgctattgctttgaaaca

SEQ ID NO: 4300 - DNA, 450 bp, Cicer arietinum
acattagtgatgggtttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagttaataattaatgtaataaatgtgtgctgtaatatatatgtggtcgcggtttgcttgggttcttaatgaaataaaagtatgataagttttattgt

SEQ ID NO: 4301 - DNA, 250 bp, Cicer arietinum
gcaccttgattgaatccgacatctgcggatggagcttgcctacagtggccaagtcctacaatgatgtatgctcattcgtatgaccaatttagacatgctgtttaccaggctccatttggtcaaccgttgagctttgactattcacagaactattagattacatgtaggaggaagaagagatttggatttgaatgcagaatttatgttagctttttaggagatctcattcatattagcttcatttttcagt

SEQ ID NO: 4302 - DNA, 295 bp, Cicer arietinum
ataacaactgcccagtcgagcagcagttcaacgactacaaccaacactcccaaaatcaggaacaccacgccaaactttcccatgaaataatcggtggtgccgctgcctatgaggcagccaaggcatacgaggatcatgttgccaagaatggcaagccagatagccatgcccaggccaaggaattcattgtcggagctgttggtgctttcgttgatcgagagtttgagaccaagggtctggacttctttgacaaggaggaggccaagcgccaaggtgaacatcgagcagaaaggga

SEQ ID NO: 4303 - DNA, 261 bp, Cicer arietinum
acatcactccgcgagatgtcgtgtaaaggcggaatttgttggcatggtgtggcggagcggttgccggcgtctcaggtcaaaggagctatatgactcggagctacgatgatgacagacagtggaagacaattatttgcggtgtttgatgttactaaggattcaataccctattatcatctagtggttcaattgggtgatgcatgatgaagtgtttactgtgcttaataaggattgtatctactactattatgtacctgcccg

SEQ ID NO: 4304 - DNA, 362 bp, Cicer arietinum
agatctcaacaagccaaataaaaatatatattcagacacatgaaacgacaactaaaacaaaaagttggaaaatgtagctttttatttgcaaaatgatggcatattccatcccattcaaatccacattcaaacaatttataataaacaataatgtaacatttctttcattaaatgacgacgacacagattgtcaggagaaaattgatgtcttctagatggaaatattaacaggttctcggaggatcctttccatctgttgtgccctactcctgatagacatatcaaagaccttttggctgaattccagcactagaccaccaagtatgcttgggtcaatcttctgttcaagcttaacctttgcc

SEQ ID NO: 4305 - DNA, 427 bp, Cicer arietinum
  misc_feature (224)..(224): n is a, c, g, or t
gatagaataattggtgtggctttggatttctccaacagcagcaagaacgctctaaaatgggcacttgagaatttagctgaaaaaggtgacaacatttacatcattcacataagccatgattctcttgatgagtctcgtaatcagatatgggccaaatctggttctcctcttattccgttgaaagagttcagagaacccgagataatgaagaagtatggtgttcnaattgatattgaggttcttgatttgcttgacactgtttcaagacaaaaagaggtgaatattgttgcaaaagtatattggggggatgcaagagagaaacttttggatgctattgatgatctgaaactggattctctggttatgggaagcaggggtctcagcacaattcaaaggatattattgggaagtgtaagcaactttgtga

SEQ ID NO: 4306 - DNA, 330 bp, Cicer arietinum
accaagattatcaccatagtcaaaaagccattaattaattagcatcttaattattccaaatggcttcaaaatttgctattattcttctttccctcaacatcctatttttcactatggttacctccaattatgttccatgtcctccaccaccccccaagggtcacaaaccccaccacccaccttcctcaaaatctccaacttgtcctagagacacttttaagtttggtgtgtgtgctgatttattgggtttgattaatgttcaacttggtaagccaccaaagacaccatgttgttcactcattgatggtcttgctaatcttgaagctgctg

SEQ ID NO: 4307 - DNA, 243 bp, Cicer arietinum
  misc_feature (224)..(224): n is a, c, g, or t
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctnttcagaaggagtaaaatct

SEQ ID NO: 4308 - DNA, 426 bp, Cicer arietinum
acaacactagtagctaacacttcaaacatgccggtggctgctcgtgaagcttcaatttatacaggaatcactttagctgagtattttagagatatgggttacaatgtcagtatgatggcagattcaacatctcgatgggcagaagcattgcgtgaaatctcaggaagactggcggaaatgcctgcagatagtggatatccggcttaccttgctgcacgtttagcctctttctatgaacgtgccgggaaagtaaaatgccttggaggtcctgaacggacaggtagtgtaacaattgttggtgctgtttctccacctggaggagatttctcagatcccgtgacatctgcaaccctcagcatagttcaggttttctggggattggacaaaaagcttgctcagaggaagcattttccttctgtgaactgg

SEQ ID NO: 4309 - DNA, 464 bp, Cicer arietinum
actgagacattgccacaacaacaacccacaagagcttaaggggccccagggctggtatgatcttctaccggaagggacctaagccacccaagaagggtcagcccgagaatgcagtttatgattttgaagacaaaatcaactttgctgttttcccctcccttcagggtggtcctcacgaccaccagattggtgcccttgctattgctttgaaacatgtcacgacgcccggattcaaggcatatgccaagcaagttaaggccaatgcagttgcacttggaaattacttgatcagcaagggatacagccttgtcactggaggaactgaaaatcatcttgtcttgtgggatcttcgccctcttggcttgaccggcaataaggtggaaaaactttgtgatctatgtaacatcactgtgaacaagaatgctgtttttggtgatagcagtgccttggctcctggaggagta

SEQ ID NO: 4310 - DNA, 422 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccactttgtgcaacacaaactt

SEQ ID NO: 4311 - DNA, 467 bp, Cicer arietinum
accagcttcgtgaagaacgcgatatgaaaccggagacatttgctagcttagtatctgctattctctacgagaaaaggttcggtccatacttttgccagccagtaattgctggattaggggatgatgacaaaccgttcatttgcacaatggatgcaattggagcaaaggagcttgcaaaagattttgttgttgctgggactgcatctgagtctctgtatggtgcttgtgagtcgatgtttaaggctgacatggaacccgaggaattgtttgagaccatctcccaagcactgctatcatctgtagaccgtgattgccttagtggctggggtggtcatgtctatgttgtcacaccaactgaagtaaaggaaaggattttgaagggaagaatggattaacttctaagactcctggtcaactacttgagttcactttgttttctgtttaattcggaactgaatggcagaaca

SEQ ID NO: 4312 - DNA, 463 bp, Cicer arietinum
actttctttatcgtttggttcacgtttagttgtcgttgtctcttcaccttctttagttcaagaatgctttaataaaaacgatattgttttagcaaaccgaccacagttgttagctggaaaatacatcttttacaactataccaccttaggttcctcttcttacggagaccattggcgtaacctacgtcgtataacagctattgatgttctctcaaacaatcgtcttaactccttcttaggagttcgaacagacgaaacaaatagacttatacaaaagcttctaaacgacactgtttctgatcaaggttttacaaaagtggaactaagacatagactaacggagatgacgtttaatggtatgatgatgatgatatctggaaaaaggtattatggagatgacagagacgtgacggatgttgaagaagcaaaacaatttagagatataataagtgagataatgtct

SEQ ID NO: 4313 - DNA, 417 bp, Cicer arietinum
  misc_feature (406)..(406): n is a, c, g, or t
acagagcttacctggagaccatggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgngggtaataagt

SEQ ID NO: 4314 - DNA, 297 bp, Cicer arietinum
acagagcttacccggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggtattgtaatagttcccgctgacgggatgacctcttgaaagtaaatgcgcctttgtgccgatgatatgctggatgaactagatggga

SEQ ID NO: 4315 - DNA, 416 bp, Cicer arietinum
  misc_feature (230)..(230): n is a, c, g, or t
acatacatatacatacccatacagaagaaaagtatttttttttacagaaaaaacaaaagaagcaaattatatattgtcttctccagcggttgattttggtttcttcactatcaaaacagggcacttcacattctgtgcgcagtgattgctcacgcttccaaggaaagccctcttgatgacaccatagccgtgacttcccatgaccaaaatatcaacacccaatttttganccgcatgacatatcacgtccctcggatcgccattctctatcttggtctccacattttggaggtctttacaaactctcttggctttctccaagacacaatcggcaacttgttggctatacttctccatggttgcagttatgtcagatgaaaaaaggtatcctgtgccatcaaaggccgaataaacgg

SEQ ID NO: 4316 - DNA, 309 bp, Cicer arietinum
acagatcttacctggagaccgtggaatgaggcgactacctcgtctacagagcagcgttctggccaccttgggtttttcccctgcgaggggtttccctaaggatgcatagttctagggttgcagctactggcgatcttaggggttatggttctcctgcctttgggcatggaaagctacttgatctatctgtgcaagagaattctaggctggataggaatagttcccgctgacgggatgacctcttgaaagtaatgcgccttcgtgccgatgatatgctggatgaactagacgaaatcgcagttgcatggg

SEQ ID NO: 4317 - DNA, 420 bp, Cicer arietinum
  misc_feature (225)..(225): n is a, c, g, or t
ggcatccgaagttcaggagggagcatgatgacctctatattgatcacaatctgagcttaactgaggctctatgtggcttccagtttactgtcacacatcttgatgggaggcaactattggtcaaatcaaaccctggggaagtcatcaagccaggtcaacataaagctataaatgatgaggggatgccacaacacaataggcctttcatgaggggacgtctttacntaaagtttagtgttgatttcccagactcaggttttcttccccctagccaaagccaggcattagaaaagatattacctcaaaagaccagcaagaaattgtcgcaaaaagagctagataattgtgaggagaccaccttgcatgatgtcaatattgcggaggagatgagtcgaaagaagcaacaatacagtgaggcat

SEQ ID NO: 4318 - DNA, 122 bp, Cicer arietinum
cccttttggttaaattattattaagaaatttcatagacgccagatggcgctagatataaattattttgcctctgcagaaacaagacactacgctagaaaaccattattattacataataata

SEQ ID NO: 4319 - DNA, 453 bp, Cicer arietinum
actaatccttcaacaaatcgaaacatcatggtaggacagttgagggcgacaaaaccaagtcgaagcgacgaggttttggacagcgaggaacaagtgaggatcacaaatcagatcaaagctcaattcgatgctttaaaacctaaacgacccattaaacccaacagaagcgaacctgaaactcaaaaccccgttgactcaacactctcttcacacaacataccagagcttcaaaaacttcaatctcttcaatctattaattctctcgctatactttcctcagagaatttggtggatccgcaagatgagtttgtggagactcactattacaaggagttgttgtccattgataaacagcatcatgcgacgggaagtgggtttataaaagcggtgagagaaggtggtgaagatggatatgagattaagttacctgcaagctatgttgatgttggtgaa

SEQ ID NO: 4320 - DNA, 471 bp, Cicer arietinum
actaagattgcttctgaaggactcaaacatcgtgtgtttgagatctcattggctgatcttcaaggtgatgaggataatgctttcaggaagattaggttgagggctgaagatgttcagggcaagaatgtcctcaccaacttttatggtatggatttcaccactgacaagctcaggtctttggtccgtaaatggcaaactctcattgaagctcatgtggatgttaagaccactgataattataccttgagaatgttctgcattggctttaccaagagacgcagtaaccaagtgaagagaacctgttatgctcaatccagccagatcagacagatccgcaggaagatgagggagatcatggttaaccaagcaacatcgtgtgatttgaaagagcttgttcgcaagtttatccctgagatgattggaaaggagattgagaaggctacatctagcatttactctctgcagaacgtt

SEQ ID NO: 4321 - DNA, 254 bp, Cicer arietinum
acttgtattattaggggtctagtagacgttctctaggggtatgaaagtttcctcaaccactccaggagtcttaatactcgggtgcgagcaatacagttcaaatttggacagagcgaaagtgaaaagtccggtcgatggtggtccgggtatataccatctattttactgagacttctcgtgctgagtcgagacgcgctgaagagagacaacgaaatcctcgagggatcgctgcttctggttctgcttgggggact

SEQ ID NO: 4322 - DNA, 194 bp, Cicer arietinum
  misc_feature (129)..(129): n is a, c, g, or t
  misc_feature (174)..(174): n is a, c, g, or t
cgtacgccaactctgaggacggtggtatcgtccagaacttcggtaggatcgacgaggttctcttccttgagatctctcttactgagaactggctcatcttcatcacccgtgccaacggccccttctggncttccatcccctcttggcagctggctggtgccattctgatcgtcnatatccttgccaccctcttc

SEQ ID NO: 4323 - DNA, 297 bp, Cicer arietinum
actttcactatggtttggttcacgtttagttgtcgttgtctcttcaccttctttagttcaagaatgctttaataaaaacgatattgttttagcaacccgaccacagttgttagctggaaaatacatcttttacaactataccaccttaggttcctcttcttacggagaccattggcgtaacctacgtcgtataacagctattgatgttctctcaaacaatcgtcttaactccttcttaggagttcgaacagacgaaacaaatagacttatacaaaagcttctaaacgacactgtttc

SEQ ID NO: 4324 - DNA, 482 bp, Cicer arietinum
aagcgagtcgcatgctcccttccgccatggcggaagcgggaattcgatttcgagcggccgcccgggcaggtacagagcttacctggagaccatggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggataggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggta

SEQ ID NO: 4325 - DNA, 270 bp, Cicer arietinum
acaacttcttcaccactggcagtcctgatccaactctaaacacaacttatttacaagatttgcgcaaaatatgtcctaatagtggactaggcaataacctcgccaattttgatccgacgactcctgataaatttgataaaaactattactctaatcttaaggtgaaaaagggtttgcttcaaagtgatcaagaattgttctcaacatctggctttgatactattgacattgttaacaaattcatcaccgaccaaaaagccttttttgaaa

SEQ ID NO: 4326 - DNA, 184 bp, Cicer arietinum
acaacttctttaaccctggcagtcctgatccaactctaaacacaacttatttacaagatttgcgcaaaatatgtcctaatagtggactaggcaataacctcgccaattttgatccgacgactcctgataaatttgataaaaactattactctaatcttaaggtgaaaaagggtttgcttcaaag

SEQ ID NO: 4327 - DNA, 168 bp, Cicer arietinum
gcattactcagtgcacaaactaacacgtatgattatcttccatacttctattcaagggtttttgaatatgaagggagccttagaaaagtatggtggcagttcttcggagacaatgttggagaaacagccgaaattggaaactttgatcctaaaatagctactttttgg

SEQ ID NO: 4328 - DNA, 404 bp, Cicer arietinum
accaccaaacaccaagcaataaacaaagatctaggtgctctcgctcctattcggcttcgtagacacgaaaatcagatgttgatcaaggttgggaacccagtcatttgtagcaggattacttttatatcctctgaattgaatttcaccaacatcaacatagcttgcaggtaacttaatctcatatccatcttcaccaccttctctcaccgcttttataaacccacttcccgtcgcatgatgctgtttatcaatggacaacaactccttgtaatagtgagtctccacaaactcatcttgcggatccaccaaattctctgaggaaagtatagcgagagaattaatagattgaagagattgaagtttttgaagctctggtatgttgtgtgaagagagtgttgagtcaa

SEQ ID NO: 4329 - DNA, 471 bp, Cicer arietinum
tcattattaaactttgatttattgctcttataaccttcacagagaaatcttgttttctttgttaatatagttattatgaatgattgaaaaacaacacaaatgtctccagtaatctgtgagatctctggttttatgataaactccactctcagacgcaggacacatttagttcaatctttctctgttgttttcctctattggttctatattttctcatgaactaaccctattttttccaattttctttccaatacaaatctagtttcattctatctatctaatcaatttaactatctaattaaatactaattaccactatctaaatcgccacatcaaagtttttgaatcttaagcgaacagtcgcatctgcaattgaggctgcatcaatcaaatcaaagatcgcaactcgcgaccgcgatttaaaacctaactacctatggcttctcctggtggagcatattcatctggaac

SEQ ID NO: 4330 - DNA, 469 bp, Cicer arietinum
actgcgaatgaattcgatgcccccgatgatttttacattctggattcagctgaaaatgctggggtggatctaccttactcatgcagagctggtgcatgttctacttgtgccggccaagtggtttcaggttctgtggatcagtctgatcaatcctttctcgatgaccagcaaattgagaagggttatcttctcacatgcgtctcatacccgaaatcagacattgtgatttacactcacaaggaggaagaactctactaagtgatatgtgcttattgtcagcttttctacgcttgctttgaccatgtgttatgtagttggttattgggaaactatgttgatgtttgtgtaacttaatgaatcattttagaaaatcaagagaggaaacaagttacaggacataagtttgttttctaaaactactattattatgttagcctagtttgaatgtattgcactctttgatgcatta

SEQ ID NO: 4331 - DNA, 339 bp, Cicer arietinum
gaaaattcattctcaagtttagtgttacaaaggtaactttagaagagtcacaagaccactgggtggcgttgattgagatagttaatgccaagacatggttttttggctgccaatcttttcaatttttaggttcacagtctgtcattttttgcttccttgaggagcaaatattctatcaaaatgaagtcctattcctaggtttaatctatgtttttattttatttctttttattctggggtagaaaaagaagttacaaaagggtcattggatttaattttcctcaagtctccattttggtccagttttggggatgatacaggatttggatgtgatatttc

SEQ ID NO: 4332 - DNA, 423 bp, Cicer arietinum
actgtgactttcacttgtgcttgaatttggctcagtcactgcatgatagggcagacttcctggaggtggtagatcaggttgcctcacaaccagatgcaatgtgtgaccatcttcaacatggtaggcagacaagagttgatcatcctttagaactttcccttggcaaattaaacgctgctgttcggataacactccagttacagaagcaatctgttctttcagagcagggactggcatctgcttatccactttgagggtataagtttgtgaatccaatgtttttatctttatctcaatagtggtttctgaacttccaatgctgttattgctagggatcttttcaacgccattacttcccattctccacagaccacacaatacacttgaagtagaatcgttatggaagtgagtggagtgaaggag

SEQ ID NO: 4333 - DNA, 190 bp, Cicer arietinum
tttttttttaatacaaaaaggactttctgattggcttctaatcataggatttcaacaacaacaaccctaatttatttggagacttttttttcctcacatttctgaaaaactacacatacatcttagaaaaatatatttttctaagagtgcaattttaaagcatatatgaggtgaaaaaaaagcttccttt

SEQ ID NO: 4334 - DNA, 424 bp, Cicer arietinum
acaacttcatttacactggcagtcctgatccaactctaaacacaacttatttacaagatttgcgcaaaatatgtcctaatagtggactaggcaataacctcgccaattttgatccgacgactcctgataaatttgataaaaactattactctaatcttaaggtgaaaaagggtttgcttcaaagtgatcaagaattgttctcaacatctggcgcagatactattgacattgttaacaaattcagcaccgaccaaaaagccttttttgaaagctttaaggctgccatgattaaaatgagcaatattggtgtgctaactggaaacaaaggagagattagaaaacaatgcaactttattaatcaaaagtcatctgatctagctactatggtctccgaagaatcatctgaagatggtatggctagtgc

SEQ ID NO: 4335 - DNA, 216 bp, Cicer arietinum
actaatatatgactattacgatgacacttgctttattgagagtaagcaacaactaacatccaatatttcaaatttaagtgattgttcattcttcatcccatagatcatcaagaagaggcttggttggtcctttgatgagtctctcctggtgaatttcacttattttcttgtaatcatctttgggcaatgaccaatcaaatatttgcaagttttgat

SEQ ID NO: 4336 - DNA, 274 bp, Cicer arietinum
  misc_feature (248)..(248): n is a, c, g, or t
  misc_feature (252)..(252): n is a, c, g, or t
acctgttgtaggaggccatgcgggagttactattctcccattattttctcaggcaacacctaaagccaatctgagtgatgattacattaaggctctaacaaagaggacacaagagggaggaacagaagttgtggaagctaaggctggaaagggttctgcaactttgtcaatggcttatgctggagccatatttgctgacgcttgcctcaaaggtcttaatggagttccagatgttgctgaatgctcgnatgngcaatccaatatcatcgccgat

SEQ ID NO: 4337 - DNA, 314 bp, Cicer arietinum
gctgctgttccccctgctaagctcttcaaagccatgtcaatagatattcataaccttttcccaaaaattgtgccaattattgacagtgttcagttgactgaaggaactggtgaagctggcaccatcaagatactcaacataaaagaaggggaccaaatcaagcaagtgctgcacagagtggatgaaattgatgaaataaaatttatatacaatttcatcataattggaggcactggtttagctgacacattggaaaaagtgtcattcaagagccaattgtttgatgacgaaaatggaggaacaattaggaaagt

SEQ ID NO: 4338 - DNA, 418 bp, Cicer arietinum
tgtaagactcttccgttttgcattaccttatgaagaccaacaattgggattacccattgggaaacacattttcttatgtgttgccatagatgggaaactatgcatgcgagcttatactccaacgagtagtgtcgatgaaattgggtattttgatttagttgtcaaaatttacttcaaaaacgtgcaccctaagtttcctaatggtggacttatgtcacaatatttggactcacttactattgggtcaatattggacgtaaaaggtccagtgggtcacattgagtatattggaagtggaaacttcatggttcaggggaaacaaaggtttgcgaagaaactaacttttatagctggtgggaccgggatcacacctgtttatcaagtggcgcaagcgatattcaatgacagcgatgaccct

SEQ ID NO: 4339 - DNA, 215 bp, Cicer arietinum
acaaagttttatgattgattaattatctaaaggtggacgttaagattttaccatcccttggttaccttttattttggtgttaggacaggaccgagtagcacttgtgaaaagtcaaatttgattttcaatctagatcaaaagacaataaattcagtaagcatgtttgattcaaaagtagttagttttttttttttctttctaatttgtattctttt

SEQ ID NO: 4340 - DNA, 260 bp, Cicer arietinum
acttattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgagg

SEQ ID NO: 4341 - DNA, 272 bp, Cicer arietinum
cgatctatccgagtctgagaaggttcgactatggcgttcatgaagggaaaggcagtgattaccaaagtggcagctttagcgagttatggcgtgttaccaggtgccatggtggctgctctcgtctactctccccctaattacgccgaaaaacacgcccccgccacctccaattaggggcaccgggtttgcatgatgcaaatcagcaatatgtgagagtcctttagtgaagaagcatgttctgtaataaaatgtgactagatttttgtatttta

SEQ ID NO: 4342 - DNA, 390 bp, Cicer arietinum
acctggggtgatgcgtgcaatgacctcctcgagctcatcagtgtgaatacggagaccatcaagagcattggggcgagagagtttggcgtgggccctggggctgagataatcagggtgacacttgggagagaacttgccatccatgcaaacatagtagtaagggttatcagcagctatgtgagtctcctcagcgacagggtcaagagtgttgactttgtagtgccaaatagcatgagagcgagtgttcttggcggcaggcttgggacccttcacgaggtccgactcggcgtgaacagcctcaatcatggccagctggttcttaggaacaccaagagcagcccagaggaagctctcctgagagacgaccagattacagacaagcttagagag

SEQ ID NO: 4343 - DNA, 342 bp, Cicer arietinum
ggcatccttagtccaggagggagcatgatgacctctatattgatcacaatctgagcttaactgaggctctatgtggcttccagtttactgtcacacatcttgatgggaggcaactattggtcaaatcaaaccctggggaagtcatcaagccaggtcaacataaagctataaatgatgaggggatgccacaacacaataggcctttcatgagggtacgtctttacataaagtttagtgttgatttcccagactcaggttttcttccccctagccaaagccaggcattagaaaagatattacctcaaaagaccagcaagaaattgtcgcaaaaagagctagata

SEQ ID NO: 4344 - DNA, 424 bp, Cicer arietinum
accgttctcttccccggccattgccttatgatgcagaccctaggtatttccgcccacagcatgacaggctagtttcaagacatgagaagggttctagtcatttgaacgaggagtcggaacctctaaggagtgatgtggatatagatcaagaatctttgaattcgagtggtaaatggaatgaaagcactggcaaagatgaatcaaaggaataccgtttctagtcatcggtaagactttcatcggcaaaacttacaactggagctgcacttgtgtatgcatcatcggaagaggaggatgtttgtccaacttgtcttgaagaatacaccgaagagaatccaaagatagtgacaaaatgttctcatcattttcatcttggatgcatatacgagtggatggagagaagtgacagctgtcctgtttgtgg

SEQ ID NO: 4345 - DNA, 408 bp, Cicer arietinum
cgggtcatctagacacggtccacgatgtcgcgatggattactatggaaagaggctggccacggcttcttcggatcacacaattaagataattggggtgagcaactcagcctctcagcctctagcaactctgaccggtcacgaaggacctgtttgggaggtggcatgggctcaccctaagtttggttcactgcttgcttcgtgttcttatgatgggcgtgtcattctatggaaggagggtaaccaaaacgaatgggttcaagctcatgtctttgatgatcacaagtcatctgtgaattcagttgcttgggcgcctcacgagttgggtctctgtttggcttgtgcttcgtctgatgggaatatatctatattcactgcaagagcagatggtggatgggacacctcaagga

SEQ ID NO: 4346 - DNA, 472 bp, Cicer arietinum
actgagctgaacaagaaaatttacaagcttggcaagtctggagaagagacccatgatgcccaaactgattatgataggactgagaaagacatcaccccaatgggtggattcccccactatggtgttgtgaaggaggattatctgatgatcaagggaggtgttgttggtcccaagaaaagggttattactttgcgtcagtctctactcaagcagacttctcgcaatgccttggaggatatcaaacttaagtttatcgatacctcttcaaagtttgggcatggtcgcttccagacaacacaagagaaacagaagttctatggacgcctcaaagcttagttatggctgctgctttgaaatgttggaaatcgttatttatgttatttttgttgccatccttttaaactctgttgtggtgtcttccgttagctattttggtaatccgtgcatactcatgggttatttttgcagcacc

SEQ ID NO: 4347 - DNA, 249 bp, Cicer arietinum
acccaagtgttccccgagcacaagttgagatatgactcatatccgtttgagccaaccgtgataacccgaaatctgaaaccttagcattcatcttaaaatcaagaagaatgttgcttgatttaacatctctatggtaaataggaggaacagccatgaagtgaagataagcaagaccttccgaagtgtcgcgtgcgacatgaagccgatgattccaagtatagtgaagcacgaccctttggcatttgacct

SEQ ID NO: 4348 - DNA, 382 bp, Cicer arietinum
caaccttatgtttttagtaacaactggaaaggaaggaagtgaagaagaattcaagagtttatgcaagaaatctggattttccaaatttcacgttgcttgcggtgatgatgtatcagcaatgtcaggggtgatggaattttataaatagaagttacttagtaggaacatggaatcttgatatatcctcaacattttataaagttgtaaaataataatactgtgatttgcaaagaataagcagttatgccccactcttagaaagatgtatgtttatatgtttttcatgtgttcgtattaatgatttatgagttgtcagattaatggcaaaagtttgatttgtaactttaaaggaataaattcaaaaaatttcgtagaaagttgt

SEQ ID NO: 4349 - DNA, 143 bp, Cicer arietinum
gatttcggagcgggccgcccgggcaggtacttttttcaacttaacataattcagcaaattattttaaacactacacaatcactgaatttgtccatttagtagagccttgtttgttactgtagaacaaaacattgttctgaacc

SEQ ID NO: 4350 - DNA, 366 bp, Cicer arietinum; identical to SEQ ID NO: 3788

SEQ ID NO: 4351 - DNA, 454 bp, Cicer arietinum
gatttcgagcgccgcccgggcaggtacatgaaggttaccggtaatgttttcaagaacaagagagtcttgatggagagcattcacaagtcgaaggctgagaaggcaagagagaagactttgtctgaccagtttgaggccaagcgtgcaaagaacaaggcaagcagggaaaggaaatttgctaggcgtgaggagcgatttgctcaaggtcctggtgaaaaagtatcagcgcctagtgctccaccctttacaactccccagcctgcccaagtgccaaagaaatccgagaagtgagcagcctaccgagaaattaaaaggaagttgaatatttgatgacactggcatattcctgtagtctgctacaaatgtgttaagtattcccttttttgatggtttggactttgtcttatataactataaacttatttcttgcaaactttattttatagtacctcgg

SEQ ID NO: 4352 - DNA, 459 bp, Cicer arietinum
gtctgacttcagagaacaatataagaaggatcatcctaataacaaatccgtcgccgctgtcggtaaagcttgcggagaagaatggaaatcgttgtctgatgctgataaggctccctatgttgctagggcattgaagaagaaagcagagtatgagaaaaatgttcaggcttacaataggaaacaggcgggaatagaggaggaaggtggttctgacttgtcgaaatctgaagttcatgatgaggatgaagaggaggaggacgatgatgaagatgatgatgagtgaagttgctgttacacgtgatgaatcttaggagaaaattggggaaaaaatatttgttttgcttaggttggggttataatatgttgtgatgtaaccaacccacttttattatctgatgatagtttatgaatttttattgtcttgttgtctaggtttagatagtgaacaatcctaattac

SEQ ID NO: 4353 - DNA, 311 bp, Cicer arietinum
gtacgcacaaagacagtgaagaaatcctctcgtcaagttatcgagaggtattactctcgtatgacactcgatttccacaccaacaagaagattttggaagaggttgctctcattccatccaagaggcttcgtaacaagatcgccggattctccactcatctcatgaagcggatccagaaaggacctgttcgtggaatctcattgaagcttcaagaggaggagcgtgagcgtcgtatggatttcgttcccgaagtctctgccattaggaccgaccagatcgaagtcgactaggaaaccttggacatgcttgc

SEQ ID NO: 4354 - DNA, 401 bp, Cicer arietinum
acccgaggcatcgatgactcaccgtcctcatcgtcatcgtcatcatatgcctcactgtattgttgcttctttcgactcatctcctccgcaatattgacatcatgcaaggtggtctcctcacaattatctagctctttttgcgacaatttcttgctggtcttttgaggtaatatcttttctaatgcctggctttggctagggggaagaaaacctgagtctgggaaatcaacactaaactttatgtaaagacgtcccctcatgaaaggcctattgtgttgtggcatcccctcatcatttatagctttatgttgacctggcttgatgacttccccagggtttgatttgaccaatagttgcctcccatcaagatgtgtgacagtaaactggaagccacatagagc

SEQ ID NO: 4355 - DNA, 360 bp, Cicer arietinum
acgggagatgtagtgacggttgagctcgaggagaatcgattgatcaatcacacaaccggaaaggagtataagttgaagcctattggagatgccggtcctgtcattgaagccggtggtatctttgcctatgctaggaaaaccggcatgattcctactcgatgagagaaagtcatgttggcagcagcagatgttttgggaggctgactagaattgtttgttcgcctgcattcaaggattctattcagattctctaatcatgcagcttttataaaaatgagtattgtaatttggagttagaattgttaactattttaggaatataaaatgtcaaggctttctattagaacatttgaaaggtac

SEQ ID NO: 4356 - DNA, 290 bp, Cicer arietinum
actatgatgccttatacagatcaggcttttcgtctgaattgggcttcattcagcgctggtggcggtgagagacgttcttctgatgctacttctgatctctctatatttgtgggggacttggccatagatgttactgatgctatgctgcaagaggtgtttgctagcagatactcatctattaagggagcaaaagttgtcattgattctaattctggccgtttcaaaaggctatggttttgttaggtttggtgatgaaaatgagaggacaagggcaatgactgaaatgaatg

SEQ ID NO: 4357 - DNA, 331 bp, Cicer arietinum
actatgatgcctaataccgatcaggcttttcgtctgaattgggcttcattcagcgctggtggcggtgagagacgttcttctgatgctacttctgatctctctatatttgtgggggacttggccatagatgttactgatgctatgctgcaagaggtgtttgctagcagatactcatctattaagggagcaaaagttgtcattgattctaattctggccgttcaaaaggctatggttttgttaggtttggtgatgaaaatgagaggacaagggcaatgactgaaatgaatggtgtttattgttctagcagggcgatgcgaataggtgttgcaa

SEQ ID NO: 4358 - DNA, 335 bp, Cicer arietinum
accagtgctacctggcctttatccaacagatatcgacagagggactcagaatcctcaattttaccaaatccttcagcttctcttccataatagaagctgaagtcaatgaataaataaaatgctccctggggttcagatattttaacaccatctatttcgccgaaacttttaaccaagtaatcccttcgttccctaaatgctttcaccatgatcgaaacatcctccccaccagcatagcctagtcctaatgcagcaaccgcagctttctgagatatactactggcccctgaagtgaactgactttgaatctttccacatgctgcaatgaaatgttt

SEQ ID NO: 4359 - DNA, 428 bp, Cicer arietinum
atctccagggatatttgctggggaaccccatgacaacacgaaatgaaaaaaatgatcaaatcccatatgctcacggaatgggactcatctctgatgaactctatgcgtcactacagagaaattgcaaaggagagtatattgatgtggattccaaaaatgagttgtgtttaagagatgtccagtattttcaagagtgcctttcaggaattaataaattcaacattttggatcgcttatgtgaagatgatgagcatctatggagaagatatttaactcaagacatgaagacatttagttctcatctcaaagtgcctgaattaaattgccaaatttatggtttttacctcgcaactaaatgggctaatgatgagcatgttcgcaagtcactgcacattcgtgagggaaccatagggaaatgggaacgttgt

SEQ ID NO: 4360 - DNA, 293 bp, Cicer arietinum; identical to SEQ ID NO: 1098

SEQ ID NO: 4361 - DNA, 469 bp, Cicer arietinum
cggcagcgagtcaagactcggtctcgtgtgaagcgatcgaacttagccaagccgaagttaacaactgataatgaggaaaaaagtagcaataacaaaggaattgaatccggttctgttgaaccggttgaagaagtgatgaaccggtccgcgagtcatgaatcatcgctaagccaccagtctgaggcggtaaatgcggcggcggtggatggagagagtaaagagagtgatgaaagtatggcttcggttgaaacggctgagacttcgatgaacttatttagagatgaaccggagtcaaccagagatttgaaacgggtggaccgaaccggtgaaagtggagaggaaaatgttggtttagaattgactcttgggtttgaaccggtttcacgtgttcatcacgtggttcctgtgaagaaaagaagagttgaattgaaagattgtggtggcggctcatggaagattgagctggggc

SEQ ID NO: 4362 - DNA, 462 bp, Cicer arietinum
  misc_feature (387)..(387): n is a, c, g, or t
accgttctcctccaaggccattgccttatgatgcagaccctaggtatttccgcccacagcatgacaggctagtttcaagacatgagaagggttctagtcatttgaacgaggagtcggaacctctaaggagtgatgtggatatagatcaagaatctttgaattcgagtggtaaatggaatgaaagcactggcaaagatgaatcaaaggaataccgttccaagtcatcggtaagactttcatcggcaaaacttacaactggagctgcacttgtgtatgcatcatcggaagaggaggatgtttgtccaacttgtcttgaagaatacaccgaagagaatccaaagatagtgacaaaatgttctcatcattttcatcttggatgcatatacnagtggatggagagaagtgacagctgtcctgtttgtgggaaggtaatggtattcgatgagacgacttaatcttttg

SEQ ID NO: 4363 - DNA, 181 bp, Cicer arietinum
gtctgacttctgcgaacaatataagaaggatcatcctaataacaaatccgtcgccgctgtcggtaaagcttgcggagaagaatggaaatcgttgtctgatgctgataaggctccctatgttgctagggcattgaagaagaaagcagagtatgagaaaaatgttcaggcttacaataggaaa

SEQ ID NO: 4364 - DNA, 203 bp, Cicer arietinum
gtacgctttacacagtgaagaaagaatctcgtcaagttatcgagaggtattactctcgtatgacactcgatttccacaccaacaagaagattttggaagaggttgctctcattccatccaagaggcttcgtaactagatcgccggattctccactcatctcatgaagcggatccagaaaggacctgttcgtggaatctcattg

SEQ ID NO: 4365 - DNA, 459 bp, Cicer arietinum
gatttcgagcgccgcccgggcaggtacatgaaggttaacggtaatgttttcaagaacaagagagtcttgatggagagcattcacaagtcgaaggctgagaaggcaagagagaagactttgtctgaccagtttgaggccaagcgtgcaaagaacaaggcaagcagggaaaggaaatttgctaggcgtgaggagcgatttgctcaaggtcctggtgaaaaagtatcagcgcctagtgctccacccgctacaactccccagcctgcccaagtgccaaagaaatccaagaagtgagcagcctaccgagaaattaaaaggaagttgaatatttgatgacactggcatattcctgtagtctgctacaaatgtgttaagtattcccttttttgatggtttggactttgtcttatataactataaacttatttcttgcaaactttattttatagtacctcggccgcg

SEQ ID NO: 4366 - DNA, 158 bp, Cicer arietinum
actttgacttaccccttccttatcgtgatgagactgatgataaagttacagttgaaagtgcagaagcgactctcaagtataacgtagcaatcaagtgtacaactatcactccagatgaagctcgtgtcaaggagtttggcctgaagcagatgtggaag

SEQ ID NO: 4367 - DNA, 325 bp, Cicer arietinum
actaccaattccatttactaatgatcctaagaagagtctcttcattcttaaggaaggaagccaatgccgcatgaaattcaccttcactgtttcgaacaacatcgtttctggtctcaaatacaccaatattgtctggaaaactggggttagagtggatagcagaaaaaaaatgttgggaacttttagtcctcagcaggaaccatttttatatgaattggaagaagaaactactccttctggtatatttgctaggggaacctattcagcaagaaccaagtttgtagatgacgatcgaaaatgctacttggatgtgagttactacttt

SEQ ID NO: 4368 - DNA, 400 bp, Cicer arietinum
accatataacccagctacaaatttaaaaataatactacagttcacttaagagagcaataaaatccatcctatttcaataccagttctgctatgaccgttaggaagcaccttgaattgcagcagcaggttgcatagctatatcctgattctgtctagcagcaaatccatgacctccatatccatggcctccataaccatgcttatttcctggactgcgaccccaagaaaggcgcactgtctgcttcccaatcattgttccgttcaatgcttgaattgcgtcctcagcattctttctgtcagcaagttgaacaaaaccacatcctttaccgactggaatcttcacagagacaacatcaccaaattgcaaaaatggttgtctgagatcctcatcactgatgtc

SEQ ID NO: 4369 - DNA, 438 bp, Cicer arietinum
cggcagcgagtcaagactcggtctcgtgtgaagcgatcgaacttagccaagccgaagttaacaactgataatgaggaaaaaagtagcaataacaaaggaattgaatccggttctgttgaaccggttgaagaagtgatgaaccggtccgcgagtcatgaatcatcgctaagccaccagtctgaggcggtaaatgcggcggcggtggatggagagagtaaagagagtgatgaaagtatggcttcggttgaaacggctgagacttcgatgaacttatttagagatgaaccggagtcaaccagagatttgaaacgggtggaccgaaccggtgaaagtggagaggaaaatgttggtttagaattgactcttgggtttgaaccggtttcacgtgttcatcacgtggttcctgtgaagaaaagaagagttgaattgaaagattgt

SEQ ID NO: 4370 - DNA, 373 bp, Cicer arietinum
ccacagagcagcgttctagccgccttgggtttttccctgcgaggggtttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagt

SEQ ID NO: 4371 - DNA, 459 bp, Cicer arietinum
acgagcttggtcgccagccagctaacaccaagctatcaagcaacaaaactgttagacgcattcgtgttagaggtggcaatgtgaagtggagagctctcagattggatactggaaatttctcatggggaagtgaagctgtcactcgtaaaacccgtttgctcgatgtggtttacaatgcttccaacaatgagcttgtgcgaactcagacccttgtgaagagtgctatcgtgcaggttgatgctgctcctttcaagcagtggtatcttcaacactacggtgttgaaattggaaggaaaaagaaaactgcttccaaaaaagatacaccagaggaggccgaagctgttacagaagaagccaagaagagtaaccatgtccaaagaaaattagagacccgccagaaagaacgccagcttgattcccacattgaagagcaatttggtggtgggcgtttgcttgcat

SEQ ID NO: 4372 - DNA, 326 bp, Cicer arietinum
aaaagcaatattgccgcttccgtatctaatttcagtgttgtttccgttgacgaagaccaaattgctgcaaatttagtaaagaatggccctcttgcagttgctattaacgcagcctggatgcaaacatatatgagtggtgtctcatgcccatacatctgtgcaaaatcgcgtttggatcatggggttcttctagttggttttggaaatggttttgctcccatccgattgaaggaaaagccttactggatcataaagaattcatggggacagaattggggtgaggaaggatattacaagatctgcagaggtcgaaatatatgtggagt

SEQ ID NO: 4373 - DNA, 452 bp, Cicer arietinum
acggccgagtcagatcagggatctctatctgcaacaaattagggcttattacttctcagagatccattcttcaacgctccctcatcgccccttccatttcgcaggcttccagaaattatgctaacataccagggcaaaaggaaaccaaaattaaggtccccatcgctatgtttggaggttcaggaaactatgcctctgctttgtatattgcagcagtgaaagctaaagcagtggaaaaggttgattctgagcttcttcaatttgttgaggcggtaaagggtagtgcgataacctcacagtttataaaggacatatctgtggccaaggatatcagagtaaaggccatccaggagatttgcgaccaagctaagttttcagatgttacaaagaacttccttgttatcgttgctgagaatgggaggcttaaagacatagacaccattgcaaagagg

SEQ ID NO: 4374 - DNA, 469 bp, Cicer arietinum
gatagaataattggtgtggctttggatttctccaacagcagcaagaacgctctaaaatgggcacttgagaatttagctgaaaaaggtgacaacatttacatcattcacataagccatgattctcttgatgagtctcgtaatcagatatgggccaaatctggttctcctcttattccgttgaaagagttcagagaacccgagataatgaagaagtatggtgttcaaattgatattgaggttcttgatttgcttgacactgtttcaagacaaaaagaggtgaatattgttgcaaaagtatattggggggatgcaagagagaaacttttggatgctattgatgatctgaaactggattctctggttatgggaagcaggggtctcagcacaattcaaaggatattattgggaagtgtaagcaactttgtgatgactcatgctccttgccccgtgactattgtcaaggatctga

SEQ ID NO: 4375 - DNA, 183 bp, Cicer arietinum
acagagcttttctcgagaccgtggaatgaggcgactacctcgtccacagagcagcgttctggccgctttggggttttctcctgcaagggttttccccaaggatgcacggtcctaggttgcagctactggcgatcttaggggatcatggacttcctgcctcagggtatggaaagctacttgatc

SEQ ID NO: 4376 - DNA, 243 bp, Cicer arietinum
acacacttgccctacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatct

SEQ ID NO: 4377 - DNA, 362 bp, Cicer arietinum
acctagtctaataaaacaggctcaatctgaagagtggataaaaaccagtgccgaaaagataaatagtcaatcaccaaggaagtaaatccgagtataataaatatcttaagaaacaaggctttcattaagtgataatgaagacagctgatcagcagcaccgccagcctgctgttgtgcaacattcctaaggacgtccattgcttctgccaccttcgctttcagggcctccggggactcaagcaagtgcagaacttcagtctggtccatctccagaagcatgccagtaactttggcggcattggcgggctccaattgctccactagggggtaaagattctcaccgagcatcgtcctctgctgct

SEQ ID NO: 4378 - DNA, 407 bp, Cicer arietinum
actggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatccaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggacagtgggaat

SEQ ID NO: 4379 - DNA, 402 bp, Cicer arietinum
acaaagtaaatcttccaaaagcaaccatcactcatatatccaggacaaagctccattctaagagcagctaaacttggagcaagatgttcaacagccaaagcatgttcttgttgtgcatcagacaaatcaaaatcatcagaatcaggatcatcgggaagtggaaaatcgagccaagtttctggatgcatcgctaggtttctggcaaaggcgacaacctcctccgtaactccaaccacaccgtcgagatcgtattcctcttcggatccgatttgaaggaaactggaagcgatcttggtgaattcagatacggttttgttaccggaaagctttgagatcccgctcttgaattttccactaatttcagcgaaatcgcttcggattccagcgataacgtcttcatcg

SEQ ID NO: 4380 - DNA, 430 bp, Cicer arietinum
acgacactgttcctggtcaatggaagcattttgaccttaaggttaaggactctaaaacccttctctttggtgagaagaccgttactgtttttggaactaggaaccctgaggagattccatggggtgaggttggagctgattatgttgttgagtcaactggtgttttcactgacaaggataaagctgctgctcacttggagggtggtgccaagaaggttgtcatttcagccccaagcaaagatgcacccatgtttgttgttggtgttaacgaaaatgaatacaagccagagcttaacattgtttccaatgctagctgcacaaccaattgccttgctccccttgccaaggttcttaatgaccgatttggaatcgtcgagggtcttatgaccactgtccactccatcacagctacccagaagactgttgacgg

SEQ ID NO: 4381 - DNA, 363 bp, Cicer arietinum
acgagccttggacttgtgtggcattagcaagttcctcaggtgtagagtcacccgccttggtcttgcgtgcacgtcttgggaaaacaaccaacttggccttgtatgttttcagcctctgcacattagcttgcaggccttccaaagaagggttcctgcggcgatgatcaatggcaatgccaatggttggagcaagcttcttgggaataccagcagccttcaactcttcaagggaaaatcctttaccagcacgaagtttcatgttgtatttggcagtttgaccatgaaccaatggccttagtggtccagcagtaggcctagggaaaatcttaactgctttcttctgacgggccaatcgtcttctgg

SEQ ID NO: 4382 - DNA, 428 bp, Cicer arietinum
gtcgagaaatttggcagatattgactgaaagggcctcccaattcaacattgcattggatgatgtgtcaatcacaagcttgacgtttgggagggagttcacggctgcaattgaagccaagcaggttgctgctcaagaagcggagagagcaaaatttgttgtagaaaaagctgaacaagacaaaagaagtgctgttattagagcacagggagaagccaaaagtgctcaattgatcggtcaagctattgccaacaaccctgcatttataaccttaaggaaaattgaagctgcaagggaaatcgctcaaacaatttcaaattctgccaacaaggtttacttgaaatctgatgatctcttgttgaatcttcgggatttaaatttggagcccagtgggaagaaatagtcatgttgctgaattcactaatttatt

SEQ ID NO: 4383 - DNA, 268 bp, Cicer arietinum
gatcacattaacgccaatgttgacgatgaaaagattgtccgtgacacatgtagaaacataggttttgtttcagatgatgttggtcttgatactgacaattgcaaagtccttgtcaacattgaacaacagagtcctgatattgctcaaggtgttcatggccatctcacaaaaagacctgaggaaattggtgctggtgatcaaggtcacatgtttggctatgcaaccgatgaaacacccgagttcatgcctttaagtcatgtcctcgcga

SEQ ID NO: 4384 - DNA, 366 bp, Cicer arietinum
acttcaaaactataagaatcttcaagatatcattgccattttgggaatggatgagctcagtgaagatgataagttgaccgttgcccgtgcccgtaaaattcagcgattcttaagccagcctttccatgtggcagaagtcttcactggtgccccaggaaaatatgttgaattgaaggagaacatcactagtttccagggtgtgttggatggcaaatatgatgacctttcagagcaggcattttacatggttggtggtattgacgaggtcattgctaaggcagagaagattgcaaatgaatcacatgcctcagcttaatcacaattttattatcctttctctataattgctaaatttaataatttagg

SEQ ID NO: 4385 - DNA, 331 bp, Cicer arietinum
gcgatgacgatttccttagtgagaattcgcggcgtggaaggggatctcgtgaagagagctctcgctgcgttgattcgaccttcttcgcatcagcagagaaggagaggtgattttcgtccaagacctagtagactttccgttatgtctaaagccgaagattcttgaagaagctttaaacaggtttattgataccacgatacggtttccggccaccgcttaaggtggcgccagatcccgccgaattagattatcagatctaacggctgagcgaacaatttggaaaatcaagcaaggattgattatgtgcttcgtctctccttgttgtttgtgc

SEQ ID NO: 4386 - DNA, 296 bp, Cicer arietinum
accactattatctagcaaaactgacgcatcacaaccttgaacaaaacaatcatgaaagtgaagtctaacgagactagcaagcattcgaggatctgtcttagaaacgttccttatgacttcacgaacaatggaatggacattaggacaagtatttctataaaaggatgggtcaagttgtgcatccgaggagaagggtaaccctcctagcacaacctcaacacaccataaagctgtgaatgtgagatgaagagaagagttcattgtttctctacttttatttcaactctcaaacttgt

SEQ ID NO: 4387 - DNA, 205 bp, Cicer arietinum
acccattttggaggtggcaaatcaaccggttttggtttgatttacgatacagttgagaatgctaataagtatgagcccaaatacagacttaccaggaatggtcttgacaccaaaatagagaagtcaaggaagcaaatgaaggagagaaagaatagggccaagaagatccgtggtgtaaagaagaccaaggcctctgatgctgcca

SEQ ID NO: 4388 - DNA, 403 bp, Cicer arietinum
actgtatccccattcgttgtcataccaagaaacaacctttacaaagttatcattcaaagcaattcctgccttggcatcaaatatactagacctgctatcaccaacaaagtcagtagataccacatcatcttcagtgtaacccaaaattcccttcaacttgccctctgattcctccttgatagcagccttgatttgttcataggttgctttcttctcaagccttacagtgaggtcaacaactgaaacatcgacggtagggactcggaaagacattccggtcaatttaccattcagttctggaagaacctttcctacagccttggcagctccagtgctgctgggaataatattgaaggaagcagctcttccacctctccagtccttgcttgatgggccgtcaaca

SEQ ID NO: 4389 - DNA, 272 bp, Cicer arietinum
gcaaaagattttccccgccgctcaataggaattgcgtttcaaggtgtcccgcaaggctcatccgccttacgaggtccaccaacgacacgtgcctctggggggccaaggccccctactgctggtcggcaagcgaacgacgggcacacgcatcgcttctagcccggattctgacttagaggcgttcagtcgtaatccaacgcacggtagctccgcgcttttggcttttcaaccaagcgcgatgaccaattgtgcgaatcagcggttcctctcgt

SEQ ID NO: 4390 - DNA, 431 bp, Cicer arietinum
actacatattccaaatcaataatcctctccttcatcttcatcttctgctccctcagcaccgacttcttcataatctttctcaagagcagcaagatcttcacgtgcttctgagaactccccttcttccatgccctcatcgacataccagtgaacaaaggcccttttagcatacataagatcaaacttgtgatcaatgcgagagaagacctctgttacagcagtgttgttgctgatcatgcaaactgctctctgcacctttgcaaggtcaccaccaggcacaactgatggaggctgatagttgataccacatttaaagccggtaggacaccaatcaacaaactggactgtcctcttcgttttgatggttccaacagcagcatttacatccttgggtacaacatctccacgatacatcaagcagcaagccatgt

SEQ ID NO: 4391 - DNA, 329 bp, Cicer arietinum
aaaggaatgtgataacagcgcaacgaagaagatcgagcacctagaactttccaaaaggttttcaaaaccaactttctttaatttggtttcattttgactgcatggtatttgtattgagaaaaaaagacacgaatcattatatattctcagcataggatattttcattccatgtattgtaggaagctgttaggaaatgaattggatacatgtgctattgacgaattacaacagattgaagaacaaatcgaacgtagcctaagcaaaattagggcaagaaagaatcaattgttcagggagcaaattgaaaagctcagagaacaggaaaggt

SEQ ID NO: 4392 - DNA, 369 bp, Cicer arietinum
  misc_feature (44)..(44): n is a, c, g, or t
  misc_feature (52)..(52): n is a, c, g, or t
  misc_feature (185)..(185): n is a, c, g, or t
  misc_feature (333)..(333): n is a, c, g, or t
taccgtatgtcatttaatcatatatgtgaatgcatttttttcanttaaaacnaaatgcattcacatatatgattaaatgacatacggtatgacacaaagtgctttacaacatcttaaattcaaaattcatacaataatgagaatataatttattcctaattaaaacacacgaagagaaaaagagngacacttttttcttttttttttacaaattaataagtgtgcgataccacttcagaaactttgcttccactatttttcctttgtataattgcacaatgcatattccttatgtgcactatcttcgctttattttcgatatattcctcaaanccatggatgatatggtaaaccactctctattaatgg

SEQ ID NO: 4393 - DNA, 279 bp, Cicer arietinum
acttggatgagaagactatctttcaccttaacccttctggccgatttgtcattggaggtccccatggtgatgccggtctgaccggaagaaagattatcattgacacttatggtggatggggtgctcacggtggaggtgccttttcagggaaggacccaactaaggttgacagaattggtgcctatgttgtaaggcaggcagccaagagtattgtggctagcggtcttgctcgcagatgcattgttcaagtttcttacgctatcggtgtgcctgaacctt

SEQ ID NO: 4394 - DNA, 176 bp, Cicer arietinum
ctgcagatgtggccatctcagttaattcaatggaacccaataccatatctgcacaaccgctagttgcttctggctcagaggagattgtggagatgaagcccaaggatggtcctaaacggtgcagcaactgcaataagcgggttggtttgacaggatttaattgtcgatgtggtaac

SEQ ID NO: 4395 - DNA, 253 bp, Cicer arietinum
actaagaaaacatagactgaaactgcaaaaatgaaccctatactgcattatggaccacacatacatgacatcaaacagagatgagcaaatccaagcctacttccctcttttgtgaacttcatacaagtaaccaaggatcaccactgcagcggtaactgcagctcctacagcgctttgtgccagtatggtcccatccttaggagaagtcacctttgaacttggcacaaagccaagctctgaaagtttcttatgt

SEQ ID NO: 4396 - DNA, 121 bp, Cicer arietinum
gggtaagttccttctttctgccgtgtcgtttgctgttattttctgtcggtttcccattcagaccgaaccctaatttttcacccaaaccatgtctaccaagcaaggtggaaaagctaagcct

SEQ ID NO: 4397 - DNA, 308 bp, Cicer arietinum
actaagtaaatcttccaaaagcaaccatcactcatatatccaggacaaagctccattctaagagcagctaaacttggagcaagatgttcaacagccaaagcatgttcttgttgtgcatcagacaaatcaaaatcatcagaatcaggatcatcgggaagtggaaaatcgagccaagtttctggatgcatcgctaggtttctggcaaaggcgacaacctcctccgtaactccaaccacaccgtcgagatcgtattcctcttcggatccgatttgaaggaaactggaagcgatcttggcgaattcagatac

SEQ ID NO: 4398 - DNA, 208 bp, Cicer arietinum
acatgtgtgttctctcactattgaagtgcaaatccttctttatttataaatacatctatgattactacatgaaattggcctaatgttaagattagctcaatgcaatgcagctgaatccacaaaccaagttatgcaattggagttccttcatgcattggagggtcggttgaaggagttctttcttgcagttgccaggacagtcttgtca

SEQ ID NO: 4399 - DNA, 402 bp, Cicer arietinum
acaacactgctgttggtaacatcattatcgtcttggctggtgctgtccctggttactgggtgtctgttgccactatcgatacccttggacgaaagactattcagcttggtggtttcatcattctgactattctcttcattgtcatgggtttcgcttacaaccatatctcctccaacggtctcctcgctatttacgtccttgcccagttcttcttcaacttcggccctaacactaccactttcatcgtccctggtgaggtcttccctacccgctaccgatctacctcccatggtatctccgctgcctcaggaaagattggttccatcattggccagggtgccatctccatcctccgcacccacggtgccaccgacaagaacgaggccccctggatggaccacg

SEQ ID NO: 4400 - DNA, 412 bp, Cicer arietinum
gttaacttactttctgtgtttttatccaaatgaggatgaattaaggtgaaggagggaaatcaaagggatatggcgagcgagaagattaagattaagaagatagacaacgcatcagcgagacaagttactttttcgaaacgaagaagaggcttgttcaaaaaaggtgaagaactctccgttttgtgtgatgctgatgttgctctcatcattttctcttccaccggaaagctctttgagtattctaatttaagcatgagggaaatacttgaaaggcatcatttgcactcaaagaacctggcagagctggaagaaccatctctagagttgcagctagttgaaaacatcaactgctccacattgagcaaggaaattgctgagaagagtcatcagctaaggcagatgaggggagaag

SEQ ID NO: 4401 - DNA, 271 bp, Cicer arietinum
accttgatttcgtgcaattcgcaacaattcaagctgtgatgcgttgcgcgattctctattcctacgctaaagaacgttcgggtccactcaaacccggcgtcgacaccgtcgaagaagctgttaagaccgtcgtcggtccagtctacgaaaaattccaccaagtcccagtcgagcttctcaaatacgtcgatcgcaaagtcgacgaatccgtttctgagatagatcgccacgttcctactaacgtcaagaaggtttcaactcaagctcgcac

SEQ ID NO: 4402 - DNA, 152 bp, Cicer arietinum
accttgatttcgcgcaattcgcaacaattcaagctgtgatgcgttgcgcgattctctattcctacgctaaagaacgttcgggtccactcaaacccggcgtcgacaccgtcgaagaagctgttaagaccgtcgtcggtccagtctacgaaaaa

SEQ ID NO: 4403 - DNA, 406 bp, Cicer arietinum
  misc_feature (3)..(3): n is a, c, g, or t
  misc_feature (16)..(16): n is a, c, g, or t
cgntcgcggccgaggnaccgacgaaatggtgtatgggctgtcccttgatagagaatcttgactggtcatcattgatcatgacacccctatctgtgttgatcctaagaagatctcacatgttgctttcctcaaacttacaatgtggacattccccacactccccattgaatacaggcagagcatgatcccctggtttcagattactcacaccctccccttttttctccacaatccctccagcttcatgaccaaatatactaggaaacataggagtctgacccttagcttcccagaagtaaacatcagtgtgacaaatggaggtgaagagtatcttaagacggacttcaccggcttgtggtggcgccacctccacttcttctatcaccagcggcttccccgcctccca

SEQ ID NO: 4404 - DNA, 431 bp, Cicer arietinum
  misc_feature (231)..(231): n is a, c, g, or t
acgcccttagtcgtattcgtaacaatgctaggaaccttcttactcttgatgagaagaatccacgtaggatttttgaaggtgaagctttgcttcgtagaatgtttcgttatggattacttaatgagactcagaataagcttgattatgtcttagctcttaccgttgagaatttccttgagcgtcgtcttcagacacttgtttttatatctggtatggctaagtctattcatnatgctagggttctcatcagacagaggcatatcagggttggtaggcaggtggtgaacatcccctctttcatggttagggttgactcacagaagcacattgacttttcactcacaagtccccttggtggtggacgtcctggaagagtgaagagaaggaatctcaaggctgccgccaagaaagcatctggtggtgacggagat

SEQ ID NO: 4405 - DNA, 216 bp, Cicer arietinum
atcaaaacttgccaatatttgattggtcattgaccaaagatgattacaagaaaataagtgaaattcaccaggagagactcatcaaaggaccaaccaagcctcttcttgatgatctatgggatgaagaatgaacaatcacttaaatttgaaatattggatgttagttgttgcttactctcaataaagcaagtgtcatcgtaatagtcatatattagt

SEQ ID NO: 4406 - DNA, 342 bp, Cicer arietinum
accttgcttcgcttgaggcttcatatctaaaccttcctgattctactttcaaggatcttcggaggaagcttccagtcacccgcaccttatttccatggcataacactttgcaatttagcttgtcaagagatatctcaaaagaacttggcattggaaagtaaatacatacacatacacaacaaattaaagttgtgtttagtcgaacctggaggcgacaagtttcctatatataaagttattcaacacatgtaactgatcaaatcaacgatcaatcattcttagggttgactttatcttcacacatttgcttcctgtagtgcacttctttgtgtgagtctcttt

SEQ ID NO: 4407 - DNA, 187 bp, Cicer arietinum
acacagctcacaaaagagacttggtggagcttatgagaaacctcccgggacctttgttcctcttctctatacacaggtcctttatttctctcctcccgtctcccgcggcattaacttcaatacttaaaccccttactgaccctcaagctcagcaagaatcttctcacccttggccttggcggaggcg

SEQ ID NO: 4408 - DNA, 362 bp, Cicer arietinum; identical to SEQ ID NO: 575

SEQ ID NO: 4409 - DNA, 437 bp, Cicer arietinum
gataaaatcaactcacttttacattatggtgatgaaagaacagagaaaattagtgttaatgttacttatggtaatggtaataattatgggttgtatgttgaaaggttcaaatgggtttagtttgtgtaacatgaatgaagatggattggatgcttgtaagccagcagtgactcagccaccagaagatccaaagcctgaatgctgcaaggcacttaatggagctgacttgagatgtctttgttcttataagaactcatcagagttacctttatttggaattgacccaattcttgcttcttcacttcctgctaaatgtaatctcactcctccagataactgctaagcttgtttcattgatctattttgtgtgtgtgtgttttgttttgttttaaaccctccatttctcatggcaatagggccttaataatctagatgta

SEQ ID NO: 4410 - DNA, 182 bp, Cicer arietinum
ctggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtgga

SEQ ID NO: 4411 - DNA, 203 bp, Cicer arietinum
acgcggtttgagcgacatgcgaaatgttgaggatgatagggttccttaccagaggccatcagttaaaaagccagcaaataaatctgcagggatgcaatctagagatggtgaccttgatttggatctttcacagcctaggtctggacagtcctcttccaggcaactcacatcaaggccagaagcaacacctttggattttgtga

SEQ ID NO: 4412 - DNA, 428 bp, Cicer arietinum
aaaatcttgaagcttccactgaagttatatgttcacgaactccgtcccggctgcaatatttaagacagatataccatactaaatttggcatttctcttgaccatgatattgaaagaaatacctctggagatcataaaaagattttacttgcttatgtaagcacaccacgccatgaaggcccagaggttaatagagaaatggctgagaatgatgcgaaggttttgtatacagctggtgaaaagaaactgggaactgatgagaaaacgtttgtgcaaatattcagtgaacggagtgcagcacagttggctgccataaataatttttaccatggcaagtatggacactcattgaaaaaggcaataaagaatgaaacgtcggggaattttgctcatgcacttttgacaatagtccaatgcgctgagaatcca

SEQ ID NO: 4413 - DNA, 407 bp, Cicer arietinum
acaaaaattggcatgcagatatagagacaaacaaattaagcaacatttaagtttcaataattcaaataactggtctacaaccggaagctagaaagcaatcctagcctaagctttgattgcatactttcttaatggaaagtatatctccttcttcttctctcgttctgtcttcaatgatgcctggtgtttggtaaggcgtcttcgaatggcacgggtcttcttaggacgtaggtcaagtggcaaatacttcttattcttataaacctctctgagtgcagctttctgcttctgtgaaatcactgtcaacacttgtgctattgaaagcctcacaacttttattttggagagcttgttaggcgcaccgccggtgactttcgccactcgtagcaaagcgagttccgccttca

SEQ ID NO: 4414 - DNA, 422 bp, Cicer arietinum
acagagcttacctggagaccgtggaagggggcaattgcctcgtctacagagcagcgttctggccaccttgggtttttcccctgcgaggggtttccctaaggatgcatagttctagggttgcagctactggcgatcttaagggttatggttctcctgcctttgggcatggaaagctacttgatctatctgtgcaagagaattctaggctggagaggaatagttcccgctgacgggatgacctcttgaaagtaatgcgccttcgtgccgatgatatgctggatgaactagacggaatcgcagttgcatggggatatctcctgaatcacctgctttgacatccaagatgatgtgcttgaacctaccgtagggctggctacgagtaggaaggtgccctcgggggaaggagctcgagaggctctccg

SEQ ID NO: 4415 - DNA, 428 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccactttgtgcaacacaaacttggtttc

SEQ ID NO: 4416 - DNA, 370 bp, Cicer arietinum
acaaacaaatatactgtagcctctagatctaagaaataaaataaaaaatacaactaaacaaaaccacaaaacgaaatttaatattatcacgaatctgttggaggtgtgggagatgaagaagaattatgttcaatttttctcaattgaattctatttgtatgctcctcatcttcataagcataagcaaaaccaccatgtcgggtcatatccatacccgcaagttcatcttcgggtgaaatccttagcaatttcattttattcaaaataaagaaaagaggacccattgtagcactaacccacccaataattaccaatatttgaatcacgtgtgcccctaacaactttcctccaccacccataaataaaccgt

SEQ ID NO: 4417 - DNA, 293 bp, Cicer arietinum
cagatcagcatacttgaaggcaatggaagttgccaaagacgccggctgccttctctcttatgatccaaacctccgcttacccttgtggtcctcagccgatgaagctcgcaagcaaattctcagtatatgggaaaaggctgatttgatcaaggttagtgatgtggagctagagttcctgactggaagtgacaaaattgacgacgcttctgctttgtcattgtggcaccccaatttgaagttgctccttgtcactctcggtgaaaatggctcaagatactacaccaagaatttcc

SEQ ID NO: 4418 - DNA, 431 bp, Cicer arietinum
ctccatcacatctccccagaagactgttgacggtccatcaagcaaggactggagaggtggaagagctgcttccttcaatattattcccagcagcactggagctgccaaggctgtaggaaaggttcttccagaactgaatggtaaattgaccggaatgtctttccgagtccctaccgtcgatgtttcagttgttgacctcactgtaaggcttgagaagaaagcaacctatgaacaaatcaaggctgctatcaaggaggaatcagagggcaagttgaagggaattttgggttacactgaagatgatgtggtatctactgactttgttggtgatagcaggtctagtatatttgatgccaaggcaggaattgctttgaatgataactttgtaaaggttgtttcttggtatgacaacgaatggggatacagtacct

SEQ ID NO: 4419 - DNA, 458 bp, Cicer arietinum
aggtagaaaagtctaataagtaataactcttagaatatagtcacggggtcaagctgaaacttgttggtttttcaacaatctgaaactttcattcaagacatgcaagctttcttcaacatggagccacactttgcaatcaagaaggatgtcactgaattaattgggaacaccccattggtatatctaaacaacattacagaagggtgtgtagctcatattgctgctaagcttgaatacttgcaatcatgctgcagtgtcaaagataggatagcgttgagcatgattcgagatgctgagagtaaaggcctcattacacctggaaagactgttcttgttgagccaacaagtggtaacaccggcataggattggcgtccatagcagcgccgagaggctataaacttttagtgattatgccatcgtatgtgagtcttgagagaaaaattatactgagagcttt

SEQ ID NO: 4420 - DNA, 304 bp, Cicer arietinum
acgacaagaacgtagatgatcacatccactcggagccagttcctgatgatgtgatccaggcaactcaatcagacaaatactgggccccacacccacaaactggagtatttgggccccccggcgagcacgccacagcctccaccacgaatgcaactgctggctcggtgctggaggaaaaggcctggtttcgcccttccagccttgaggacttagagaagccccaccctcatcatccttagtttttagaacctcatatataccttatgtgtgcgtatatatactactaccaataaataaggacagt

SEQ ID NO: 4421 - DNA, 216 bp, Cicer arietinum; identical to SEQ ID NO: 2490

SEQ ID NO: 4422 - DNA, 237 bp, Cicer arietinum
tttgccttcgagcggccgaacgggcaggtaccacataagagtattaaacacatatcactagatccgaatcctaccaccattttggatgcaagcaatagtaaacagaaaagctaagagtgacgatttaggccacaaacaacatcacaatgtaagaaaaccgtgggaaatgtatgtaatgtaaatgaaaaacaaaatcatggttattagtgagtgtttgaggacacatgacaatctact

SEQ ID NO: 4423 - DNA, 416 bp, Cicer arietinum
acaaggtggttaccccactgggacaggaagaggtggagagtcaatttatggtgcgaaatttgaagatgagattaaacaagagttgaagcacactggagctggtattttatctatggctaatgctggtcctaatacgaatggtagtcagttctttattactctcgcaccgtgcccttctctagatggaaaacacacaatatttggaagagtgagttttttaatggaaattatcaaaagacttggcagtgtccaaacagataacaatgacaggcccatccatgacgtgaagatacttcggacatcagtcaaggattgaaatgagttgatctgatgtgaaacaattgaagtttagttatgactgaaaaaatgattaagcataagagttgtatttttttgggcactagtttgcggacctg

SEQ ID NO: 4424 - DNA, 396 bp, Cicer arietinum
acaagacatatgatcttcacgaaacaatataatatggtccgataacacattaatatatatatataagcataaactgactgttgagttaacactccatcaagattcaattaaatagacacaaggaaacccaaatccaaattaaataaactacgaattaattctcatcatctaagtcctggtattgcttgaggacctcagcacagccagaagcaacttcttgtgccatgaagcccatagcattggcatatctgtcattagaggcaatgccattgaagcgggtgagaataacgcgagcttggtcacgccctggtgtggcttctctacagaaatgctgatgactgcttactagcttgacatcgcagacctggtcggcgtgatcctcatccacatacattg

SEQ ID NO: 4425 - DNA, 318 bp, Cicer arietinum
gctccttaagagccctagctttaataggagctggtgtttcaggtcttttgggttttgcaacaacagcatcagctgacgaagttgagcatggcctggcatctccaaactatccatggcctcacgagggtatcctcagttcatatgaccatgcttcgattcgccgtggtcatcaagtttatacacaagtctgtgcttcctgccattccatgtctttgatatcataccgtgatttggttggtgttgcttacacagaagaagaggtaaaggctatggctgctgagattgaggtggaagatggccctaatgatgagggtgaga

SEQ ID NO: 4426 - DNA, 135 bp, Cicer arietinum
acagtataccggtgaaagagactcacacaaagaagtgcactacaggaagcaaatgtgtgaagataaagtcaaccctaagaatgattgatcgttgatttgatcagttacatgtgttgaataactttatatatagga

SEQ ID NO: 4427 - DNA, 115 bp, Cicer arietinum
gctagctacttgttaataatatcttatttctcacactagcaatattcttaattcatcatcatgggtgttttcagttttgaggatgaggccacctcaattgtatctcctgctactc

SEQ ID NO: 4428 - DNA, 470 bp, Cicer arietinum
ttctgccatggcgaaagcgggaattcgattagcgtggtcgcggccgaggtactttggctatcacttgtcaggatttgcctttactgctaatgggtgggtgcaatcctatggatctcgttgcgtcaagcccccaatcatctacggtgatgtgagccgcccaaagccaatgactgtcttctggtcatctcttgctcagagctttaccaagcgtccaatgaagggaatgcttactggccctgtcaccattctcaactggtccttcgttagagttgaccagcctagatccgaaacctgctatcaaattgctttggctatcaaggatgaagtagaagaccttgagaagggtggtattggtgttatccaaattgatgaggctgccttgagagaggggctaccactaaggaagtcagagcatgctcactacttggactgggctgttcactccttcagaatcaccaatgttggtgttc

SEQ ID NO: 4429 - DNA, 324 bp, Cicer arietinum
actttggcttgccgttgtcaggatttgactttactgctaatgggtgggtgcaatcctatggatctcgttgcgtcaagcccccaatcatctacggtgatgtgagccgcccaaagccaatgactgtcttctggtcatctcttgctcagagctttaccaagcgtccaatgaagggaatgcttactggccctgtcaccattctcaactggtccttcgttttagttgaccagcctagatccgaaacctgctatcaaattgctttggctatcaaggatgaagtagaagaccttgagaagggtggtattggggttatccaaattgatgagg

SEQ ID NO: 4430 - DNA, 304 bp, Cicer arietinum
actgtccttatttattggtagtagtatatatacgcacacataaggtatatatgaggttctaaaaactaaggatgatgagggtggggcttctctaagtcctcaaggctggaagggcgaaaccaggccttttcctccagcaccgagccagcagttgcattcgtggtggaggctgtggcgtgctcgccggggggcccaaatactccagtttgtgggtgtggggcccagtatttgtctgattgagttgcctggatcacatcatcaggaactggctccgagtggatgtgatcatctacgttcttgtcgt

SEQ ID NO: 4431 - DNA, 377 bp, Cicer arietinum
acaacaataaacaatcaatctaactacgaaatacattcgaaaatagattataatttgatcaatataattctatatttagagacgaaaatgtagaattggtttaatatgaagtggttttttccttgacacaacaagtccgaaaacctcactcatatctaaatcttgcgtgcctaaatcagtttcaggtaacttccaatcaaaccaataaagaagattagctaacacatattcaacaagagctattccaaaattcattccaggacatccccttctcccaaaaccaaatggtaaaaattgaaaattttggcctttaaaatcaattggactatgttcaaatctctctggaatgagctcttcggggttttcccaatttttag

SEQ ID NO: 4432 - DNA, 266 bp, Cicer arietinum
acggacaatgggcctccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattctcactgtccctgtctactatccagcgaaaccacagccaagggaacgggct

SEQ ID NO: 4433 - DNA, 269 bp, Cicer arietinum
acctagtctgagaacaagttggatgggaagtattttgttcggttacaagaccgcgattggtattggagagcttttcttcccgaaggcgaagatagagaccatccagcttgtaatccattcggccctaaaggtaaaagcctcgcaggactcaaattcgccaaaagccttgtttgtgtggctggtttggatcttctccaagattggcaattggaatatgtggaaagtctaaaaaattcaggacaagatgttaaacttctttacctaaagga

SEQ ID NO: 4434 - DNA, 256 bp, Cicer arietinum
acttcaaaatgaaccgcttttgagtgaggtatactatgagtgcaagaaagatatgttggaaaaggcggctatagagtcacctctgtctgagattctggaaatcaagattcctgctctgaacatagaagaaaatccgattcaagaaaacaaaccgcttcctgatttactattaccaaagagtgtcagttcaggaagtttgagttcaatggattggatgcatggagctgcgatgaaacctgctttccttgatttccct

SEQ ID NO: 4435 - DNA, 303 bp, Cicer arietinum
tgcggattttgttcctggctacccatttagccttcgaactggggttgattgtgctctgtcgtgtggactatggctcaatctggcagaccttgatgcaccaactcaggctctcaagccagcacagaggaattcacgatatgtggatgcagttctgacagttcctgttagagcaatgttgccggtgagtggaatcaacattgcctttaaccgagaattaattggcccggcattggtcccagctttggtgttggcaggagaaggaaaaatcaggtgggaaactgtggaagatatatggtgtggatt

SEQ ID NO: 4436 - DNA, 204 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacgcctttgtcggatctaatgggggcacctcataaccataacgccttagatatc

SEQ ID NO: 4437 - DNA, 403 bp, Cicer arietinum; identical to SEQ ID NO: 2508

SEQ ID NO: 4438 - DNA, 472 bp, Cicer arietinum
gatttcgagcgggccgcccgggcaggtgcttgtcactcagctattcgtctcttgcaccaacgccggtggcggcgttaccagtgatggaaatagtatctgcgctagcaacgcgtaccgcgaggcctgtgtatccttgggaacaaacggaaagcccagttgggctagtttcgagcaggacggtgtcagtggaaacgggacttatgtgttggatatcaaggaattcggcgccgacgatgatgagtctacgtctacgacaagtgcaaagacaactgccaagacgaccgctactgattccactggcactgagactacggccgtggcggctgctgctactactggtgccaccgaggcatcgtcaggcagcgctacttcggatgcgacttcgggaactgagactcctgttgcatcggctacaacaacgccgaactcgggcatgagacttgctggtcacggagctgttggcatgggtctg

SEQ ID NO: 4439 - DNA, 304 bp, Cicer arietinum
actttcacacaaaaaattaagcaaaataacaaattaaatttccctttttttacaatatttctctgcatatagtctatctatcattgaatcactagtaatctaacaatgcaaactttacctgtaatccaattttaccaccttctgtgacaagcttagcagcaataaccaaccaatgcccaggagcatcatgtggtcccctcacaacctcgtttgtctccacatatttaagcattttagctgaacgaacaggcactggtggcccatttggataaacaccagagttaagcgctgttggagcctgctg

SEQ ID NO: 4440 - DNA, 359 bp, Cicer arietinum
acaaatcctgctagtgctgctatgtgtggaatgaaaattgtcaccataggaactgatgctaagggaaacattaacattgaagagttgaagaaggctgctgaaaaacataaggacaacttatctgcatttatggtaacatatccttcaactcatggtgtttatgaagaaggtattgatgatatttgcaagatcatccatgataatggaggtcaagtatacatggatggtgcaaacatgaatgcacaggtaggacttacaagcccaggttggattggagcagatgtttgccatctcaatctccataagacattttgcattcctcatggaggaggaggccctggcatgggtcctattggtgt

SEQ ID NO: 4441 - DNA, 376 bp, Cicer arietinum
aggtagaaaagtctaataagtaataactcttagaatatagtcacggggtcaagctgaaacttgttggtttttcaacaatctgaaactttcattcaagacatgcaagctttcttcaacatggagccacactttgcaatcaagaaggatgtcactgaattaattgggaacaccccattggtatatctaaacaacattacagaagggtgtgtagctcatattgctgctaagcttgaatacttgcaatcatgctgcagtgtcaaagataggatagcgttgagcatgattcgagatgctgagagtaaaggcctcattacacctggaaagactgttcttgttgagccaacaagtggtaacaccggcataggattggcgtcca

SEQ ID NO: 4442 - DNA, 294 bp, Cicer arietinum
actatgatgtctactacagatcaggcttttcgtctgaattgggcttcattcagcgctggtggcggtgagagacgttcttctgatgctacttctgatctctctatatttgtgggggacttggccatagatgttactgatgctatgctgcaagaggtgtttgctagcagatactcatctattaagggagcaaaagttgtcattgattctaattctggttgttcaaaaggctatggttttgttaggtttggtgatgaaaatgagaggacaagggcaatgactgaaatgaatggtgtt

SEQ ID NO: 4443 - DNA, 137 bp, Cicer arietinum
actgctggaatctcaggtggtcacataaatccagcggtgacatttgggttatttttggcgaggaagttgtcattgaccagggcactgttctacatggtgatgcaagtgtcgggtgctatttgtggtgctggtgttgt

SEQ ID NO: 4444 - DNA, 293 bp, Cicer arietinum
actgggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacgggtcgtattcgt

SEQ ID NO: 4445 - DNA, 278 bp, Cicer arietinum
gcaaaagattctacccgccgctcaataggaattgcgtttcaaggtgtcccgcaaggctcatccgccttacgaggtccaccaacgacacgtgcctctggggggccaaggccccctactgctggtcggcaagcgaacgacgggcacacgcatcgcttctagcccggattctgacttagaggcgttcagtcataatccaacgcacggtagcttcgcgccactggcttttcaaccaagcgcgatgaccaattgtgcgaatcaacggttcctctcgtacctgc

SEQ ID NO: 4446 - DNA, 391 bp, Cicer arietinum; identical to SEQ ID NO: 3719

SEQ ID NO: 4447 - DNA, 463 bp, Cicer arietinum
gtggttgatcacgatatcgtggaagttgagattgacggaactgaatctccagaagaacagaaagaagctgtaattgagattaggaaaggtaggaaaagagatagatcagtcgaaggaagagatgataatgacagatcaaacaagaagaagccgcggttgttgagtagatcatcacagtctatttccaggtgggtccgcccattacatgaagttgttccgggtgaaggtttaagagattctgctcaaaagattaaggcaatcaagcttgcaaggaaatcttgtaagaagagaaacaaggaagcacgtcgcggagaagctgatagagttatacctaatctcaaacctaagcacatttattctggaaagcgatccaatggaaagactcaacgacgctaaaattttattattattttaggtattgttatgttcaaaatactcaacacgttttcattatctcaactat

SEQ ID NO: 4448 - DNA, 385 bp, Cicer arietinum
ggtctttctttctgccgtgtcgtttgctgttattttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttcatacttccagtattgagctctgtaattacgattatgactatgacaatatctcttattgtgtgacgtgttttattactgatgttagt

SEQ ID NO: 4449 - DNA, 428 bp, Cicer arietinum
gtgttggtctttgggtgtctcttctctctatttgttaaccggcgaaaagaaaaagagaagagtcactcactcaacaaagcggtgaagttggtagcaacaaacagaacagaagaaagaagcttagcaatgggttttatcggtgacactatggattctatcaaatctcttcagatccgtcaggtcctcactcaggctgttagtctcggcatgattgttacgtctgcactgataatatggaaggcattgatgtgcatcactggcagtgaatctcctgtcgtcgttgttctttctggaagtatggaaccaggattcaagcggggagacatcttattcttacacatgaataaggatccaattcgtgctggtgagattgttgtatttaatgtagatgggcgggagattccgattgttcatcgtgtaattaaggt

SEQ ID NO: 4450 - DNA, 358 bp, Cicer arietinum; identical to SEQ ID NO: 690

SEQ ID NO: 4451 - DNA, 482 bp, Cicer arietinum
gtcgcatgctcttcgccgccatggaaaccgcgggaattcgatttcaagcggccgcccgggcaggtaccactcttaccaatttggacctaaccactcctgatacatttgactctgcctactattccaatcttaaaattcaaaagggattgtttcagagtgaccaagagttgttttcaaccagtggtgcagacactattgacattgtcaatagtttcaatgacaaccaaactcttttctttgcaaactttaaggcctctatgattaaaatgtttaatattaatgtgttaactggatctcaaggagaaattagacaacaatgtaactttattaatggaaactctgttgaccttgctactactgtgactagagagtcgtcagaagatggcatcgttagttcatactaagtaatttaattagcaaaagtaaggaacctaataaagattaaagagtgtggtctatcttctagaggcatatacatgccc

SEQ ID NO: 4452 - DNA, 273 bp, Cicer arietinum; identical to SEQ ID NO: 3441

SEQ ID NO: 4453 - DNA, 433 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaa

SEQ ID NO: 4454 - DNA, 326 bp, Cicer arietinum
gttaaccctaaagcataccctttggctgatgctcagttgacaataaccataatggaccttgttcaacaagctgctaactacaagcagctcaaaaagggtgctaatgaagccactaagacactgaacaggggtatttctgagtttgttgttatggctgctgatgctgaacctcttgagattcttctccatcttcctctacttgctgaggataagaatgttccctacgtgtttgtcacatcaaaacaagcacttggtcgtgcttgtggtgtcacccggccagtcattgcttgttctgtgacaactaatgaaggaagtcaattgaaatc

SEQ ID NO: 4455 - DNA, 441 bp, Cicer arietinum
actatgatgccaaatacagatcaggcttttcgtctgaattgggcttcattcagcgctggtggcggtgagagacgttcttctgatgctacttctgatctctctatatttgtgggggacttggccatagatgttactgatgctatgctgcaagaggtgtttgctagcagatactcatctattaagggagcaaaagttgtcattgattctaattctggccgttcaaaaggctatggttttgttaggtttggtgatgaaaatgagaggacaagggcaatgactgaaatgaatggtgtttattgttctagcagggcgatgcgaataggtgttgcaacacccaaaaaaacttatggaaatccccaacaatatgcctcacaagctgtggtgttggctggtggacactcatctaatggtgctgtggcccaaggttcccaatctgaaggg

SEQ ID NO: 4456 - DNA, 272 bp, Cicer arietinum
acattaataaattattgatcacaaagagtgattgatttattgatagtaagtaggttgtaatatagaaattaatcaccgcaattaacaaaggtatagttaacagtaaggtgaccctgttggttgccctgtccattagtatcaagttgattgaagacattaacatccaagtccaaaccaccattggagcactgatcaactattctcactgctacctgacttccagttgcggtattcgtcaccctcaagcacttgccacaagaatctctgccttg

SEQ ID NO: 4457 - DNA, 456 bp, Cicer arietinum
actatgaaatttcagccaagagcaactataactttgagaagcctttcctgtatcttgcccggaaacttgcaggtgatcctaacttgcactttgttgaatctcctgccttggctcctccagaggttcagatcgatttagttgcacaacaacagcatgaggctgagattgcccaagctgctaatcagccccttcccgatgatgatgatgatgcatttgaatgatgcatttgagtagaacctgtgcgtgtggtgacaatcttcttgagtgtatgcttactgtttgtttcggaggttgtaatattcacggatgtggatttgaggatctgaattcaaccagtatgaaatattttacttgaatttaaaatcttgtttattgttatgttattgcctcgggcattaagctttagtatcacaataccattattttttactcattttgcattttaaaagataccat

SEQ ID NO: 4458 - DNA, 458 bp, Cicer arietinum
actatgatatttctggttgctatatcctcagaccttggtcaatgtcaatttgggagattttgcaagcgttttttgacccagaaacaaagaaaatgaagatcaagaactgctacttccctgtgtttgtttcacctggtgttctggaaaaggagaaggaccatgttgagggttttgctccagaggttgcttgggtgacaaaatctgggaactctgatttagagattcctatcgctattcgtccaactagtgaaactgtcatgtatccctactactctaagtggattaggggacaccgtgacttgcccttgaaacttaatcagtggtgcaatgttgttagatgggagttcagcaatcccacaccgttcatcaggagtcgtgagtttctttggcaagaaggacacactgcttttgcaacaaaggaggaagcagatacagaggttcttgaaatattggaatta

SEQ ID NO: 4459 - DNA, 457 bp, Cicer arietinum
actatgatatttctggttgctatatcctcagaccttggtcaatgtcaatttgggagattttgcaagcgttttttgacccagaaacaaagaaaatgaagatcaagaactgctacttccctgtgtttgtttcacctggtgttctggaaaaggagaaggaccatgttgagggttttgctccagaggttgcttgggtgacaaaatctgggaactctgatttagagattcctatcgctattcgtccaactagtgaaactgtcatgtatccctactactctaagtggattaggggacaccgtgacttgcccttgaaacttaatcagtggtgcaatgttgttagatgggagttcagcaatcccacaccgttcatcaggagtcgtgagtttctttggcaagaaggacacactgcttttgcaacaaaggaggaagcagatacagaggttcttgaaatattggaatt

SEQ ID NO: 4460 - DNA, 372 bp, Cicer arietinum
aggaaaagccttactggatcataaagaattcatggggacagaattggggtgaggaaggatattacaagatctgcagaggtcgaaatatatgtggagtggattcaatggtctcaactgtagctgcagttcatgcatccaacaattaataatacggagatgctggttctggtggtctcatcctatgtgacacgactctagttcaatttgtgtaaatatataatcatgaagttgtgaatttagcttctggttctggcaaaactatctccatataggatcagaaaactaccacaatcatgttatttatgtagttggtaattatgtatgcttgttactcaagtgttgtttatccatagccatggcaacatggtaggt

SEQ ID NO: 4461 - DNA, 462 bp, Cicer arietinum
acattataataaagaagaaaggccgaataatctgagtaaagcaactacaacattaattaacgaaaactgagaaatcacaaaagatgtgagtgattacaagatcggtaacttatttctcagaatgagccagcttgcctgtaaattatcaaacttctatggaatcctcccataagctgcagctattgtcatcatttgaaactctcaaactgcaccatctacttcattcattcattcttttcatgcaagggctaacttgccagtaatgcagtaaagttggtgatcaataccgtcccttatatggcgcctcaggtaggtaattgggcatgtataaaacttgtctaggatgaccatgaagttgtccatactgtggtccattctgatgaaaatattgttgagatggcatttgagctacctgtggattatacatgataggttgtggcccggcaaaagaagttccaactc

SEQ ID NO: 4462 - DNA, 439 bp, Cicer arietinum
actgcttcgcctgtagccggacccttctcttatactctgttgtatcctggataaatagatgatagccttctgtctgggcaggatcagcaggatttggctggtcaagcaaatcttgaatgcccacaagaatttgcttcactgttatggctggtctccacccactgtcttcattaagtatagacaagcaaactgttcctgatgggtaaacattagggtggaagaacccttgtgggaatttacacttcggaggcttgctaggatagtcttcactaaagtgtagtgtaagtgggaagtagccaccctcccaatcagtcccagattttccaggaatagtgcaatgccaaatcatcaaattcacagaaccatcaggcagtgtctctggcttcgcaacaaaaccatgaggatgattcttccgccatgacttgcgctcctcagtaag

SEQ ID NO: 4463 - DNA, 437 bp, Cicer arietinum
acaaattactttaattccaaaggggaaagagcagtcctctgtcaaggaggcagattcgtcccaaaaaggggtgactgataaactacaagaagtcctaaaaaagatcaaaacccccgtgaaaactgggatttatgacgacctttatggagaatccttatctgtcaaagttggatcagcctgggcatactcacctgtaagtagtagtgaacgacctccagctgctaaggaaaatggaaaagagaatacactaagcggaagatcagacagtaatccaagcaatgctgatgaggatgacgacgacgatttgttcgggtgactattgaacctatgcagactgtattttggaatagttttgtggcattttttgagtttgacatcatagggagtagaaaacatgcaaatattatgttgcacgctttttatcatctggaattact

SEQ ID NO: 4464 - DNA, 378 bp, Cicer arietinum
ctaatggcggctcctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgtacctg

SEQ ID NO: 4465 - DNA, 332 bp, Cicer arietinum
cgtgaatggtgaactacatccatccagattttgtgagaaagatttgctcaaagttgttgatagggagtatgtttttgcatatgttgatgatccttgtctctctacataccctttgatgcaaaagttgagacaagtgcttgtagatcatgcattggtgaatgttgatggtgagaagaatttgaacacatcaatatttcaaaagattgcaacttttgaggatgagttgaagacccttttgcctaaagaagttgaaagtgcaagaattgcttatgagaatggacaatgtggaattccaaacaagattaaggagtgtaggtcttatccattgtaca

SEQ ID NO: 4466 - DNA, 172 bp, Cicer arietinum
tggcggtggatatggtggaggcggtggatatggtggtggacgtcgtgaaggtggatataacagaggtggtggtggaggatatggtggtggaggtggatatggcggaggaggtggtggtggttatggtggtagcagagatcgtggatatggtggtggtgatggtggttctcgc

SEQ ID NO: 4467 - DNA, 462 bp, Cicer arietinum
caaaaaaacaaaattaaaaggcaaaggcttaattttggacggtgttgtgcagaaggggagaatggcagcagaagagggacaagtaatcggtgttcatactgtggatgcttggaaagatcagatccagaagggaaatgagtccgggaaattgattgttgttgattttactgcttcttggtgcggcccatgccgtttcattgctccaattctagcagagattgctaaaaagctgccgaatgtcaccttccttaaggttgacgtggatgaattgaagactgttgctgaggagtggggtgttgaagctatgccaacattcttgttcttgaaagaaggaaaactagtggacaaggttgtgggtgctcagaaggagaagctgcaatcgacaatagccaagcatgcttgaagggtcatataaataaaatattgtcatctatttcgagtcagtttgcatttttttctatt

SEQ ID NO: 4468 - DNA, 200 bp, Cicer arietinum
acctgaagcagtttgcgctacctatctaaattaaattagctatgtgctcgctctgctttttcaggggttgctttttttttctctacggtttggacctgttctggcgtttccgccctatatcagattggacttttgcacctggtgacgaaccgaggtaatgaatgatttatgagtgtttggatttagttgatggtacctgc

SEQ ID NO: 4469 - DNA, 461 bp, Cicer arietinum
accacctgcttatccatatccagatccctactacagaagcatctttgctccctatgatgcacaaccttatccgccacaaccctacggtggacatccaatggccaatcttcagttaatgggaattcagcatgcaggtgttcctttgccgacggatgcagttgaggagcctgtttttgtcaatgctaaacagtatcatggtattttaaggcgcaggcagtctcgtgctaaagctgaatcagaaaagaaagttgcaaggaatcgaaagccatacttgcacgagtctcgacatttgcatgcactgaaaagagcaagaggatgcggaggaaggtttctgaattcaaagaaaaatgagaatcaacaagacgaggttgcatcagctgacaattcgcagtccaatatcaatctcaattcagatagaaatgaccttgcaccatcagacaaaacatcttgaaaaaaaattc

SEQ ID NO: 4470 - DNA, 200 bp, Cicer arietinum
acaccgtgtttgccactgccgttgacccaaagaagggtaatattggaattattgcaccaattgcaattggtttcattgttggtgctaacattttggttggaggagccttcaccggagcatccatgaagccagccgtgtcattcggcccagctgttgtaagctggagctggtccaaccactggatctactgggctgggcca

SEQ ID NO: 4471 - DNA, 159 bp, Cicer arietinum
acaagaaattgattattacaagagacatatggaaaatccatatggaagattaaacatgaacaaagttcaaagtaaaacgacaacaaccaccaaaaccaatatgctagtctaaatccaccttattattgttgcaaaggaagatgaatcagccagaagctg

SEQ ID NO: 4472 - DNA, 309 bp, Cicer arietinum
aaattaattattttagatggagtcatacagaaaggttatgattgtggggataatgttgttggccgttgccaatgcaatgttgttggttaatggtcagtcctattgtcacatgacaaaatcagggcttaattcatgcaagccttatgtgagtggtgacaattctgttgatgatcaaattccatccaatgcttgttgctctgctatttccaaagctgatcttcaatgtttgtgtcgttacatggattcagggttgctttctttctatggtgttgatccaaaacaagccatggaactacctgttaagtgtaa

SEQ ID NO: 4473 - DNA, 456 bp, Cicer arietinum
acatatgctggacaattcatcatgggtggttttctgaatttgaagttgaagaaatggataagggcgttgattacgcggagttttgcaatcatcccaaccacgattgttgctcttatattcgatacctcagaggattcattggatcttctgaatgaatggctcaatgttcttcagtcagtgcaaatcccctttgcattgattcccttgctttgtttggtgtcgaaggaacagataatgggcaccttcaagattgggtctggcctcaagattatatcctggcttgtggctgctctggtgatagtgataaatggctatcttttgctggaattcttttcctctgaagtgaatggagcagtgctcaccactattgtgtccacaataacagctgcatatgttgcattcataatttaccttatttcaagtgcctttaccttttcaccttggcaaagtttaact

SEQ ID NO: 4474 - DNA, 188 bp, Cicer arietinum
acgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtgga

SEQ ID NO: 4475 - DNA, 408 bp, Cicer arietinum
acaagagagtaactgtcagatcatccataaaccacgtcgcagccttcatgatgccatgtaaaaccagttcaagagcccaaaaagaatctgatccacaacagcaaagttgaactatttgtcatcgtcaggttaagcttaatatacccaaaaatttctgatttacaggatcagaatcctcgtatatcgaaccaataatgctgtcttgacctgtctaagaaactgtgctctcaaaagaaacctggaattgcgcaagatgtctgggctttggatttgatgaggcggcaaggccttgaagcaactttacaacatcagtagtatcatcaagaaaatacttggccttgctaggcttcctacctacagtgcaggcgaaaatctctggagctgatggtaacgatgggcatgagactg

SEQ ID NO: 4476 - DNA, 437 bp, Cicer arietinum
acctttgatacagcagaagaagctgctttggcttatgataaagcagcttttaagctccgtggtgactttgctaggcttaactttcctaacctgaaacacacaggttcatgtgttgttggtggtgaatttggtgagtataagcctcttccttcttctgttgatgctaaacttcaagctatttgtgaagatttagctcagatccagaaacaagggaagtcagagaagccaaccaagaagaaaacaccctccaaacttgcttccaagcctgtttccacggtcactattccgttggaggattctgttgatttgaagaatgtttcggataactgttgtaaagttgaagtttcgttttcgagtgaaggttcttcaccactttcggatcttacttttggtgatgttggtgagccacagtgggaaggtgattctgataatttcaa

SEQ ID NO: 4477 - DNA, 410 bp, Cicer arietinum
  misc_feature (87)..(87): n is a, c, g, or t
tggaaagccaaagttctatctacaaattctaaatacaatgccaagagccacacatgttattacatgtaaagctgcaatatgctgggnggaaaggaaagacagtgacggttgaagagatagaagtagatccaccaaaggcaacagaagttagagttaagatgttgtgtgcaagtctctgccacacagacatctcaagcattcaaggatttcctcataatcaatttcctctagcacttggacatgaaggaattggtgttgtagagagtattggcgatgaagtaagaaatctaaaggaaggggattttataattccaacatacataggagaatgtgaagaatgtgagaattgtgtttcaggaaaaaccaatgtgtgtttgacacatcctgtgaggttgactggtctaatgcca

SEQ ID NO: 4478 - DNA, 417 bp, Cicer arietinum; identical to SEQ ID NO: 1860

SEQ ID NO: 4479 - DNA, 462 bp, Cicer arietinum
tcttaattcatcatcatgggcgttttcagttttgaggatgaggccacctcaattgtagctcctgctactctctacaaagctctagttacagatgccgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggt

SEQ ID NO: 4480 - DNA, 317 bp, Cicer arietinum
gcgagttctctcgcagcttcaacttccccactcgtgtcgaccaggacaacgtctctgccaagtttaaggacggtatcctgagcattgttgttcccaaggccaagaagcacgagtctcgccgcatcaacgtcgagtaaacgcgacaacacaccacaacccggaatcttgacgaccttattatccagctctcagatttcacgacaagtcaagatcagtaatgactcatctttacgactttagcattgcatggatcggtgttgggaagtttcttagcatgaaatagcattgtaggcctggcttggtcattcgctccttgt

SEQ ID NO: 4481 - DNA, 456 bp, Cicer arietinum
caagaatctaaaatcctgaaagaaagaaacgaagtttgacactcactgatcaaatgagtcgccatccggaagttctgtgggcgcagcggtctgacaaggtttacctgactgttgctctacctgatgccaaggatgttactgtgaagtgtgagcctcatggtttgtttagtttctctgcttctagggttcaacatgaatcttacagctttagtttggaactttatggatcaattgaacctgggggttgtaaaactaaaactagctcaagaaacatactatgctcaatccagaaaggacaaagaggttggtggaaaaggctactgaagtctgaagagaaacctgcaccatacctgaaggttgattggaataaatggtgtgatgaagatgaagagtcagattatgagttgatatctgacgacgatggacgatttgctggtgaagatgatgaaagcagtg

SEQ ID NO: 4482 - DNA, 302 bp, Cicer arietinum
caaggagcgaatgaccaagccaggcctacaatgctatttcatgctaagaaacttcccaacaccgatccatgcaacgctaaagtcgtaaagatgagtcattactgatcttgacttgtcgtgaaatctgagagctggataataaggtcgtcaagattccgggttgtggtgtgttgtcgcgtttactcgacgttgatgcggcgagactcgtgcttcttggccttgggaacaacaatgctcaggataccgtccttaaacttggcagagacgttgtcctggtcgacacgagtggggaagttgaagct

SEQ ID NO: 4483 - DNA, 364 bp, Cicer arietinum
ccatgttcgctgggagaaggatgaaaccggcaagtttcaatttaaggaaattgagggcagtgaagagattattgaggcagacatagttttactagccatgggattccttggtcctgagtcgaatattgcagagaagttgggtgtggagcgagacaacaggtcaaacttcaaggctgattatggtcgcttcccgaccaatgtgaatggggtgtttgcagcaggtgattgtcgccgcggtcagtcgttagttgtatgggctatttcagagggaaggcaagctgccgcacaagtcgacagctacctcaccaaagaagaccaggaccataatattgatgggaatcaggatgaatttgtgaagaggcaa

SEQ ID NO: 4484 - DNA, 295 bp, Cicer arietinum
acgtgatggtgtttggcaagtgacatacactctctttgatagagattttgatgagagtgagtgtcaattgccacaaagatgtggaaaatttgggctttgtgaggaaaatcaatgtgttggttgtccattagaaaatggaatatttgggtggagcaataaatgtagtgctaagcctatagcaacatgcaaagaaagtgaatttcattactacaaaattgaaggagttgagcattatatgagcaaatacactaatggtgatagtgtaagtgaagctaattgtggaaataaatgcacc

SEQ ID NO: 4485 - DNA, 292 bp, Cicer arietinum
acggtgttgggatcctatgcgcacttcatgtgggaagcagcggaggaggaagaggaatcagaagtggagttgatagttgctttttaatgggtttgagaatgacacgtgtatgtttctaactggcgttgaatgtgaaaggttatggagtgacaacaataaatagtctcactctcgcatctaatataactgaaactcccataacagagagggaccgaaagtctaacctttctgtatcttgttcttttctacttgttttatttcttctactggatgtaactatgtacctgcccgg

SEQ ID NO: 4486 - DNA, 459 bp, Cicer arietinum
gtcgagaaataaggaagatattgactgaaagggcctcccaattcaacattgcattggatgatgtgtcaatcacaagcttgacgtttgggagggagttcacggctgcaattgaagccaagcaggttgctgctcaagaagcggagagagcaaaatttgttgtagaaaaagctgaacaagacaaaagaagtgctgttattagagcacagggagaagccaaaagtgctcaattgatcggtcaagctattgccaacaaccctgcatttataaccttaaggaaaattgaagctgcaagggaaatcgctcaaacaatttcaaattctgccaacaaggtttacttgaaatctgatgatctcttgttgaatcttcgggatttaaatttggagcccagtgggaagaaatagtcatgttgctgaattcactaatttatttcagtgtatcttgtttctcgtattatgattg

SEQ ID NO: 4487 - DNA, 423 bp, Cicer arietinum
accctcgccgactacaatatccagaaggaatctacccttcatctcgtcctccgtcttcgtggaggtatgcagatctttgtgaagaccctcaccggtaagaccatcactctcgaagttgaaagctctgacaccatcgacaacgtgaaggctaagatccaagacaaggaaggaatcccaccagaccagcagagactcatcttcgccggaaagcagcttgaagatggccgcaccttagctgactacaacatccagaaggagtcaacccttcaccttgtgttgcgtcttcgcggtggtatgcaaatcttcgtgaagaccctcactggtaaaactattacccttgaggtggagagttctgacacaatcgacaacgttaaggccaagatccaggataaggaaggtattcccccagatcagcagaggttg

SEQ ID NO: 4488 - DNA, 459 bp, Cicer arietinum
acacaagtgagctgctagctcttcttatccactataaacaacaacaaagttacaagacaactcaaagaagctgtgataatcaccatactagtagctaacagcaacgatgcatatcccatttatctttgttttcagcaataacctcaactctatcaaggcagagtgtaaggtccacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttgtgacacacttgcattttcatcttgtgctgcacttgcacaaggagctagcttaaaagcttcattatctggtgtagtggattttccacattcaccagcactttccacacttgcaacactaacaagt

SEQ ID NO: 4489 - DNA, 322 bp, Cicer arietinum
actgtttttgattcaagctttgaaagaaataatccaattgactttgagcttggtagtggccaagtgatcaaaggatgggaccaaggattattgggaatgtgtctcggtgggaagcggaaactgaaaataccagcaaaacttggctacggagagcagggctccccacccactattccagggggtgcaacacttatatttgataccgagcttgtgggagtgaacgacaaaagtttaagcgaagaaaaatcaaactccgaactgtagacaaatcaaaagaaatggataactagactttcgggaatatttgatagcttatttgtgt

SEQ ID NO: 4490 - DNA, 406 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaact

SEQ ID NO: 4491 - DNA, 460 bp, Cicer arietinum
acaactgggaccccaaagggtgccgttttgacccatcaaaactttattgcaaatgttgctggggccactatgaatgaatctttcaacccttctgatgtttatatatcctatcttcctttggcacacatttatgagcgagcaaatcaagtcatgacagtatattttggcattgcagtaggattctatcagggggataatttgaaattaattgatgacctagcagttctaagacctactatcttcagtagtgttcctcgtctatataatagaatatatgctggtattattaatgctgtcaaaacatctggtggtctgaaggagaggctattcaatgctgcctacaatgctaaaaggcaggcattattgcatggcaagaacccatctccaatgtgggacagattagttttcaacaagataaaggaaaaacttggaggacgggttcgtcttatggtatcaggtg

SEQ ID NO: 4492 - DNA, 400 bp, Cicer arietinum
acactatttagtcaaagaattcccaattgaactttggatgaactgaattattggtggatgagctggatgatgatgttgaattgacaggaattaatggtggtagagaatcaaatgtctcccattttgtagtaactacaacttctgaggtagaagaatttctagaaggtttgtgttgaagctgctcaaatactaaagaattcccatttgagttcctttgaggttgttgttccaaatttagttgtaatctatgatgcccatttgacatttcttgtggttgttcttgaattggagctagtcttttcccattttgttgaggcttcttcattggggcatgactcccattacaattcttaattttcaacaaatccaaagtttcaacatacttttgaactctttttac

SEQ ID NO: 4493 - DNA, 465 bp, Cicer arietinum
acctcttaagaccgctgctgttgaagaagccccatctgtggttgtgtctgatgtagagacagagaaacatcctgtgcaccctgttcaaagtgatgtaactcaaactagtgaaaagtatgtggttaaagaagctccaattaatccctctacagaacaatcatcatctggttcaacaaatcgattttcagatgaagcatatgaggatgatgccgatgactggttgaaagaagaggatacttctgaaatggttggtcccagtggaacttccattcatactggtgatgaagaggatgtctcattcagtgatcttgaggaggaggatggtgatgtagatgcaaattataaaaaaactagatcaggttctgattcttccacaaaagactctcgagattgggttcagttgggtagaagttcacctaactctgataaggatataaactctatggaaagcagacatgcaggctc

SEQ ID NO: 4494 - DNA, 377 bp, Cicer arietinum
  misc_feature (4)..(4): n is a, c, g, or t
  misc_feature (6)..(6): n is a, c, g, or t
  misc_feature (9)..(9): n is a, c, g, or t
  misc_feature (95)..(95): n is a, c, g, or t
ttcnancgnccgcccgggcaggccctagtctcttcaggatatcattgccattctgggtatggatgagttgtctgaggccgacaagcttactgtcnagcgtgcccgtaagatccagcgtttcctgagccagcctttcactgtcgcccaggttttcactggtatcgagggtaagctcgtccaccttaaggagaccatcaactccttcaaggccatccttaacggtgtttttgacagccttcctgagggtggcttccacatggttggtgacttcgcctccgccaaggtcaagggtgagaagattcttgctgagcttgagggtcagtaaggggtttaattcttgaagttaatgccgcgcgacacgggaggatagaaataaa

SEQ ID NO: 4495 - DNA, 402 bp, Cicer arietinum
  misc_feature (131)..(131): n is a, c, g, or t
actcattacccccaagaggcacctctctactcgtagctcgccctacagtagttgtcggtgaagcacgtcccattggacatcaatacagttgatctcagcagagattccctccagcaacgtttctatctagntcatccagcatatcatcggcacgaaggcgctttactttcaagaggtcatcccgtcagcgggaactattcctctccagcctagaattctcttgcacagatagatcaagtagctttccataccctgaggcaggaagtccatgatcccctaagatcgccagtagctgcaacctaggaccgtgcatccttggggaaaacccttgcaggagaaaaccccaaggcggctagaacgctgctctgtggacgaggtagtcgcctcattccacggtctcca

SEQ ID NO: 4496 - DNA, 437 bp, Cicer arietinum
accgtgttgaagatgctaatattgaagatattgtaggagtgatttgcaatttgccatcagttgacggtgaagatgcaggaaaggttcagtcaagaaaggcagttgctaccagaatggtagggaagagcttacaagctggagatgctgtgtttgagagggtgttcaatgctgtctattcggctttgcgtggagtcgtgcttgggggaactgggccccgcgggaggaaattagctgaaatggctctccttaaagttggggctggtgctctgactgatagggtagtagaagctgctcgtgttttgattgtggcagccactatatcagtcggtgttcacgggccatggtataaatgtttgactgataacgtatgaacataattgtataacaaaaatgtaaaagtacacgaaataatattacacacatatctgtcctcggcc

SEQ ID NO: 4497 - DNA, 256 bp, Cicer arietinum
actaaggggaataagtatttaaatcaaatacaaaatatcagatagatgatagtcattaaacattttatttcagcagaccaaacaagttacacaagttactgaagaaggaagaaaaagaaacaatcaaatttgcgacccagagaggacattatggcagaaactgatttgcaattgaaactgaccacatctcatgatccataactgaagaagcatgagtaaagttttgccttccttaaatttcggcatagcttggtca

SEQ ID NO: 4498 - DNA, 444 bp, Cicer arietinum
cggccgaggtacatgagtgtgatgaaaatcaattggaaatcgatatttccaagttgctacaaggatgaaaatggttactcttcaccgaaaccagcagcaacaaaagcggttgctacaaagacaaattcatttaacagaatatctctgacggatctgagttttccaagcgcaacaacgctttcagcagaagatctttcaatttctctagtaggttctaatctctatgttttcacactcgctgagcccaagattattactcagggtttctcttcaagtaactttcttggtgaaggagggtttggacctgtgcataaaggtttcattgatgataaagttagacctggacttgaacctcaacctgttgctgttaagctcttagatttggatggttctcagggtcataaagaatggctgactgaggttgtgtttttgggtcaactgaga

SEQ ID NO: 4499 - DNA, 208 bp, Cicer arietinum
gcatggaagcaagaccgttggaagatgggcttgcagaggccattgatgaaggcacaattggaccaagggatgaccccaaaatccgttctaaaatcttgtcagagcagtatggttgggataaggatcttgctaagaagatttggtgttttggacctgagaccactggacccaacatggtggttgatatgtgtaagggagtccagtattt

SEQ ID NO: 4500 - DNA, 462 bp, Cicer arietinum
accaagggtgattaccagagtatctcgtggggatggggtctcggtgtcatgcttggagtatacgttggcggtaaatcaggtggtcacttgaacccagccgtcactctcgccaactgtatattcagaggtcatccctggagaaagttccctgtgtatgccgtcgcccaagtccttggagccatgtgtgctgctgccgtcgtgtatggcaactacaagtctgcctttgatgcttatgaaggcggtccaggaattcgaacagtgattggcgagaatgcaaccgctggtgtcttctgcacatatcccgcggaattcatgacacgcactggcatgttcttctctgaattcatcgccagcacgattttgcagtttgtcattttcgctatggctgatagcgctaacatcggtgctggtcctttgatgccacttggcttgttcttcttgatctttggaattggtgcttgc

SEQ ID NO: 4501 - DNA, 304 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgggcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtgg

SEQ ID NO: 4502 - DNA, 308 bp, Cicer arietinum
cggtcggccgaggtacccggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttctaattccgaaggactaaaggatcgataggccacgctttcacggttcgtattcgta

SEQ ID NO: 4503 - DNA, 307 bp, Cicer arietinum
cggtcggccgaggtactaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 4504 - DNA, 302 bp, Cicer arietinum
caagagttaaggttcctaaattattagttgagtgaaattaagaaggtttttattaaagtcgacaaggagataggcttagaagcagccataattttatgacctcgtaacagagcgcttgttaagttttaaaagcatcgaaaatttatcggatctaaacaatataccgaaaccttgtccatattattttataattaaagcttaattataattaaatggggtagcagaacgttgagctaaataagatttttattttttaaatgaaattataataatttaactcaagtgataatggtgacatgagt

SEQ ID NO: 4505 - DNA, 204 bp, Cicer arietinum
acttaaacatgtatgtcatgtaatcagttgtgatgaaaggatcgttgattgcaacaagttcaacatcgtctctttgaagagcaactctagcaaccaaacgcccaattcttccgaatccgttgataccgatcctaatcttcttgtcagatgccattagaatgagagtgagaataatagagttgaaaaataatagagaaatgagat

SEQ ID NO: 4506 - DNA, 384 bp, Cicer arietinum
acctcaatctcctcaaccattttcttcaaccttatcaaattacatgtctcaagctcatagccgccgtcaccgccgtcacacttctagtgtgatggattctgcttcttccctggttggattcgattatgagttgaagaagagcaagtccgtcgcttttgtttcaagaagccaaattagcggtagggaattcaatggagataacaaggaaaataataagaaaggaagcttttggtccaagctactcaaattgacaagaaaggacaccaaggaagccttcatgcattcaagaacaatgagggagagaaagggttgactttttgtaaacagtttaataaaacttagatccacttttttaataacttaactgcacataattaaattgga

SEQ ID NO: 4507 - DNA, 389 bp, Cicer arietinum
acttggttaatatgactgaaaaagattaccaaagaaaaaagaataagtttctgcccaaaattcatgcatgggtccaggaacatggaggtgggcaaatgattcctttcagctgtgtcttagagaagaatctttcagatatgcctcctgatgaggcagctaaatattgtgaagcgaacaacgttcaaagcgctcttcccaaaataataaagactggattttcagctatcaatctcatttactttttcacagcgggacctgatgaggttaagtgttggcaaattagacgcctaacaaaggctcctcaagctgcaggggctatccatactgattttgaaaagggatttatatgtgctgcggtgatgaagtttgaggatctaaaggaacttggt

SEQ ID NO: 4508 - DNA, 357 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtggag

SEQ ID NO: 4509 - DNA, 435 bp, Cicer arietinum
caaatcatttcacttttgagatcaaacaacacttctggtttccaaatttctcttagagatggaagatggatttcagtgccacctgatcatagctccttcttcatcaatgttggtgattctcttcaggttatgactaatgggaggttcaaaagtgtgagacacagagttttggcaaatgggatcaacccaaggctctcaatgatttactttggtggaccaccccttagtgagaaaatagcaccattgccttcactcatgaaaggaaaagaaagtttgtataaagaatttacatggtttgagtataagaattcaacctatggttcaagattggctgacaatagacttggacactatgaaaggattgctgcctcctaatgcaagattattattatagggtgtttcacttgtcaatacaaaaaaatagggggatacaat

SEQ ID NO: 4510 - DNA, 197 bp, Cicer arietinum
acgaggagtggttagttaagcacggtaaagtttacaacggtttaggtgagaaagacaagaggtttgacatcttcaaagacaaccttaagttcatcgatgaacataatgttctgaattcaacctataggttgggtctgacccggttcgctgatctaaccaatgaagagtatcgagccaagtttttgggaactagggtc

SEQ ID NO: 4511 - DNA, 449 bp, Cicer arietinum
acccggatttttggggaaaaacggtgtggccacaagtgatttgagacggatactacgacttgatttggaatgattaattgatttcgtttgttaggtgttttgattactttcttccgaagtagacgatgaaaattggtggttgtttgtctgtttgttcgtatggtccctaacgtgcatcctttattttttcaagaggatttgccgtagggtgcgaacgcatgaagaagcgttgaaagttgaaagtcaagtgaaggtttgttgtttcagtgttcagttcgtgatagaagaaataatcaagttaggttttgtggttagttcatacgttgatgaccgaagggatgtaacttttgtaatttcctctagtctgatatacgtgaatctatagtgtttggatttagagtatttctttgtgtagtgtgtgtgattttttccatatggaagaattaagt

SEQ ID NO: 4512 - DNA, 293 bp, Cicer arietinum; identical to SEQ ID NO: 1098

SEQ ID NO: 4513 - DNA, 457 bp, Cicer arietinum
ctacgggctatgcgactacacaaaactgcggggatgctatcggctccctaacagcagctttcggagaaggaattttggagagttcgccttctctgacaacaactttgtcggatctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgct

SEQ ID NO: 4514 - DNA, 436 bp, Cicer arietinum
acggacatgggccatccgactgtttaaaaaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttgttttacttattccgtgaatcggaggcggggcgctgcccc

SEQ ID NO: 4515 - DNA, 447 bp, Cicer arietinum
acctttgatacagcagaagaagctgctttggcttatgataaagcagcttttaagctccgtggtgactttgctaggcttaactttcctaacctgaaacacacaggttcatgtgttgttggtggtgaatttggtgagtataagcctcttccttcttctgttgatgctaaacttcaagctatttgtgaagatttagctcagatccagaaacaagggaagtcagagaagccaaccaagaagaaaacaccctccaaacttgcttccaagcctgtttccacggtcactattccgttggaggattctgttgatttgaagaatgtttcggataactgttgtaaagttgaagtttcgttttcgagtgaaggttcttcaccactttcggatcttacttttggtgatgttggtgagccacagtgggaaggtgattctgataatttcaatttacttaag

SEQ ID NO: 4516 - DNA, 483 bp, Cicer arietinum
gatttctctgctggtttgcacggttgggcatttactctgaccaactttgcaaaaatgtatgcctcaaagtttggcgttgatgaatccaagatgatggagaggctctggggtgaaaacttctttgatccagccacaaagaaatggaccacaaagaatactggttcaccttcttgcaagcgtggatttgttcaattctgttacgagcctatcaagcagattattaacacttgtatgaatgaccagaaggacaagttgtggcctatgctaacaaagctaggagtcaccatgaaatctgaagagaaagacttgatgggtaaggcattgatgaaacgtgtcatgcagacttggctcccagctagcagcgcactattggaaatgatgatctttcatcttccctctccatcaactgctcagaggtatcgtgttgagaatttgtatgagggtccccttgacgatcaatatgctaatgctatcagaaactgc

SEQ ID NO: 4517 - DNA, 238 bp, Cicer arietinum
actgacctacatcattcattcggctgacatttcatctaccttctgaattgcatgttgatgttggagagagggctttgtgtttttatttattattattatgagttatgattaattaacgtgtttgtagaacgcggcggagaaaggggataatatgttatgtaatgataataatgatagattgaggtgttatgtttgttttcctagtgagtgaagaaaagaatatgatcagttcatggag

SEQ ID NO: 4518 - DNA, 441 bp, Cicer arietinum
acttccaacaactcataagcgcggttgaattttgccacagtagaggagttgcacaccgcgatttaaaacctgagaatttgttactcgacgaacacggagaccttaaaatctccgattttggtctctccgctttgccagaacagcttcggcaggacgggcttttacatactcaatgtgggacccccgcttacgtggcacccgaggttgttagaaaaagaggttataacggttttaaagctgatacttggtcttgtggtgttattctttatgctttacttgctggatttcttccttttcaacatgaaaatcttattactatgtataataaggttttcaaagaagagtatcgattcccaccttggttttcgcctgaatcaaagagattaatctcgaagattctagttgcggatcctgaaagaagaatcactatttcttcaatta

SEQ ID NO: 4519 - DNA, 459 bp, Cicer arietinum
cgatggcttcttctaaggatcgtgaaaacttcgtctacatcgccaagctcgccgagcaagctgagcgatacgaagagatggtggattcaatgaagagtgttgcaaatctagatgttgaactgactgttgaagaaaggaatttgctttctgttggttataagaatgtgattggtgctcgcagagcatcgtggaggattctgtcttccattgagcaaaaggaagagacaaagggaaacgatgtaaatgcagaacggattaaggagtataggcataaggttgaatcagagctttcaaacatctgtaatgatgttatgagagtgattgatgaacaccttataccttcagctgcagctggtgaatcaactgtcttttactataagatgaaaggagattattatcgttaccttgcggaatttaagacaggcaatgagaagaaggaggctgctgatcagtcgatga

SEQ ID NO: 4520 - DNA, 294 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgggcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggat

SEQ ID NO: 4521 - DNA, 456 bp, Cicer arietinum
acactcgtccctacctgattgaacttatgttctcagacaccattcaaatctcaaatctaactctcctcaattctccatcatggaatattcatcctgtttacagcagcaacattattgtgcaaggaatcactattattgctcctgtctcatctcctaatacagatggtatcaacccagactcttgcacaaatacaagaattgaagattgctatatagtttctggggatgactgtgttgctgtgaagagtggatgggatgaatatggcacaaaatttgggatgccaaccaaacaactagtaatcagaaggctaacatgcatttcaccatacagtgcaaccatagccttgggaagtgaaatgtcaggagggatacaagatgttagagctgaagacatcacagccattcgaacagaatcaggtgtcaggattaaaacagctgttggtagaggaggttatg

SEQ ID NO: 4522 - DNA, 278 bp, Cicer arietinum
gttcattctacgaatatcgctgtgtgatggcaatgagatcggcgctgagtcgagggatcgtgactcgttcgatggactcaacatctcgtggagctttcagtcgtttctacagcggcaaaggtaagattcttagcgaagaggaacaagccaaagaaaacgtctacatccggaaatgggagcgggaaaggttggagaaactgaagctacagaatgataaggctaaggctgagaaggacaaagacactactgataagaaacctgatgggactcaaaagagc

SEQ ID NO: 4523 - DNA, 462 bp, Cicer arietinum
accccttcattgtcctccattggattgcagtatttgggagaagggctctctgaggaaacacttgctgattatcagaacatatctgctgctaccattcgtggtgatcatgaagcctgtttgctctacactgagcaattcaagaaagggtgtgttgagcaattcaagcaagggactttagggattgaacagctagctgcagtggatggtttgtgtgatttgataacggagacgattggggcaaaggatccagttaaatcatacaatgtgaatctctctgttttcacatccattcctgatttttggggcatagagcaattgtttccaattgtcccaattcatcgtctggatgagaaaccaactgctaggggtattttatctgacttaacttgtgacagtgatgggaagataaacaagttcattggtggtgagtcaagcttgccacttcatgaattggaaggacaa

SEQ ID NO: 4524 - DNA, 149 bp, Cicer arietinum
acaccaattcgccggtcaacacgaactccaacaccaaagcgggacgcgctccaactccagctgaaagtgagaatgctggaacagacaaaccagtagcgaagacgaggagcaaggaagcgacgatggatccgaggagttgagcgataatg

SEQ ID NO: 4525 - DNA, 165 bp, Cicer arietinum
acagatcgttggtgatgatctccttgttaccaacccaaagtgtgtggagaaagctattaaggagaagtcttgcaatgcccttttattgaaggtgaatcaaattggtagtgtaactgagagtattgaagttgtgagaatgtctaacaaagctggctggggtgtcat

SEQ ID NO: 4526 - DNA, 457 bp, Cicer arietinum
actacttttactacccttcttttctttctcctaataataactttcctttcaattgcaatttcaacaccaacaaatttcatcaaatcatcatgtagcacaacacaatacccaacactttgtgttgaatcactttctacctatgcatcaacaattcaacaagaccctcatcaattagtccaaacagctatatcaataagcctcaacaaaacccaatccactaaagattttgttacaaggtgcaaaaatatcaagggtcttaaagcaagagaatatgctgccttacatgatcgtagtgaagaaattagtgatagtgttgataggcttatccgttcattaaaagagcttaaaatttgcaagatcaaaggtgaggatttcaattggcatataagtaatgttgagacatgggttagctcagctttgactgatgaaacaacttgtggtgatgggtttggtggaa

SEQ ID NO: 4527 - DNA, 281 bp, Cicer arietinum
acagatcgttggtgatgatctccttgttaccaacccaaagtgtgtggagaaagctattaaggagaagtcttgcaatgcccttttattgaaggtgaatcaaattggtagtgtaactgaaagtattgaagttgtgagaatgtctaagaaagctggctggggtgtcatggctagtcaccgaagtggtgaaactgaggataccttcattgctgatctctcagttgggttagcaacaggtcagatcaagaccggagctccctgcagatccgaaaggcttgctaagt

SEQ ID NO: 4528 - DNA, 126 bp, Cicer arietinum
aaaaaggtttaacagaggcactgccggaagggaacaaccaccgtctttcaattttccggcgatctcctcgtttcttccacctgcgatctagtatcccaacaatcaaacatgactacatcaagacgc

SEQ ID NO: 4529 - DNA, 319 bp, Cicer arietinum
  misc_feature (319)..(319): n is a, c, g, or t
acaacaaaatatttcttatattaagataaacaaggattcaaaatgaaaagaaaaatggggaaaaaaaaagtcatcaactctaaaacaagagaacctaaggccgactattaatttaaaatacaaaaaatataaaacatagacactttgtgtttcaatgacttcactcacaacaacacaaagttttattaagccgaattcaaattcacactatgataatctcgagtgagacaaaatttagaacaggttcaaacgatacaatctaagctatcagcctcaagccacagaagcaatgtggacaatcaaatcaataacacgggtn

SEQ ID NO: 4530 - DNA, 230 bp, Cicer arietinum
ctgtatggagagctagctagatttgtgttgcggttgctcggggtcagaactaagtccaagaaggttaacccgccaggtccgaatggacatccacttcatggaccacacaattcttctggaaatatgaactacattgagggagcaaaggctgctccaagtggttcttgggacaatgtctggggaaatgatgccagtgaataatttggtgaatttagttagtgtgttcaagt

SEQ ID NO: 4531 - DNA, 322 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgg

SEQ ID NO: 4532 - DNA, 203 bp, Cicer arietinum
caaccggacctcatcccaatcctaatgggaaagaacatggttcccctgaggacccgattcgacatgctggcgatttaggaaatatcaatgtcggtgatgatggaactgtaagcttctctattactgacaatcagatccctctcactggaccaaactccatcataggaagggctgttgttgttcatgctgatcctgatgatctt

SEQ ID NO: 4533 - DNA, 402 bp, Cicer arietinum
acctgccttgtgcaaaccagatttgacatatcccatagctatgttcttcttgagacaaggactgaatccaccacttgtgacttcaccaatgttgttgcctccttcatcttgaatctcactgtgacttctaggaggtggacccgaagaaatgaaaccgacacgcctgatcaaaggaccatctccgagctgtttcaggataacatcagctccaagaaaaccgccttctgctcttctccgctttcctatagcccatgtcagtcctgcctcaataggtgtaatatgctgttccaggtcattgccgtataagcacaatccagcttcgaggcgaagactatctctagcacctagtcctgtcaatcttattttcccttcagatttttccagtaatgccttggcaagatc

SEQ ID NO: 4534 - DNA, 411 bp, Cicer arietinum
acactggggattacggatttgagatctcagttccttcagagaatggagtagatcttgccaaggcattactggaaaaatctgaagggaaaataagattgacaggactaggtgctagagatagtcttcgcctcgaagctggattgtgcttatacggcaatgacctggaacagcatattacacctattgaggcaggactgacatgggctataggaaagtttagaagagcagaaggcggttttcttggagctgatgttatcctgaaacagctcggagatggtcctttgatcaggcgtgtcggtttcatttcttcgggtccacctcctagaagtcacagtgagattcaagatgaaggaggcaacaacattggtgaagtcacaagtggtggattcagtccttgtctcaagaagaaca

SEQ ID NO: 4535 - DNA, 440 bp, Cicer arietinum
acaaaagcaccattttccattttacacttacattcttatcttagcaatagcattgtaaacaaaggatttaaatgaagatgccaataatatataatccttgcttcgaaaactatatatacctcttatttttcacattttcttaatataacaagttttagaaacgattgtcatcatcggcaggaggataccccgggtggtgaggtggcttctcatatggaggataccctgggtagtgaggtggcttctcatatggaggcccgtaaaccggtggtttctcaactgggggcttataaactggaggctcttcaattggtggcttgtataccggaggtttctctacaggtggtgtgtagacagggggtttctcaattggtggtttgtatacaggtggcttctctactggtggtttgtaaatcggtggtttctcaactggaggtttg

SEQ ID NO: 4536 - DNA, 165 bp, Cicer arietinum
ggcagagctatttgtgaatcaggcaaaacaatatgcagattcaagaccaagttatccgctacagctattccaattcatagcttcaaaaactccctctcacaacctcgtttgggacgtcgctaccggaagtggccaagccgccaaatctttagctacattgtacct

SEQ ID NO: 4537 - DNA, 336 bp, Cicer arietinum
tttggaggtgctcggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatgtcatactctcttcttcttttcattttgttgtggaagt

SEQ ID NO: 4538 - DNA, 442 bp, Cicer arietinum
acaagtaatgtaattccggataacagaaaatggggaagtcagagtctggatcttaattcgggccctggtggcacagatgccgagcgcagagatgacagattgccttcgggattgaggcagctgcctgtctccaatccacaagccttgatggaggatcacttgaaaatgtttcagatggctggtgcattaaaaagaaaggaacctgatggtagttgggatggagctgatagattcagttacaaacatccctcatggcagtaggataatggcactctttgaagcaattttttaagaggtcagccccttattttatggaaaaatcagaaaaattggggaagttataagtgatgcaacctttgctgctgatgggccgaaagtgatcagaacctctgatgcggttgttgtgtgcaaatctgggtcccacagattgccctttgcagat

SEQ ID NO: 4539 - DNA, 442 bp, Cicer arietinum
ggggtgtcctgagatcacattcaacaatggttaaggctgtggcagttcttggtagcagtgacactgtgtctgggactattaacttcagtcaggagggagacggtccaaccactgtaactggaaatcttgctggtcttaagcctggtctccatggcttccatattcatgccttaggggacaccacaaatggctgcatgtcaaccggaccacatttcaatcctaatgggaaagaacatggttcccctgaggacccgattcgacatgctggcgatttaggaaatatcaatgtcggtgatgatggaactgtaagcttctctattactgacaatcagatccctctcactggaccaaactccatcataggaagggctgttgttgttcatgctgatcctgatgatcttgggaaaggtggtcacgagcttagcaaaactactggaaatgc

SEQ ID NO: 4540 - DNA, 284 bp, Cicer arietinum
  misc_feature (54)..(54): n is a, c, g, or t
  misc_feature (131)..(131): n is a, c, g, or t
  misc_feature (148)..(148): n is a, c, g, or t
  misc_feature (203)..(203): n is a, c, g, or t
  misc_feature (211)..(212): n is a, c, g, or t
  misc_feature (218)..(218): n is a, c, g, or t
acactaatttgttgcataaccttgcgaaccgagaataaggtccaccagtgttgntccaaatatatcatacagataataaaatcaatatttaccaccatggtcatcaatctagaacagcaacctcttggtcnaccctccagtaatttgnttcattgaactccttcacaccaggactgtcctcttcagaactttccttttctggnacttttgnnactacntttctttttaatggctcggtttccccaactatcccttctttgagagcttgttccattgccttaccc

SEQ ID NO: 4541 - DNA, 414 bp, Cicer arietinum
acaaaaggttatatcaattcctcggggtcaagctcggggtcttacatggttcattccttccgatgacccgactctgatctcaaaacaacaactctttgcaagaattgttggaggattaggtggtagggctgcagaagaaattatttttggtgagcctgaggttacaactggtgcagctggtgatttgcagcaaattaccggtttggcaagacagatggtaaccacatttggaatgtctgatattggtccatggtcacttatggacgcatcagcacaaggtggggatgttatcatgagaatgatggcaagaaactcaatgtcagaaaagcttgcagaagacattgataccgctgtcaagaggttatcagatgaagcatatgaaattgcattgacacatataaagaacaaccgtga

SEQ ID NO: 4542 - DNA, 122 bp, Cicer arietinum
ggccacctcaattgtagctcctgctactctctacaaagctctagttacagatgctgacaaccttactccaaaggttattgatgccattaagagtgttgaaattgttgaaggaaatggtggcc

SEQ ID NO: 4543 - DNA, 200 bp, Cicer arietinum
ggagcagttaccaagatcaaggagtcaaatctttctcttttaacatatggcaaattaaacaatgttccagaagcggtttacatgcagcacctaatgggaatcgatggggtgatagtagattttgtgcaagaaataacagaggccgttgcggatatgatgaagccagcaaagattggagaggaagagggtttgaatgaagg

SEQ ID NO: 4544 - DNA, 269 bp, Cicer arietinum
ctgcaggcaatcttgttaaggttaagggttcattcaaactcgctccggctaaatcttctgtggctaaacctaaagccgctactgctcccgctgctaccaagaaggctaaggctgttaccaagccagccgccaaggctgctaccaagcccaaggctaaagctgttgcgaagcctaaagcagcggcaaagcccaaagctgcaacgaagccgaaaacggctgcgaagccaaaagcgaagacggttaagacaacaccggtgaagaaggctgtt

SEQ ID NO: 4545 - DNA, 184 bp, Cicer arietinum
actcctcattgaaaggagatcctataaaagatgctagtcctgcctttgattacttggagaatgctcttagtaaatttgatgatggaccattctttctaggacaattcagttgggtggatattgcctatattccatttgttgaaagattccatatagtcttttctgaggtcggtgatgctgccaa

SEQ ID NO: 4546 - DNA, 423 bp, Cicer arietinum
  misc_feature (227)..(227): n is a, c, g, or t
atggaaggaccctcgctgattacaacatccagaaggagtctacccttcaccttgtgttgcgtcttcgtggtggtatgcagatttttgtgaagaccttgactgagaagacaattacccttgaggtggagagctctgataccattgataatgtgaaggcaaaaattcaggataaagaaggtgtcccaccggaccagcagaggttgatctttgcagggaagcagttggangatggaaggacccttgctgattacaatattcagaaggagtccacccttcaccttgtgctccgtcttcgtggtggtttctaatctgtggctgtgggattaatatctgtctgatgtttcttttacttgttgtggaagtgatagggcctgtgttggcccagtagaataagtttacgatgttatgaattttatggttctt

SEQ ID NO: 4547 - DNA, 416 bp, Cicer arietinum
atttcgtggtcctagtgatactcatttggatagtcttgttggacaagctttgtttggagatggagctgctgcattgattgttggatctgatccaattcctgaaattgagaaaccaatatttgagatggtttggactgcacaaacaattgctccagatagtgaaggtgctattgatggtcaccttcgtgaagcaggactcacatttcaccttcttaaagatgttcctgggattgtctcaaagaacattgataaagctttgattgaagctttccaaccattgaacatatctgattacaattcaatattttggattgcacatccaggtggaccagcaattctagaccaagtagaggaaaagttagccttgaagcctgaaaagatgagggcaactagggaagtgttgagtgaatatggaa

SEQ ID NO: 4548 - DNA, 402 bp, Cicer arietinum
  misc_feature (274)..(274): n is a, c, g, or t
actcttccaataaatccactctgctctttctaccatcccttcttcctgttttcagaggaatatatggtcctcctagcgaaacaatgccatctctagcagaaagaacaaggatgtcagaacaagaaacaactccaggacactctctttcaacagcttctttgattgtatcaatgtatctgaaattcctcaaaccaaagcttctgtcatgttcttgttcagataagcttcttcttgtggaagtcagcaacaaagaagcatcacaactctgaacagnacagtcatggaaaatgtttctgagccatgagaaagcagtgttcttgtgacgcttgtaaagaagtttgacttgctctttgatgatttcttcagcttgaggacatgattctttgcagcagctcataacaa

SEQ ID NO: 4549 - DNA, 435 bp, Cicer arietinum
acactggggaagatggatttgagatctcagttccttcagagaatggagtagatcttgccaaggcattactggaaaaatctgaagggaaaataagattgacaggactaggtgctagagatagtcttcgcctcgaagctggattgtgcttatacggcaatgacctggaacagcatattacacctattgaggcaggactgacatgggctataggaaagcggagaagagcagaaggcggttttcttggagctgatgttatcctgaaacagctcggagatggtcctttgatcaggcgtgtcggtttcatttcttcgggtccacctcctagaagtcacagtgagattcaagatgaaggaggcaacaacattggtgaagtcacaagtggtggattcagtccttgtctcaagaagaacatagctatgggatatgtcaaatctg

SEQ ID NO: 4550 - DNA, 359 bp, Cicer arietinum
acagttgccttctctgctggtttgcacggttgggcatttactctgaccaactttgcaaaaatgtatgcctcaaagtttggcgttgatgaatccaagatgatggagaggctctggggtgaaaacttctttgatccagccacaaagaaatggaccacaaagaatactggttcaccttcttgcaagcgtggatttgttcaattctgttacgagcctatcaagcagattattaacacttgtatgaatgaccagaaggacaagttgtggcctatgctaacaaagctaggagtcgaccatgaaatctgaagagaaagacttgatgggtaaggcattgatgaaacgtgtcatgcagacttggctcc

SEQ ID NO: 4551 - DNA, 404 bp, Cicer arietinum
gaccaaccaccggtagagaagccaccagtttacaaacctccagttgagaaaccaccgatttacaaaccaccagtagagaagccacctgtatacaaaccaccaattgagaaaccccctgtctacacaccacctgtagagaaacctccggtatacaagccaccaattgaagagcctccagtttataagcccccagttgagaaaccaccggtttacgggcctccatatgagaagccacctcactacccagggtatcctccatatgagaagccacctcaccacccggggtatcctcctgccgatgatgacaatcgtttctaaaacttgttatattaagaaaatgtgaaaaataagaggtatatatagttttcgaagcaaggattatatattattggcatcttcattta

SEQ ID NO: 4552 - DNA, 412 bp, Cicer arietinum
acaaaaggtttccccaattcctcggggtcaagctcggggtcttacatggttcattccttccgatgacccgactctgatctcaaaacaacaactctttgcaagaattgttggaggattaggtggtagggctgcagaagaaattatttttggtgagcctgaggttacaactggtgcagctggtgatttgcagcaaattaccggtttggcaagacagatggtaaccacatttggaatgtctgatattggtccatggtcacttatggacgcatcagcacaaggtggggatgttatcatgagaatgatggcaagaaactcaatgtcagaaaagcttgcagaagacattgataccgctgtcaagaggttatcagatgaagcatatgaaattgcattgacacatataaagaacaaccgt

SEQ ID NO: 4553 - DNA, 200 bp, Cicer arietinum; identical to SEQ ID NO: 4543

SEQ ID NO: 4554 - DNA, 158 bp, Cicer arietinum
acaacactagtagctagcacttcaaacatgccggtggctgctcgtgaagcttcaatttatacaggaatcactttagctgagtattttagagatatgggttacaatgtcagtatgatggcagattcaacatctcgatgggcagaagcattgcgtgaaat

SEQ ID NO: 4555 - DNA, 248 bp, Cicer arietinum
accttttccaaagaaccaagcaatgagaatctattccagcctgtggaatgcagatgattgggccactagaggtggattggtgaaaactgattggtccaaagcaccctttacagcttactaccgaaacttcaaagccactcaattctcatccaactcttattcaaattctaataatgctgaatgggaaataaatgaacttgatgcttatggcaggagaagattgagatgggttcaaaagtacctgcccg

SEQ ID NO: 4556 - DNA, 440 bp, Cicer arietinum
tcttaattcatcatcatgggcgttttcagttttgaggatgaggccacctcaattgtagctcctgctactctctacaaagctctagttacagatgccgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatgg

SEQ ID NO: 4557 - DNA, 231 bp, Cicer arietinum
aaattgttaaggtttgaaatctgaatctgatgaaatgaattcgaagattgaagaacaagaagaaacgattcgaaacgtgaaaatctgaaaacgaatctatttgacccgttttctgagtcgggtttgggtcacacgtgtttaattcgttttattttatttactttccagattttattatatttatataaatagggaaaaaaatctttaggttaagatagattttaagagagg

SEQ ID NO: 4558 - DNA, 358 bp, Cicer arietinum
gatttcgagcgggccgcccgggcaggtacaaccccttccctcttcatttggggaacgagttctatgatcaactatgcatgttacaagcttgaatgaaccactggatcaatcaacagtataaaatatcaactgcaattaaatcacaatggagattctttccatggtaatctatcaaggccatcaacaatggcccttcgaaactcgccattatggagaaggaaagatgagacgtgcccgcctgtcacccatcttacctcagaacctggccaagctttctgtagttctaggactgagtgttttggaatgtatccatcatcagttgcagcaacaaggattacagcattggggtttttgggaa

SEQ ID NO: 4559 - DNA, 236 bp, Cicer arietinum
acccttaacatactctgtaaaagccaacgcaatcaaacccaacatagcaattcttccattccacagctctgcatctgaggacataacacctttggatttagactccacactaacaccttggaaaaatggaatcaaagaagcaagtgtcaacaacacacttgtccccaagaaccatgggactcctccaccagaaatctgttcaaacaaaccctgcccttttgctatttccaccccca

SEQ ID NO: 4560 - DNA, 435 bp, Cicer arietinum
gtgctttctttgcttgacatcggttacagcagctccgcatcgtgggcgactatggcttcagactactatgcgcactacccagccaatacatcaaggctgaaagtttggctcttgactactgccggtattggtatccccacagcgatcggcatgactgcgggagctacggttgccagtgcacttaacaatgtcgacgcctggaagatcgcatacacttatcctcaccagggccttggcttcttaatcagagacatgctgcatcctcgaggcttcgccaagttgcttctcgttctgctatccttcagcggcatcaacaccaacatcatgtccctctactcatcggccatttcgtttcaacagatggccaccccgtgtgccaaagttcctcggtttgtctggacacttggtaatttggtaattgtcatagatctggct

SEQ ID NO: 4561 - DNA, 424 bp, Cicer arietinum
gagaaaaagattttacgaatattgatgataagatagagagactaataaagagacaaattcgaagaagaagaagaagggtttcgatgaaaaacacgatgcagagtgaaagcaacaacaataaccagttggtagttcagaattctggaagtttaagcttcagaaggcacttgtctaaagaagatgaagagatgtcaaaatctgctctttcaactttcagagctaaagaagaagaaattgaaaagaagaagatggaagtgagagaaaaggttcagcttcagttgggtcgtgttgaagaagaaaccaaacgtcttgctaccattcgtgaggagcttgaagcccttgctgatccaatgaggaaagatgtttcaattgtccgaaagaagattgattcaataaacgaagaattaaaggcacttggtcatac

SEQ ID NO: 4562 - DNA, 378 bp, Cicer arietinum
caggtatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgagataccactacttttaacgttattttacttattccgtgaatcg

SEQ ID NO: 4563 - DNA, 260 bp, Cicer arietinum
atgcgcacttcatgtgggaagcagcggaggaggaagaggaatcagaagtggagttgatagttgctttttaatgggtttgagaatgacacgtgtatgtttctaactggcgttgaatgtgaaaggttatggagtgacaacaataaatagtctcactctcgcatctaatataactgaaactcccataacagagagggaccgaaagtctaacctttctgtatcttgttcttttctacttgttttatttcttctactggatgtaa

SEQ ID NO: 4564 - DNA, 312 bp, Cicer arietinum
accattattttgaaatacctttagcatggaatgctaccgttatacactatataagcaactttcttcattttcacttacagttctactatctttgtagctggaaatgtaagttgtattcccaataagaggagtaatatcgaactcagttgccaatctgttacacgtagaacctgaagaacactgacgaagaacttgcaaaatctcctttgtggaaggcctagtggagggtaacgtgcttgtgcacatgaggtctaatttgaagacacttgtcatctctgctgcataacttgattctctgatatcctcatcaaa

SEQ ID NO: 4565 - DNA, 239 bp, Cicer arietinum
acttatggaagccttcttgaatatggccggcgcaggaattactcacacctcgattctatgatttagccgaatattaaaaaggataagtgacatgacagttcagtgcacttgaacagcctgctttacatatccttttgaggtaggttgttaatgtataaattgagtgtcctgcaaatgtcctgaatttgtagttgttgtagggtgtgtttatacctgtgtgtgataaacgagggtatgta

SEQ ID NO: 4566 - DNA, 409 bp, Cicer arietinum
gtgcttcgtttggctaaggatttggctgagaataacaaaggtgcacgtgcgttggttgtttgttctgaagtcactgcagtcacatttcgtggtcctagtgatactcatttggatagtcttgttggacaagctttgtttggagatggagctgctgcattgattgttggatctgatccaattcctgaaattgagaaaccaatatttgagatggtttggactgcacaaacaattgctccagatagtgaaggtgctattgatggtcaccttcgtgaagcaggactcacatttcaccttcttaaagatgttcctgggattgtctcaaagaacattgataaagctttgattgaagctttccaaccattgaacatatctgattacaattcaatattttggattgcacatccaggtg

SEQ ID NO: 4567 - DNA, 406 bp, Cicer arietinum
acattccaacacctagcgcccgaagcccccaaattacatgatgcatatataattatacaatgttcttgctctttcttaagtaacctaagtaagaaaccactgttgagttatgcaacataatacatatttccccaccaattcaatgcctccccctctccatggttttgctgctcagtttcagatgcaacaaacacattaaagtaacttctcccatcatcactcccatcatcctcctctgattgaactctttcaattggagccacacatccaccatagttgtcagctggaaagtaaggatcaacactgtcaacaacgacatggggactaccctcgtccaccactgcacttccaacacttccagcactcatgtggtcatccaccttgatgctgaaaatttgtgctattt

SEQ ID NO: 4568 - DNA, 288 bp, Cicer arietinum
actgctggagcatttggtcaatttgcaacaggaatcggaaatactgatgccggttttgtgttgggagcagggaagcttttgctaaaggtgcctccaactttgagatttgtaatggatgggaaatgcccaattatctgcttgcaaaggatttgattctgcaaattatcggtgaaatatccgtggctggtgcaacttacaaatctatggagtttgttggttcaactgttgaaagtttaaatatggaagaacggatgacattgtgcaacatgggtgttgaagctggaggag

SEQ ID NO: 4569 - DNA, 418 bp, Cicer arietinum
ttcaagcggccgcccggcaggtacttcaacggtattggcttgccaattccccctgcttcactatgtagttctgctcaggaaagtcttcccccttaaagtgtctctcaagcatgtctttaactccagcagcataacgtaactgtgcatctatggtggttccagaaatatgaggagtcatagcatgatttggcatgtagcgccatggatgatcttttggagctggttgtggaaaccaaacatcaccactataacctgcaatgtggccactagaacaagcatcagcaactgcttgcgtgtccataatcgccccgcgagcattgttaacaatcaagacacccttcttcaactttgcaattctatttttgtcaaacaatcctcttgtcttatcggcgaggggggtgttgataacaattacatc

SEQ ID NO: 4570 - DNA, 197 bp, Cicer arietinum
cgccgaagcttcttcagtgctctcggcttccctcgcctcagatatgttcgctaccgccgtttaagatagccacgcacaaaccgaaattccatctttacccctgtatataaaataaatatttccttctttttttcacttttgggcgataatcagataaggtcggttccatgccaagtcctaagaaccaacggaatcac

SEQ ID NO: 4571 - DNA, 198 bp, Cicer arietinum
tgttgcctcggtaggggtagaactaaattattcgggatgggtagggttatcagggcacaacgtaagggtgcgggatcagtcttcaaatcccacacccaccaccgtaagggaccagccagattccgcagtctcgatttcggtgaaagaaacggttacctcaagggagtaatcaccgatatcatccatgaccctggtcgt

SEQ ID NO: 4572 - DNA, 240 bp, Cicer arietinum
ccgggcaggtacctaatatggataagcaaacaagttattcagacatgctggatttggccgttcaacatattaaaggtcttcaaactcaagttcagaagcttcacggagaacttgaaaactgcagttgtggatgcaaacctagcacataatcttattttgttttacgagattaattctattacaatgtgcatagaatagaagtcaaggttttgaaggcaatgcatggaaactgatttttgt

SEQ ID NO: 4573 - DNA, 205 bp, Cicer arietinum
gattatttggagaacaccgacacgttagctggagctgccactacgttgccgcaatgtgtgcgtaacctagtcaagtggtcgcaaatcagcttgccccaagcggtgatgactgttactaataatgctgccaagtcaattggcgttgaccacgagcgtgggtttttgaatgttgggtgtttagctgattttgttgttttagacaaga

SEQ ID NO: 4574 - DNA, 382 bp, Cicer arietinum
gcacaagtgggctgctagctcttcttatccactataaacaacaacaaagttacaagacaactcaaagaagctgtgataatcaccatactagtagctaacagcaacgatgcatatcccatttatctttgttttcagcaataacctcaactctatcaaggcagagtgtaaggtccacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttgtgacacacttgcattttcatcttgtgctgcacttgcacaaggagcta

SEQ ID NO: 4575 - DNA, 360 bp, Cicer arietinum
gattagcgtggtcgggccgaggttgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcgaggcactt

SEQ ID NO: 4576 - DNA, 168 bp, Cicer arietinum
cccaaaaaagaagaaggaaacctcgattttactttgaaaatgagacctgctgtagccgctcttattttcctcttccttttcttgtttgcagctacaatagaatcgagaaatgatctaaaggagtattggaaaactattatgaaagatgaagagatgccagtgggaatt

SEQ ID NO: 4577 - DNA, 428 bp, Cicer arietinum
gagaaaaagttgatagaaatattgattataagatagagagactaataaagagacaaattcgaagaagaagaagaagggtttcgatgaaaaacacgatgcagagtgaaagcaacaacaataaccagttggtagttcagaattctggaagtttaagcttcagaaggcacttgtctaaagaagatgaatagatgtcaaaatctgctctttcaactttcagagctaaagaagaagacattgaaaagaagaagatggaagtcagagaaaaggttcagcttcagttgggtcgtgttgaagaagaaaccaaacgtcttgctaccattcgtgaggagcttgaagcccttgcagatccaatgaggaaagatgtttcaattgtccgaaagaagattgattcaataaacaaagaattaaaggcacttggtcatacctgc

SEQ ID NO: 4578 - DNA, 229 bp, Cicer arietinum
caattgccttgctccccttgccaaggttcttaatgaccgatttggaatcgtcgagggtcttatgaccactgtccactccatcacagctacccagaagactgttgacggtccatcaagcaaggactggagaggtggaagagctgcttccttcaatattattcccagcagcactggagctgccaaggctgtaggaaaggttcttccagaactgaatggtaaattgaccgga

SEQ ID NO: 4579 - DNA, 423 bp, Cicer arietinum
gacaggataccccgcttccttcaccatccagcataccaaggcacaaagggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagccgtatgtcttttttgcagggaaaaaccttgggaaggaaccaaaggccggcggtgcggcttgccttcaaaggggaaaaacccatcgcaatcggcgtcgttgatcggaaggatgtcgctaccgatgccacgggcaccgtcctccgatatctaatgcgttctggttctgaggtgccgccattagatccgacaaaggtgttgtcagagaaggtgaactctccaaaattccttct

SEQ ID NO: 4580 - DNA, 104 bp, Cicer arietinum
ctgcaaaagattctacccgccgctcaataggaattgcgtttcaaggtgtcccgcaaggctcatccgccttacgaggtccaccaacgacacgtgcctctgggggg

SEQ ID NO: 4581 - DNA, 456 bp, Cicer arietinum
acaaaaagaatgacgatggacctacaattgaaatcgtgttgtagcggatgcagatcaaccaccgatctctacggaagcaattgcaaacacatgactctctgcttaacctgtggcaaaaccatggctgaaaaccgcgctaagtgctatgattgtggagccaccctaactcgcttgattcgagaatataatgttcgtgcaagttctgccaacgataaaaactactttattggaaggtttatgactgggttgcctgatttttcaaagaagaaaagtgctgaaaataaatggtgtctgcagaaggatggattgcagcgtcgagaagttactgatgctttgcgggagaagttcaagaacaggccttggctcttggaggacgaaacaggtcagtcccagtatcagggtcatcttgaaggttcacaatcagctacatattacctgttaatgaaggaaaagaag

SEQ ID NO: 4582 - DNA, 134 bp, Cicer arietinum
gttaaccttaacagcataccctttggctgatgctcagttgacaataaccataatggaccttgttcaacaagctgctaactacaagcagctcaaaaagggtgctaatgaagccactaagacactgaacaggggta

SEQ ID NO: 4583 - DNA, 456 bp, Cicer arietinum
gatttcgagcgggccgcccgggcaggtacaagagaaaagttgtaagatccttgctttaatagttagtgtcaggccaaaaaatcagagtggcattgcttcaaacggagaagtatcaaatgaaaagaaatcgctgaccactattgatgatgttttgataggattggtaaaatggctttgtgagcagctgaagaaaccttctcatcctactcgcggagttccaactgctatcaattgcttagcaactctacttaaggaacctgtagttaggtcttcctttgttcaaacagacggggtcaagttgcttgtgccattgatttgtccagcatccactcaacaatctattcagcttctttatgagacatgtctctgcatatggctcttatcctattatgagcctgctattgaatatttggctacttcaaggacccttccaagactgattgatgttgttaagag

SEQ ID NO: 4584 - DNA, 316 bp, Cicer arietinum
acctatggggccttcatccagattgcaacatgctttggtctattgggggctttatttattggaatccctgtcaaagaaatttctggatggtggcgggtttgtttctgggtatctaacatacctgcagctctacttgctctggctatgttcttctgtgctgagagtccacattggttattcaagcaaggaagaattactgaagcagaagctgagtttgaaaggcttcttggtgtatccgaagcaaaatttgcgatatcacagttatccaaggtagatagaggagacgatactgatagtgtgaagctctctgaattgc

SEQ ID NO: 4585 - DNA, 322 bp, Cicer arietinum; identical to SEQ ID NO: 1541

SEQ ID NO: 4586 - DNA, 248 bp, Cicer arietinum
gattagcgtggtccggccgaggtattcagataatattcagatatccaatctcactttggttaattctccctcctggaatgtccatcctgtttacagcagcaacgttattgttcaaggaatcacaattcttgcgcccgtggactcgccaaatacagatggaatcaaccctgactcttgcacgaacacacgaattgaggactgttatatagtgtcaggggacgattgtgtggctgtgaagagtggttggg

SEQ ID NO: 4587 - DNA, 204 bp, Cicer arietinum
acaccaatgtggcatgctagagaaggggctgcgttattgcgttctggaaaaggagacgaggatgttcttaaaggtggatttgaagaaccactttggatcacatgtgagtaatagtgaggctgatgataattaagaagaataatatatattatgtattttgaaatatattgttaaagcccaaaatcaagtgttagaccatgcaca

SEQ ID NO: 4588 - DNA, 117 bp, Cicer arietinum
actaacatcagtaataaaacacgtcacacaataagagatattgtcatagtcataatcgtaattacagagctcaatactggaagtatgaaatcatgagaaagagcacctctatttctt

SEQ ID NO: 4589 - DNA, 214 bp, Cicer arietinum
gctgaatccatccaaaagaaggcttgcaatggtttgttactcaaggttaaccagatcggcacagtgactgaatctattcgggctgcactggactctaaggctgccggttggggtgtcatggttagtcatcggagtggtgaaactgaggataacttcattgctgatctttctgttggtttggctagtggacagataaagactggtgctccttgca

SEQ ID NO: 4590 - DNA, 238 bp, Cicer arietinum
acccggctccgcatttaacgtcgccacaagcataattggcgctggaatcatgtcaatcccagcgattctaaaggttctcggcgtgattccctcttttgccttgattctcatcgttgccgttttggctgaagtttccgtggactttctcatgcgttttacgcatgccggtgaaacgacgacgtatgctggtgttatgagcgaggcttttggatccgttggagcattaaccgctcaagtt

SEQ ID NO: 4591 - DNA, 200 bp, Cicer arietinum
actgaaagcgatgtttccgtgaaagaagagttaataactctacaagactctacaaccacaccaacttgtgatgaaaccgccattcccgaatcagattcaaaggatttaaactacgaatgtttcaaaaacagtgatggtgtcgcttctctgtttcctgcggatttcaaagacggttcttcagatagcgactcgagcgcaat

SEQ ID NO: 4592 - DNA, 213 bp, Cicer arietinum
tgggtttgtttcggactctgctgttcaatattgacaagaactttgcaattgtcagcatcaagaccaacatcatctgaaacaaaacctatgtttctacatgtgtcacggacaatcttttcatagtcaacattggcttttgttgtgatctcaccaaagaccataaccatgttggtctttgtgcaagtttcacaagtaactttgctgtctggatct

SEQ ID NO: 4593 - DNA, 358 bp, Cicer arietinum
acaaagcttacctggagaccgtggatcggggcgattgcctcgtctactgagcagcgttctggccgccttgggtttttccccttcgaggggttttcccaaggatgcacggtcctagggttgctgctactggcgatcttagggattatggttctcttgcctttgggcatggaaagctgcttgatctatctgtgcaagagaattctaggccggataggaatcagttcccgctgacgggatgacctcttgagagtaatgcgcctttgtgccgatgatatgctggatgaactagatgggagacgctgctggagggaagctctgctaagatcagatgtattgatgtcctttaggacgtgcttca

SEQ ID NO: 4594 - DNA, 439 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatatgactacgagctacaacttggttactggagattgtggactgcgtcagcagatgtagcgatgcgtgagagaattctggtcggtggaaaaagtcgac

SEQ ID NO: 4595 - DNA, 180 bp, Cicer arietinum
acttagggttgtgaacaatgttcttggaggtgtgtcttttgtgatgttggcaaggttgacagggtcacaaggtgttggtagtgaagagaaggtgtcaaaattggaggttggattagatgagaaggtggaagaggctttggagaatagcaaccagactaatccatcaaagtgatagcatca

SEQ ID NO: 4596 - DNA, 301 bp, Cicer arietinum
attttatctgacttaacttgtgacagtgatgggaagataaacaagttcattggtggtgagtcaagcttgccacttcatgaattggaaggacaaaatggtggaggatactatctgggaatgttcttgggcggggcttatgaggaggcgcttggtgggttccacaacctgtttggtggccctagtgttgttagggtgttacagagcgacggtccacacggttttgcggtgacgcgggctgtttctggaccgtcgtgtgcagatgtcctccgagtgatgcagcacgagccgcagctcatgtttg

SEQ ID NO: 4597 - DNA, 364 bp, Cicer arietinum
actgcccagagaacctcttcttctttgcagcctcggctgccgcccggaacacgaccgggcttcgacaatatgtctcactggctaagaccactagacaaaaccgctgggtcgaaatggtatagagcttacctggagaccgtggaatgaggcgactacctcgtccacagagcagcgttctagccgccttggggttttctcctgcgagggttttccccaaggatgcacggttctagggttgcagctactggcgatcttaggggatcatggacttcctgcctcagggtatggaaagctacttgatctatctgtgcaagagaattctaggctggagaggaatagatcccgctgacgggatgacctcttg

SEQ ID NO: 4598 - DNA, 179 bp, Cicer arietinum
acgagcttggtcgccagccagctaacaccaagctatcaagcaacaaaactgttagacgcattcgtgttagaggtggcaatgtgaagtggagagctctcagattggatactggaaatttctcatggggaagtgaagctgtcactcgtaaaacccgtttgctcgatgtggtttacaatgct

SEQ ID NO: 4599 - DNA, 461 bp, Cicer arietinum
acaatggtcatacagggaggcgtctcagtgcaatgattttccttggtcctacttactaccaaaggttgaagcatatggttgatgacaagatccattctcgtggacgaggtcctgttcagattcttacaaggcaacctgctgaggggcgttcacgagatggaggtcttcgatttggagagatggaacgtgattgcatgatagcccatggagctgctcatttcctaaaggaaagattgtttgatcaaagtgatgcatatagggtccatgtgtgcgaacactgtgggttgatagctattgcaaatctgaagaagaattcttttgagtgtaggggctgcaagaacaaaactgacattgttcaggtttacattccttatgcttgtaagctgctcttccaggagctgatggctatggcaatagcaccaagaatgcttactaaagagatcaaatctataaaagatcaa

SEQ ID NO: 4600 - DNA, 439 bp, Cicer arietinum
cgagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatgtcatactctcttcttcttttcattttgttgtggaagtgtgagattgtaagtcaagtgtgtacctcggc

SEQ ID NO: 4601 - DNA, 432 bp, Cicer arietinum
cgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgccccc

SEQ ID NO: 4602 - DNA, 483 bp, Cicer arietinum
  misc_feature (8)..(8): n is a, c, g, or t
accgacgncgcatgctcttcgccgccatggagaacgcgggaattcgattagcgtggtcgcggccgaggttcttctcaaagctatggttctcgatcttcaaggttttcgaacttccgcgctcgaatctcttgacgcggcgttgtctccgcttgcggctggttctttagccgaaggtgaacgaggtgacgcgctttataagagagccgagttgaaactcgcgacgagtgaacgcggacgagttgactcggcgctgaaggatttgactgagtcggttattttgagttctaagaacgcgaaagctcggtctgcgttgggagagtgctatgaaggaaagaaaatggaagaggaagctaagaaggcttataaggaggctcttgagttggagccacatttttctgtgccgctagaagcacttaacagtaataatggaacaaaagtcgaagatctgtcttgaacttcttttggggaagaatgtctgttgga

SEQ ID NO: 4603 - DNA, 421 bp, Cicer arietinum
acccacgggtgaagttacaaacgctgacatgcacacagcgctacacacgcaatgaaacaaagagacaaaaacaaaatataattttaaattaaaaataaaaaaggtatgtcataattaatgcatgaccatgactactaacttggtgaagatcagaaaattttatattcttccccatcaccatctactaatactactattatactactatgttcttcgccttaatttctggtctccaacaacttgaacgagactacatctctttcatcttgttaaccttattccaagcaagctttaattaattcatgcaattcctcaaaaagataaatatatatgataattaggatgcacacttaaatccttcaggtggatttttgccacagtcaatgagaagctgaagagcaatggggataacaaggttgat

SEQ ID NO: 4604 - DNA, 425 bp, Cicer arietinum
gttaggagcgggattttctgcaggccacgcgaccacacaaaactgcggggatgctatcggctccctaacagcagttttcagagaaggaattttggagagttcgccttctctgacaacacctttgtcggatctaatggcggcacctcagaaccagaacgtcttagatatcggaggacgatgccccgggcattcgtagcgacatccttccgatcaacgacgccgattgcgatgggtttttctcctttgaaggcaagccgcaccgtcggcctctgattccttcccgaggtttttccctgccgccacgacatacgactacgagctacaacttggttactggagattgtggactgcgtcagcagatgtagcgatgcgtgagagaattctggtcggtggaaaaagtcgacagtatgcccccgaacccgctg

SEQ ID NO: 4605 - DNA, 326 bp, Cicer arietinum
  misc_feature (18)..(18): n is a, c, g, or t
ggggcccgtggcatcggnagcgacatccttccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattttggtcggtggaaaaattcgacaaattccctccgaacccgctgacgggtgacgggcttgacaaaaacagcgccttttgtgccttgctatgctggatggtgaaggaagaggggtatcctgt

SEQ ID NO: 4606 - DNA, 406 bp, Cicer arietinum
accctaccatcctttagtttgacttcttttacctctccatcggagttagtagtgaatccaacagcaacggttcctttaacgatgttgacacccttatttgcataatatccctcatagaacgcagctatttcagaagtaaaaagtctaggcatacaccaaggttctgggtagaccatggtaacatcaacatcattgagtttcaaaactgcactgatctccagaccaatgtatcctcccccaacaaccacagcttttccattcttctttgctttgattgactcatacaatttgtcagcatcatcaacttccctcaaataaaatatatttttggcatcagctccttctacaccgaaatctgtcaaccttataacagttgagccggtggcgatgaccaaagtctggtagt

SEQ ID NO: 4607 - DNA, 164 bp, Cicer arietinum
acggacttgccgaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagc

SEQ ID NO: 4608 - DNA, 470 bp, Cicer arietinum
tcttctcaaagctatggttctcgatcttcaaggttttcgaacttccgcgctcgaatctcttgacgcggcgttgtctccgcttgcggctggttctttagccgaaggtgaacgaggtgacgcgctttataagagagccgagttgaaactcgcgacgagtgaacgcggacgagttgactcggcgctgaaggatttgactgagtcggttattttgagttctaagaacgcgaaagcttggtctgcgttgggagagtgctatgaaggaaagaaaatggaagaggaagctaagaaggcttataaggaggctcttgagttggagccacatttttctgtgccgctagaagcacttaacagtaataatggaacaaaagtcgaagatctgtcttgaacttcttttggggaagaatgtctgttggaggagaggtgtttcattagctgtgtaaccacattttatctcaatggtcatgactttg

SEQ ID NO: 4609 - DNA, 163 bp, Cicer arietinum
caacactgaacttcacaaaccaaagcaatggctcctaaccatgctttcatctttttggttctattatccttttcaccacaactcttcttcactctttcttctgcacaacaagataatggtcttcttatgaactactacaaagaatcatgtcctcaagctgaag

SEQ ID NO: 4610 - DNA, 222 bp, Cicer arietinum; identical to SEQ ID NO: 4094

SEQ ID NO: 4611 - DNA, 476 bp, Cicer arietinum
atctccagagccgcaacaaacaatgggacgtgtgatccgtgcacagcgtaagggagctggctccgtcttcaagtctcacacacaccaccgcaaaggaccggcacgtttccgcagtctcgacttcggagaacgtaacggttacctcaaaggtgttgtaactgacgttattcacgatccaggtcgcggtgcacctctcgctaaagttactttccgtcacccgttccgttacaagaaacagaacgaactcttcgtcgccgctgaaggtttatacaccggtcaattcatttactgcggtaaaaaagcgactctcgttgttggtaatgttcttcctctccgttctatccctgaaggtgctgttatttgtaatgtcgagcatcatgttggtgaccgtggtgcttttgctagagcctctggtgattacgctattgttatcagtcacaaccctgataatgatacatctaggatcaagcttcctt

SEQ ID NO: 4612 - DNA, 471 bp, Cicer arietinum
acaactgggaccccaaagggtgccgttttgacccatcaaaactttattgcaaatgttgctggggccactatgaatgaatctttcaacccttctgatgtttatatatcctatcttcctttggcacacatttatgagcgagcaaatcaagtcatgacagtatattttggcattgcagtaggattctatcagggggataatttgaaattaattgatgacctagcagttctaagacctactatcttcagtagtgttcctcgtctatataatagaatatatgctggtattattaatgctgtcaaaacatctggtggtctgaaggagaggctattcaatgctgcctacaatgctaaaaggcaggcattattgcatggcaagaacccatctccaatgtgggacagattagttttcaacaagataaaggaaaaacttggaggacgggttcgtcttatggtatcaggtgcctcaccttta

SEQ ID NO: 4613 - DNA, 289 bp, Cicer arietinum
actgatcatttccgagaacggagagtgcatcagggacagttctatttgaggttattaggtcatgtgttaataaaacttcttttgccatgtcagccgaagaaattactacagttgttacttgccctaatttaagtgtcattattgggccatgaatgtcagcaagatttgctaaggaatggtggggtttgttgccaagttttaaaagatttcctattatgggaagtggggtgggtcccggtggaagcttagagtgattttttttattggattttgttgtaggaatgagaaa

SEQ ID NO: 4614 - DNA, 318 bp, Cicer arietinum
actacactgatcacatcatcaaaggccttgctttggctatgctccttgctggaaccgactcatctgctgtaactttagagtggtcaatgtctaatttgttgaaccatccagaggtattgaagaaggtaagagatgaattggatactcatgtaggacaagatcgtttggtagatgaatcagaccttccaaaacttacttacctaaaaaatgtcatctatgaaacgcttcggttgtatggtccagcccctttattaataccacactcaacttcagatgattgcattattggaggatataaaataccacgagacaccatag

SEQ ID NO: 4615 - DNA, 144 bp, Cicer arietinum
acaaggagttaacgaccaagccaggcctacaatgctatttcatgctaagaaacttcccaacaccgatccatgcaatgctaaagccgtaaagatgagtcattactgatcttgacttgtcgtgaaatctgagggctggataataag

SEQ ID NO: 4616 - DNA, 337 bp, Cicer arietinum
gagaagatctctttcccaggctaaattgattgcgggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatgtcatactctcttcttcttttcattttgttgtggaagtgtgggattgtaagtcaagtgtgtacctgcc

SEQ ID NO: 4617 - DNA, 404 bp, Cicer arietinum
actgtaagagttactttcctctagccttttccaagtcagggagatataacattccttcatcatcactgctttcatcatcttcaccagcaaatcgtccatcgtcgtcagatatcaactcataatctgactcttcatcttcatcacaccatttattccaatcaaccttcaggtatggtgcaggtttctcttcagacttcagtagccttttccaccaacctctttgtcctttctggattgagcatagtatgtttcttgagctagttttagttttacaacccccaggttcaattgatccataaagttccaaactaaagctgtaagattcatgttgaaccctagaagcagagaaactaaacaaaccatgaggctcacacttcacagtaacatccttggcatcaggtaga

SEQ ID NO: 4618 - DNA, 243 bp, Cicer arietinum
actaggtttaatccctattgcgacactgtcatcagtagggtaaaactaacctgtctcacgacggtctaaacccagctcacgttccctattggtgggtgaacaatccaacacttggtgaattctgcttcacaatgataggaagagccgacatctaaggatcaaaaagcagcgtcgctatgaacgcttggctgccacaagcgcagtatccctgtggtttcttttctgacacctctagcttcaaat

SEQ ID NO: 4619 - DNA, 405 bp, Cicer arietinum; identical to SEQ ID NO: 2386

SEQ ID NO: 4620 - DNA, 473 bp, Cicer arietinum
cgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgcc

SEQ ID NO: 4621 - DNA, 477 bp, Cicer arietinum
cgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgcctttt

SEQ ID NO: 4622 - DNA, 109 bp, Cicer arietinum
atagaaggttcactcagatcacaaaagttaacagcaaacacattatatgcagcttatcttgtaatgaaagtctctgatggagcgtatggacttgactcgaggtccttca

SEQ ID NO: 4623 - DNA, 424 bp, Cicer arietinum
gggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaactcgctgacgggtgacgggctcgagaaaatacagcgccttttgtgccttggta

SEQ ID NO: 4624 - DNA, 252 bp, Cicer arietinum
tcaatacttgaacgccctaacattactgggtcctccgctgctttgtgttatcgcgggacctaacatacactatttttctttcttctaccagaacctttgaaggtgggttcagaatgcggagacaatggggtggactacatcaaatccttgttcaccgaggagtttttggatggtcaatttctgcaacttcagcagctacaagatgagaataaccctgagtttgttgttgaagtggtttctcttttctttgaa

SEQ ID NO: 4625 - DNA, 320 bp, Cicer arietinum
cattttctacaccacctctagcaagaagaaacgcattgagaaatagacagtgacagagtgatagagagagagagatttcgcaatttcacaaaccctaatttcaaagagatcggcgatggcttcttctaaggatcgtgaaaacttcgtctacatcgccaagctcgccgagcaagctgagcgatacgaagagatggtggattcaatgaagagtgttgcaaatctagatgttgaactgactgttgaagaaaggaatttgctttctgttggttataagaatgtgattggtgctcgcagagcatcgtggaggattctgtcttcca

SEQ ID NO: 4626 - DNA, 384 bp, Cicer arietinum
gagaggaaaataacggtagcagaagtcgcagggaagaaagaaaggattgggttcacttacctttttccttttcctcttcttcttcttcttcatcttcttcatcatcatcttcctttcttctatcaatcacaatccattatttaattcacaattcaacctacatcttcagatttcttctcctttctctccatccaccgtttctcccccctaaaataataaacaaaaaaagattcttattaattttattattattattttttcttgtttgactccgttgtctgaatcgtttcttctagaatagggttcaggagccacagctatgcagagccaaattgtgtgtaatggttgtaggagcatgctgctttaccctagagggccaaccaa

SEQ ID NO: 4627 - DNA, 358 bp, Cicer arietinum
acctttcaaatgttctaatagaaagccttgacattttatattcctaaaatagttaacaattctaactccaaattacaatactcatttttataaaagctgcatgattagagaatctgaatagaatccttgaatgcaggcgaacaaacaattctagtcagcctcccaaaacatctgctgctgccaacatgactttctctcatcgagtaggaatcatgccggttttcctagcataggcaaagataccaccggcttcaatgacaggaccggcatctccaataggcttcaacttatactcctttccggttgtgtgattgatcaatcgattctcctcgagctcaaccgtcactacatctcccgt

SEQ ID NO: 4628 - DNA, 429 bp, Cicer arietinum
gatttcgagcgggccgcccgggcaggtccaacgagtgccgtgattgctttagggagtgaaatgtctggtggaatcgaagatgtgaggactgaggacattgtagccatcaattcagaatcaggagtcaggatcaaaactgctgttggaagaggaggttatgtcaaggacatatatgttagaagaatgactatgaaaattatgaaatgggcattttggatgacaggagattgtggttctcatgctgataacaactacgatcctaatgcacttcctgtggttcagaacgttaattatcgcgacatggttgctgataatgtgactatggcagcaaaattagagggtatatctaatgtaccatttactggaatctgcatatccaatgtaaccattggactagcaaagaaggctaaaaaagttccatggaattgt

SEQ ID NO: 4629 - DNA, 438 bp, Cicer arietinum
gggaattcgatttctagcggccgcccgggcaggtaagcattttgaccttaaggttaaggactctaaaacccttctctttggtgagaagaccgttactgtttttggaactaggaaccctgaggagattccatggggtgaggttggagctgattatgttgttgagtcaactggtgttttcactgacaaggataaagctgctgctcacttgaagggtggtgccaagaaggttgtcatttcatccccaagcaaagatgcacccatgtttgttgttggtgttaacgaaaatgaatacaagccagagcttaacattgtttccaatgctagctgcacaaccaattgccttgctccccttgccaaggttcttaatgaccgatttggaatcgtcgagggtcttatgaccactgtccactccatcacagctacccagaagactgttga

SEQ ID NO: 4630 - DNA, 406 bp, Cicer arietinum
actgtatccccattcgttgtcataccaagaaacaacctttacaaagttatcattcaaagcaattcctgccttggcatcaaatatactagacctgctatcaccaacaaagtcagtagataccacatcatcttcagtgtaacccaaaattcccttcaacttgccctctgattcctccttgatagcagccttgatttgttcataggttgctttcttctcaagccttacagtgaggtcaacaactgaaacatcgacggtagggactcggaaagacattccggtcaatttaccattcagttctggaagaacctttcctacagccttggcagctccagtgctgctgggaataatattgaaggaagcagctcttccacctctccagtccttgcttgatggaccgtcaacagtc

SEQ ID NO: 4631 - DNA, 403 bp, Cicer arietinum
actggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagtccgttcccttggctgtggtttcgctggatagtagacagggacagtg

SEQ ID NO: 4632 - DNA, 201 bp, Cicer arietinum
acaaggagctaatgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgggttgtggtgtgttgtcgcgtttactcgacgttgatgcggcg

SEQ ID NO: 4633 - DNA, 343 bp, Cicer arietinum
acactgtaggcgtgcaacttgaaggtgaaccaaacacaccactacaacaatattctggttttccaaacgcaccacacgcgctctgacacgcgtcaccatcttccacttttaactccgaaggacacctccgattaatatcctctccacaacccgtcatatcacacatacctgaaccgccgttagcttctacaatcatcggaaggttgtaaccatcgacgaggctaacatcatagtaatccggcgaaccaattcccaaagtgaattccgctagcgttgcaggtggtgtagcgccgttgccgttgcagttaatttccccagaaccgcagtcaccggttgagcaagt

SEQ ID NO: 4634 - DNA, 147 bp, Cicer arietinum
cgggcggatgaccttgtcaggtggggagtttggctggggcggcacatctgttaaaagataacgcaggtgtcctaagatgagctcaacgagaacagaaatctcgtgtggaacaaaagggtaaaagctcgtttgattctgatttccagt

SEQ ID NO: 4635 - DNA, 297 bp, Cicer arietinum
tttacgctctaaaggaccacatgtctaacatagaggctgacaaagaaatcggacagatggatttggatgcgtctgaggggtcagttaacatgccatcgtcccaaaagcaggaggaagctttaaagaaaaaatatggaggaattgtgcccaaaaagccaccacttatttctaaggaccatgagcgtgcttactttgattctgccgattgggcattgggaaagcaaggcggtgccaagccaaagggaccacttgaggctcttcggcctaaactacagccaacacagcagcaaacacggt

SEQ ID NO: 4636 - DNA, 182 bp, Cicer arietinum
acgagcttgttcgtcagccagcaaacactaaattatcaagcaacaagacagtcaggaggatccgtgttcgagggggtaatgtgaagtggagagctcttagattggatactggtaacttctcatggggtagtgaagcagtaactcgcaagactcgtcttctggatgtggtttacaatgcctca

SEQ ID NO: 4637 - DNA, 285 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggag

SEQ ID NO: 4638 - DNA, 404 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctcc

SEQ ID NO: 4639 - DNA, 394 bp, Cicer arietinum
gatttcaggcccatttgaaaagttaattcgagggtctcagattcgggaactgagtggtcctgagtactcaaggaaggtaatggagaattgtgtggcacacttgaaatctattggaacttatggcgatgaagaagttgaagctatgcaaaaatttgctgaagccttcaagaatgtgaattttccacctggtgcctctgttttttataggcaatcacctgatggagtattagggcttagtttctctaaagatgcaagtatcccagaaaaggaggatgcagttattgagaacaaggcagtttcatcggcagtgttggagactatgattggtgaacatgctgtttctcctgatttaaagcgctgtttggctgcaagattacctgctttgttcgaccaa

SEQ ID NO: 4640 - DNA, 338 bp, Cicer arietinum
acagtgtgttccccgtggttcttagatgcaaagttctcatggttagatttttggacatgaaaattgtatcatgttgagtgtttggttttcctagaacaaggaaaaggaatagtttgctcggctcggctcggctaagctcacggctcagcagaatcccaaactcaaaatgatgaattttgtaggcttgattggataggaagagaatttataagcctcactcaattatttgtttagagattggaagaagaaaaatgtaaaatttctgttttgtgcattgcttctctcatccatttacctgggttagagtatgtgtgttttttcatttctggatttcaagg

SEQ ID NO: 4641 - DNA, 184 bp, Cicer arietinum
acataaaatcattactactatattggtagggtcaaccaaaccaaccaaacagtccctaaaaacactgaccccacatctttgaacctacgttgacccaacaattcaaaacgacacccaaatccaatccactattgtcgtatgccgtttgcttcatcctcaactcataatcatcataacttaaccg

SEQ ID NO: 4642 - DNA, 265 bp, Cicer arietinum
acggacaatttgaccccgactgtttaattaaaacgaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggc

SEQ ID NO: 4643 - DNA, 102 bp, Cicer arietinum
caatttacattacacagatgagttcaacaatcagagcttgggagtgttgcagctagcgttggtgttgtggaagccttgaaggaccaaggcatatgtagatgg

SEQ ID NO: 4644 - DNA, 390 bp, Cicer arietinum
gcttcttctatacctggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaat

SEQ ID NO: 4645 - DNA, 473 bp, Cicer arietinum
acaagggaccaactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcacacctcccacattgctgttaagttcgctgagcttctcaccaagatcgac

SEQ ID NO: 4646 - DNA, 165 bp, Cicer arietinum
actatttattaacagcagaacagactgctttacaactgtcaaaataaataaaaagctaaaatacataacagcttaaagaaattagagaaaaaaaaacacaataacaatcttatcaccatataatagcaaaattaacggcttttctttcctgaagacaaaacgcgg

SEQ ID NO: 4647 - DNA, 325 bp, Cicer arietinum
agatattgcttcccttatttcatgcaacaataataatcctgaacaatcccctcaaatgttagatcgaattctttttcttctttcttcccactctctcctcaaatgttctctccttcaagatcaacatattcttggatcctatcaccgactatacaccatcactcctgttgccaaattctttgcttctaattccgatggcgtttcattagttcccttgttggcattgcatcatcatcaaatcttcttagatagctggtctcagcttaaagattctattcgggaagggggtattcctttcaacagggttcatggcacacacgccttt

SEQ ID NO: 4648 - DNA, 268 bp, Cicer arietinum; identical to SEQ ID NO: 2439

SEQ ID NO: 4649 - DNA, 404 bp, Cicer arietinum
acttcaaataagatgaaggaaagcagattcaattcaagtattcggactgtttaaagtatatgacaggagaactaaacaacctgaaatacttaaatttgaaaatcaatatttttttgttgaaaaaacagagatggcacaataacactctctaactatccttaggctcctcagcagctgtctcaaaagtctctcctggaacaagctctggaacatcatcatcattctcttcttgtgcagcggttgaaccagcccctgcttcaggaggctgcttctggaactgctcggctaatttcttcaggttttccaaattatctggtcctaattggtgaataatgctagggagtatatcctgcaacttctttgtttgaggagcaccactaacaacccatgtattagcagcaatg

SEQ ID NO: 4650 - DNA, 272 bp, Cicer arietinum
atttcgtggtccccgtgatactcatttggatagtcttgttggacaagctttgtttggagatggagctgctgcattgattgttggatctgatccaattcctgaaattgagaaaccaatatttgagatggtttggactgcacaaacaattgctccagatagtgaaggtgctattgatggtcaccttcgtgaagcaggactcacatttcaccttcttattatatgttcctgggattgtctcaaagaacattgatgaagctttgattgaagctttc

SEQ ID NO: 4651 - DNA, 363 bp, Cicer arietinum
actccaattccacctcagtgtcaaagcgagctttgcaggtgaaagattttccggtatcagttgtgacagtgacatcttggccaggctttatctcgctgattttatctggaaggtcaattgtataacgttcgcggccagtcaatcccaaggtgtcagcatcctcgccggatttgaagcaaaggggaataatacccattcctaccaaattactgcgatgaattctctcaaaacttttggctatcacagctttgactcccaataacatgggacccttggcggcccaatccctggaacttccactaccatattcagctccggccaggacaatggtgtcgtgccctgcagccttgtatctctctgctg

SEQ ID NO: 4652 - DNA, 134 bp, Cicer arietinum
acttgcattgtccttagcaccaaaggatgaacatgaagctcaggttcaatttgctctcgagagggggattcctgctatatctgctgtaatgggcacaaagaggcttcccttccctgggagagtatttgatgtag

SEQ ID NO: 4653 - DNA, 316 bp, Cicer arietinum
acattattgtcgctcaggtctaaccagactaaatggaaatattggccaaaaatggctaattagctaatgagccttgcagaatggtgacagcagccctaacaagccatcgccgtgccatgtcaaatttactttgatggctctcggctctcagctgtaggaagagcgttcttcttggcctcattctccttgaccttggcccaagcataaacgatactccgagacgaaaccgatgaagatggctgaaacacttccaacggtaacgggagcagcgaagaagacaataccagagacggcgatgggcagcttgttgagagca

SEQ ID NO: 4654 - DNA, 429 bp, Cicer arietinum
acggaagctgttaccgatgatgggcgagcagtagtccgagcatgtgtatgctgcatatatgcatggtaaattccacgctgcagaaaagcacgacggtgctgcagccaggactcgtaagactctgagagaagcgagttcaccatcataaattggacagtttcttctgtccccaatgtaggtggggtgccagatggagaagaaggtctgagatctgatgtagaagaggttatatatgctgatacagccctggccatcgatcgacgctgcaaggggcttccttgatcaaggagatggcgtgccatttggaacataaatgggaggaaccgagaattactatcccgtcccccacctcggcaatccgcactgaacgatgctcctgttgcaaaccgagctaacatcagaacaatgtcgtaagtcagcaggcggagc

SEQ ID NO: 4655 - DNA, 475 bp, Cicer arietinum
attggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcacacctcccacattgctgttaagttcgctgagcttctcaccaagatcgacaggcgatctggtaaggaacttgagaaggagcctaagtttttgaagaatggtgatgctggtcttgttaagatgattccaaccaagcctatggttgtggaaactttctccg

SEQ ID NO: 4656 - DNA, 354 bp, Cicer arietinum
acggacaagggcaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtggg

SEQ ID NO: 4657 - DNA, 433 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccaaaattccttctctgaaaactgc

SEQ ID NO: 4658 - DNA, 275 bp, Cicer arietinum
acaactcatctttttcagttgtggaatagaaacagtgcttcaacttaacaaccttaggatgttcaaccatgcgcataacctggagttccctattcttatacctcttgtcttgcagcaccttttttatggcaaccgcttcaccagtttcaaggcacttggcctgaaaaacaacgccaaaagagccagttccgactacgcgttcagccatgtatgagattgtccgctttggttgtccgtctcgaccaccaatagtagttgtaataatttgacctgtt

SEQ ID NO: 4659 - DNA, 187 bp, Cicer arietinum
gcggacgcccgggcaggtacacagctcacaaaagagacttggtggagcttatgagaaacctcccgggacctttgttcctcttctctatacacaggtcctttatttctctcctcccgtctcccgcgggattaacttcaatacttaaaccccttactgaccctcaagctcagcaagaatcttctcaccc

SEQ ID NO: 4660 - DNA, 180 bp, Cicer arietinum
actgatcatggttgagaacggagaaggcatcagggacagttctatttgaggttattaggtcatgtgttaataaaacttcttttgccatgtcagccgaagaaattactacagttgttacttgccctaatttaagtgtcattattgggccatgaatgtcagcaagatttgctaaggaatggt

SEQ ID NO: 4661 - DNA, 405 bp, Cicer arietinum
actaataagatacatagacccttaaaaagctaggccaaacttaccctaataattaagtttcgtggcaatacaaaaaaaaggagatatagaacatttaagtgcacatacgagaaaaatatgtaagtgcatatttgattttacacgaaaatagcaaaatcatgatgaatcattataattttgcaataactataaagtatagcttctacaaaatcacaataactcgccacgattttgttaatccaaacgaaaaaccaaatatacaaaaattacaaattacatccaaatactaaaagcagatccaagaatcattacaaacacaatcaatttgtgaatggatagttggatggaagatgaaggaggaggagcatcacacaaattatatccataccaagtgtcactagggat

SEQ ID NO: 4662 - DNA, 281 bp, Cicer arietinum
accgtctcttcagccccaaagaaaggcatgacggcctgtcttttgtgccgccccataatcacgctactgtaaactccaggactttcgccctgtatctcataaatggtcgtttcggctgcctatgtgccatcctcaaatactgcccatgcatcgttccttggatgtttggcagcatcctcctcaacaaaagtattccgtaaccacacgagtcatttacagatcgtcgtcggaaagctcaccaggcagaggcatggcggcggcctcgtccatctccttgcggt

SEQ ID NO: 4663 - DNA, 393 bp, Cicer arietinum
actcgttaggaaattgcaaagcacatatccagttttctttttgactaatggaggttgtgaaatctatgaagatttgagaagaaactccttggaggaagccctgaaactctgtttggagaacgggttggaaggaattgtctctgagattaaagggatatttagaaatcctggagcagttaccaagatcaaggagtcaaatctttctcttttaacatatggcaaattaaacaatgttccagaagcggtttacatgcagcacctaatgggaatcgatggggtgatagtagattttgtacaagaaataacagaggccgttgcggatatgatgaagccagcaaagattggagaggaagagggtttgaatgaagggattgggaaggtgcaagtgaactc

SEQ ID NO: 4664 - DNA, 375 bp, Cicer arietinum
agatataattactccacccacatttgcaataaaattttgaacataactaaactagtaggaatataaaattaaaatgcaaacaatagttgccattgttttgcctaaactaaaagtagctagcaacaataatatccatagttgagataatgaaaacgtgttgagtattttgaacataacaatacctaaaataataataaaattttagcgtcgttgagtctttccattggatcgctttccagaataaatgtgcttaggtttgagattaggtataactctatcagcttctccgcgacgtgcttccttgtttctcttcttacaagatttccttgcaagcttgattgccttaatcttttgagcagaatctcttaaaccttc

SEQ ID NO: 4665 - DNA, 423 bp, Cicer arietinum
  misc_feature (232)..(232): n is a, c, g, or t
actttggcgagcagttgtcaggatttgcctttactgctaatgggtgggtgcaatcctatggatctcgttgcgtcaagcccccaatcatctacggtgatgtgagccgcccaaagccaatgactgtcttctggtcatctcttgctcagagctttaccaagcgtccaatgaagggaatgcttactggccctgtcaccattctcaactggtccttcgttagagttgaccagcctcnatccgaaacctgctatcaaattgctttggctatcaaggatgaagtagaagaccttgagaagggtggtattggtgttatccaaattgatgaggctgccttgagagaggggctaccactaaggaagtcagagcatgctcactacttggactgggctgttcactccttcagaatcaccaatgttggtgttcagg

SEQ ID NO: 4666 - DNA, 426 bp, Cicer arietinum
actatccttatcagtcatggctttctttgaatagatactcctgtatgtaaatgaaatgtttgaaatcatagcacttatgaagccgagccaattgaatgagagctcagtcaacgacgccaatgacacaccaataacaacgggagcaagtgagagccaaagagtgataggaattgattgtccaagtatgaattgtgaagcagcagcattaaagaatggctcaagagctttaacggtatgtgtgaaagaaacagcaactgcagcaaatgagacattgctggtcacatggcctaatgcatgacacacagctacaggtatgagcaacttcagcaggttcgcatctataggagcgcgcttaggaaggcccacagtccagctcaccaaacaatacaccacacccacgaataaatggataaccgacacaaagta

SEQ ID NO: 4667 - DNA, 261 bp, Cicer arietinum
actaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaggcaacgtcgctatgaacgcttggctgccacaagccagttatccctgtggtaacttttctgacacctctagcttcaaattccgaaggactaaaggat

SEQ ID NO: 4668 - DNA, 426 bp, Cicer arietinum
tgactctcttaacgtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacattgtcaggtggggagtttggctggggcggcacatctgttaaaagataacgcaggtgtcctaagatgagctcaacgagaacagaaat

SEQ ID NO: 4669 - DNA, 403 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctc

SEQ ID NO: 4670 - DNA, 378 bp, Cicer arietinum
gccaatccaagtggatgtaatttgaaccaattggcgccggtaacttttatctcactttcatggtcataatttttaacaccttcgccacaccaacgatacttcatcactcatgcacagtccacgccagcttgatgttcttttctcattcaagtcaccaagaggatagtagcagtcctaagacggcggacggccaaccatttggcaccggcccgatgtatcatgcagcccctttttgcctaatgaacaccaaagcaatgaaccgagtcctcagagttccttgcctttcccacgcaaagcctaacctagcaatggaaattgcatttatttcttcttctggctctactcctgctccttgagcaccttcttgacgatcttctg

SEQ ID NO: 4671 - DNA, 269 bp, Cicer arietinum
acaagagatcaaggctatctagaaacaggaggactgtgaaccgtgcttatggtggagttttatctggaggtgctgtcagagaaagaatcattcgagctttcttggttgaagagcagaagattgtgaaaaaggtcttgaagatccaaaagacaaaggagaaacaagcttcaaaggcttaagtttcaagaaaagagataaagatctttttggagggattttaggtttgagtcattatagtaaaaaacaaatttattagaactgttgttccc

SEQ ID NO: 4672 - DNA, 476 bp, Cicer arietinum
aagcaatagccatccttgcaggccaaacagctgaagttgcaatgtttgcttttgagtatggaaaaaatctgggtttggcatttcaattgatagatgatgtgcttgatttcacaggcacatcagcttcccttggaaagggttctttatcagacatccgccatggaattattacagctccaatattgtttgcgatggaggagttccctcaattgcgagaaattgttgaagaaggatttgaaaaccccgacaatgttaatattgctttggagtatcttgggaagagccgaggtctacaaaagacaaaggagcttgcggtgaagcatgctaaccttgcagcagaagcaattgattccttacctgagagtgacgatgaagaagtaagaaaatcaaggaaagcccttgtagatcttactcatatagtcattacaagaacaaaatgacaggaaggcttcttttcccagtttttgttttggtag

SEQ ID NO: 4673 - DNA, 295 bp, Cicer arietinum
agatattgcttcccttatttcatgcaacaataataatcctgaacaatcccctcaaatgttagatcgaattctttttcttctttcttcccactctctcctcaaatgttctctccttcaagatcaacatattcttggatcctatcaccgactatacaccatcactcctgttgccaaattctttgcttctaattccgatggcgtttcattagttcccttgttggcattgcatcatcatcaaatcttcttagatagctggtctcagcttaaagattctattcgggaagggggtattcct

SEQ ID NO: 4674 - DNA, 406 bp, Cicer arietinum
acaaacccttgcagttaaaaaaaaaaactgagcgaagatgatgcacatgaccttctactggagcaaaaaagtgactctcctaatagattcatggaaaactgattcatggacgagttacatactgagtctactcgcttgcctaatcgtttccattttctatcagcttctcgaaaaccgccgtattcgcctcaaactattcgcctccggaaagcagtttccggccgagatccagactcctcttattcaacggaagcttgtcggaagtagagctaaattaggcgtgaaactcgccggagcagttctgttcggtgtgagctcggcgatcgggtatttcttgatgctgtctgttatgtcgtttaacggtggagtgtttattgctattgttgttggtcttgctattggttac

SEQ ID NO: 4675 - DNA, 302 bp, Cicer arietinum
gctaaatgatttcattcagaacacagcactttttggtgcattgctattttttgtaggaatgaagaactcaattcccagaaaacagttcaggaagaagaccccaaaaacaaaaacaggatagaaattagaaagatatgtatctgtttccttaaaataggttgtcaaattgatgggttgctatgttttggaatagttagttaaaactttttaatattattgtttatgttcattggaacataatttgattatggatgtggttgagatttctgttacatttgtgttgtacttccggctaagaatag

SEQ ID NO: 4676 - DNA, 172 bp, Cicer arietinum
actttctctatggcttgggtcacgtttagttgtcgttgtctcttcaccttctttagttcaagaatgctttaataaaaacgatattgttttagcaaaccgaccacagttgttagctggaaaatacatcttttacaactttaccaccttaggttcctcttcttacggagaccat

SEQ ID NO: 4677 - DNA, 160 bp, Cicer arietinum
acctccagcctcctataccttggcgcagtttatttgccgcagttcttgcaagagcagctctggccacaggagcaagagctaggaccgccgcagttacaagtagatccacaatcgcaagccatgatgacagacgtaaagttatagagttgtatgtgacgag

SEQ ID NO: 4678 - DNA, 449 bp, Cicer arietinum
  misc_feature (45)..(45): n is a, c, g, or t
acggacaaggtgaatccgactgtttaattaaaacaaagcattgcngatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatc

SEQ ID NO: 4679 - DNA, 268 bp, Cicer arietinum
accagaggccattcatgaagggcaagctttacatccactttacagtggagttccctgagactcttagtcttgaccaggtgaagggtttggaagctgttttgccagctaaaccttcatcgcagttgacagatatggagctggacgagtgtgaggaaactacacttcatgatgtcaatatggaagaggagacgaggaggaagcagcatcagcaacagcaagaggcatatgatgaggacgatgatatgcctggtggggcacagagggtacc

SEQ ID NO: 4680 - DNA, 357 bp, Cicer arietinum
acaccaatggcttgggttgtggtgaataaagtgttgagcaggttaaagaagccagtgttttttctagatgtcacaacactctcacaatacagaaaagatgcacaccctgaaggttatagtggtgttatgtcaactgattgtagtcattggtgtcttccaggacttcctgatacttggaatgtgcttcttcatgcttctctttttgcttcaaattgattcaatatcttcttaattgtaaactatattatatgtttcttactccttttcatcttaaatatagcagagaagttgatcaactaaagctgatgtatttttacatcaatttttttgacaaaattttctcttgtatttatgatg

SEQ ID NO: 4681 - DNA, 293 bp, Cicer arietinum
acaaattcattacaacaacaaatgagtcagagggaataatgtttggagttatgtgtataaatctaagatcaaggtatcttcatgaacaccgtttaaggccatcaacaaataagcttctgctgaaacttctttaaaaggctatccgtgcaatggtttttctagcttcatcaatttcaggacattcctcttcatctgactctaccaataactaattaaatcaacatatccgatatcaacagatcgcaataaagatatgggctactacacaaggaataagaggcaagttcattcca

SEQ ID NO: 4682 - DNA, 390 bp, Cicer arietinum
acaacgtatcctcatggaacttttgaatcagatggatggtttcgatcagacagtgaatgttaaggtcataatggcaaccaatcgggcagacactttggatcctgccctcttgcgtcctggaaggcttgatcgcaaaattgagttccctttgcctgatagacggcaaaagaggcttgtatttcaggtttgcacagccaaaatgaacttgagtgatgaggtggacctggaggattatgtttcccgtcctgacaaaattagtgctgctgagatatctgctatttgtcaagaagcaggaatgcatgctgttcgtaagaatagatatgtcatactgccgaaggacttcgagaagggttacaggacaaatgtgaagaagcctgatacggactttga

SEQ ID NO: 4683 - DNA, 296 bp, Cicer arietinum
actggatgtggagcattaacagcattcactgtgctttatttgtggacaatatttggcaataaacgtgcagtggtagttgttcctgaaggatgtgttatgcaacctttagatgttgagtataagaaagtgaaaattgttgtagataataataaaaccattggagatggtaataagtaggtattcttgatataattatcaactatatggaattggattccatgcagttactgcgtggattcggtaattgatttggactgttcgatctgaaatggacgggcgagatttagtacctgccc

SEQ ID NO: 4684 - DNA, 271 bp, Cicer arietinum
caggtacgggagatgtaccgacggttgagctcgaggagaatcgattgatcaatcacacaaccggaaaggagtataagttgaagcctattggagatgccggtcctgtcattggagccggtggtatctttgcctatgctaggaaaaccggcatgattcctactcgatgagagaaagtcatgttggcagcggcagatgttttgggaggctgactagaattgtttgttcgcctgcattcaaggattctattcagattctctaatcatgcggcttt

SEQ ID NO: 4685 - DNA, 402 bp, Cicer arietinum
acccttttactatattctgcaccgtgcacatacacaaacaaatcagaaaaaccattcacttgtaaaattcaaagtccgtatcaggcttcttcacatttgtcctgtaacccttctcgaagtccttcggcagtatgacatatctattcttacgaacagcatgcattcctgcttcttgacaaatagcagatatctcagcagcactaattttgtcaggacgggaaacataatcctccaggtccacctcatcactcaagttcattttggctgtgcaaacctgaaatacaagcctcttttgccgtctatcaggcaaagggaactcaattttgcgatcaagccttccaggacgcaagagggcaggatccaaagtgtctgcccgattggttgccattatgaccttaacat

SEQ ID NO: 4686 - DNA, 383 bp, Cicer arietinum
ctttgttttacctaatggcggcacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 4687 - DNA, 250 bp, Cicer arietinum
ttcaattgttccctctcttcgattaagaagaacaacgatatggttaagccgaaacaacagaagaagccaccccagaagaagcaaccaaacccacaaatcaagaaacagggaaaacaggatgatagttctcaatttcgaactcagttggatgctcttggccttcgcattgtcgaagtgacagctgacggtaattgtttcttcagatcccttgctgatcagttggagggtaatgaggaggggcatcgaaagt

SEQ ID NO: 4688 - DNA, 188 bp, Cicer arietinum
acattagtgatgggcttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattgg

SEQ ID NO: 4689 - DNA, 174 bp, Cicer arietinum
gcgggattttctccgggctactcgggcacacaatactgcggggacgccatcggctccctaacagcagttttcagagaaggaattttggagagttcaccttctccgacaacacctttgtcggatctaatggcgggacctcagaaccagaacgccttatatatcggaggacggtgc

SEQ ID NO: 4690 - DNA, 314 bp, Cicer arietinum
actagcgacgaggttttggacagcgaggaacaagtgaggatcacaaatcagatcaaagctcaattcgatgctttaaaacctaaacgacccattaaacccaacagaagcgaacctgaaactcaaaaccccgttgactcaacactctcttcacacaacataccagagcttcaaaaacttcaatctcttcaatctattaattctctcgctatactttcctcagagaatttggtggatccgcaagatgagtttgtggagactcactattacaaggagttgttgtccattgataaacagcatcatgcgacgggaagtgg

SEQ ID NO: 4691 - DNA, 193 bp, Cicer arietinum
ttctctcaagtggaatgtatcctttccggcaaatttagacatatacttgttgcaagcaatcctagcagcttcgagtgcctcactagaaacattttccttctcccaactaaccagatgaacacagaagggaaactcatcaactcccttcttcttcataccgacatcataaattctgatcttgggatcaggaaca

SEQ ID NO: 4692 - DNA, 392 bp, Cicer arietinum
acgacactgttcatggtcaatggaagcattttgaccttaaggttaaggactctaaaacccttctctttggtgagaagaccgttactgtttttggaactaggaaccctgaggagattccatggggtgaggttggagctgattatgttgttgagtcaactggtgttttcactgacaaggataaagctgctgctcacttgaagggtggtgccaagaaggttgtcatttcagccccaagcaaagatgcacccatgtttgttgttggtgttaacgaaaatgaatacaagccagagcttaacattgtttccaatgctagctgcacaaccaattgccttgctccccttgccaaggttcttaatgaccgatttggaatcgtcgagggtcttatgaccact

SEQ ID NO: 4693 - DNA, 429 bp, Cicer arietinum
acaggcctttgcacaactattacgagctccacaagatgatgcccaagcggttattagagatcggttccctgttcctagattggtagtgtgtgatcaacatggttcccaggctagatttttattagcaaagctgaatccctcagcaacatataataatgcgcacgagatggctgctggttctgatgtaatctttactgatgatgttagtcttcaagttttctttgagcatctgcaaaggctggctgtccaatcttgagggcagataataggagagattgacagtttatggattctagactttggtttgggaattcaccaatgatgtgtgtcctgcattatgctgttgcattcagttatttttcctttctttcctttgttcttaaccaagagaagatctgagcctgcgtgaattgaagaataagggaagca

SEQ ID NO: 4694 - DNA, 428 bp, Cicer arietinum
acatgtggttaacttctggaaccaaaggatcatcaggatttgggtccgtcaacagggaacaaatcgggagcaacaccttggaaatggtcagagcagggctccactgctcctttaatatatcaaggcaaatgcttccattgctattgatgtttgggtgaaatacctttgtcctgaatgcaaccttgggtggcttaaagggataatctggagggaaatgaatagtgactaggaaaacacctccagtataaggactgtctggaggacccataattgtcgcttgccaatgaaacatatcttcagcaacaggaccagcgctgcatgaagttggaggatccttctgcaaatccttgagttctttcaagatccgcttcgaagccatcgcgtaaacctagggaaaacgcaagagagatcctccgttggatttgcaa

SEQ ID NO: 4695 - DNA, 296 bp, Cicer arietinum
acgtgatggtgttccggcaagtgacatacactctctttgatagagattttgatgagagtgagtgtcaattgccacaaagatgtggaaaatttgggctttgtgaggaaaatcaatgtgttggttgtccattagaaaatggaatatttgggtggagcaataaatgtagtgctaagcctatagcaacatgcaaagaaagtgaatttcattactacaaaattgtaggagttgagcattatatgagcaaatacactaatggtgatagtgtaagtgaagctaattgtggaaataaatgtacc

SEQ ID NO: 4696 - DNA, 341 bp, Cicer arietinum
acaggtgactccccggcaggaggatgatgctgattctgataacccgatgaactatagtgtccactttcaggatacccaccagcttgcattccacctgaactcgataatctatacatggaaccagcactacccaaaccaccagcggaaccaccatgtccgccaccagcaccagcaccagcaccaccaccagaacaacaaagttgtccaatagatgtattgaagttgggtgcatgtgttgatgtgcttggtagcctaatacatattggaataggtggtagtagtgctaaacaaacatgttgtccattgcttcaaggacttgtggatttggatgctgctctttg

SEQ ID NO: 4697 - DNA, 342 bp, Cicer arietinum
acccttgccgactacaatatccagaaggaatctacccttcatctcgtcctccgtcttcgtggaggtatgcagatctttgtgaagaccctcaccggtaagaccatcactctcgaagttgaaagctctgacaccatcgacaacgtgaaggctaagatccaagacaaggaaggaatcccaccagaccagcagagactcatcttcgccggaaagcatcttgaagatggccgcaccttagctgactacaacatccagaaggagtcaacccttcaccttgtgttgcgtcttcgtggtggtatgcaaatcttcgtgaagaccctcactggtaaaactattacccttgag

SEQ ID NO: 4698 - DNA, 197 bp, Cicer arietinum
accattttccgagattaacaaagcttttgattacatgcttaaggggcagtccatcagatgtatcatccgtatgggagagtaacactgtaagactctgtgaaagagtccctactgggagactgagttctatatctggttttgaaaaaataaataatgaaatattgttgtatattccattttcgttgagtttgtgaagt

SEQ ID NO: 4699 - DNA, 326 bp, Cicer arietinum
ctaagggtaccaacttcgatgctgagagcattgccgctgctaaggaggcactcaagaagaagggcgtgcgacagcgagttatggccgactgcagtcacggtaactcttctaaagaccacaagaaccagcccaaggttgctgccgatattgccggccagatctccaagggagaggagggagtcatgggagtcatgattgagagtaacatcaatgagggtaaccaaaaggttctccctgagggcaagtcgggactcaagtatggtgtaagcatcaccgatgcttgtatcagctgggaagacactgtctcgacactcgacactcttgcg

SEQ ID NO: 4700 - DNA, 150 bp, Cicer arietinum
caagagtattagcatagtcaaaaagccattaattaattagcatcttaattattccaaatggcttcaaaatttgctattattcttctttccctcaacatcctatttttcactatggttacctccaattatgttccatgtcctccaccaccc

SEQ ID NO: 4701 - DNA, 262 bp, Cicer arietinum
gctgttgcttcgaaacaggccacgacgcccggattcaaggcatatgccaagcaagttaaggccaatgcagttgcacttggaaattacttgatcagcaagggatacagccttgtcactggaggaactgaaaatcatcttgtcttgtgggatcttcgccctcttggcttgaccggcaataaggtggaaaaactttgtgatctatgtaacatcactgtgaacaagaatgctgtttttggtgatagcagtgccttggctcctggag

SEQ ID NO: 4702 - DNA, 275 bp, Cicer arietinum; identical to SEQ ID NO: 2467

SEQ ID NO: 4703 - DNA, 314 bp, Cicer arietinum; identical to SEQ ID NO: 2277

SEQ ID NO: 4704 - DNA, 152 bp, Cicer arietinum
cgatttcgagcgggccgcccgggcaggtacaatttgcccgatcccatgagcaaatagcagatggtcttacgaagccattacctgctgcgagtcatgataaattcctggaagcgctacgagtgagccaaagccctactgaagaaggtggacgt

SEQ ID NO: 4705 - DNA, 310 bp, Cicer arietinum
cgaatgtataaacttatttaatttttattgataaagggagatacaaagacatgaaatatcacatttcaggagagagaaaggaaaactaaacaagagaacagtttatttgattgaaagctaacataagaagacatcaactcatgttaggtatagttgaaggatggatcagttgtaattaggattggccaaaacgtaaccctcaatggccttgaaaagagcatcaccctttgcctttccttcttgaacctccttctcattgggcttagcatctcctttggtttgatattttacgctcaccttcccaatggac

SEQ ID NO: 4706 - DNA, 424 bp, Cicer arietinum
accagataaataattatttcactatttatatatagtcatgcattaaatacatacccaacaaatctttgtgacttccaatatattttgctttgtaaataaatcccctttaatgcaattcttcgactacacataggctgcctatatctaaattttatcaatgtctctctaaattgacggtcatttttcatagacgtattttttaagtcagtaactaacaattaaatcatacttagaatgcaatggctatatgtcaatatgttggatatcccgatctatttttaacattcagatgcaacccaaaatggccagaaatacgatttttccttgaaaccattgaaggacaaaaaagtgacgacagacccgacattattagtcgtgttttctctattaaattatggaagctgatcaatgatattaaacgtca

SEQ ID NO: 4707 - DNA, 429 bp, Cicer arietinum
gcttcttcgagaagtggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaaccc

SEQ ID NO: 4708 - DNA, 392 bp, Cicer arietinum
atatattaaccatttttaggatggatacttttacaaggaacatttgaaaataatgataaattataaacactgaagcaaagcagaagaaaagaacattataagtttacaaggtttgctgttaaatgtgttcagaacaaaccacctcagtctaggtgggcagacaatactctcattaaatatcaaccatgataccatccacccatccatccatccatccatccaataatcaataaatccgtttcagcagaattgggcattcaatagtaggggctgtagcgcatccccattctgaaccttggaaccttaccatatccataaggagcaggagcaaaggcaaaaggaggtggatatggagttctgcctcgaaaccccatgtaaggattactaggccg

SEQ ID NO: 4709 - DNA, 423 bp, Cicer arietinum
accaagattgcttctgaaggactcaaacatcgtgtgtttgagatctcattggctgatcttcaaggtgatgaggataatgctttcaggaagattaggttgagggctgaagatgttcagggcaagaatgtcctcaccaacttttatggtatggatttcaccactgacaagctcaggtctttggtccgtaaatggcaaactctcattgaagctcatgtggatgttaagaccactgataattataccttgagaatgttctgcattggctttaccaagagacgcagtaaccaagtgaagagaacctgctatgctcaatccagccagatcagacagatccgcaggaagatgagggagatcatggttaaccaagcaacatcgtgtgatttgaaagagcttgttcgcaagtttatccctgagatgattgga

SEQ ID NO: 4710 - DNA, 307 bp, Cicer arietinum
gtgaaaccatgtctcagaaggactttctagaaatgtctggaactggaaagggtaagaagagggaggaacacgacaacgcttccgatggcgactctgaagctcacgcgcctcccaaaaagaccctaaaaaaagattccgacgataactctgacgaaatcgttgtttgtgagatagggaagaacaggaaagttactgtgaggatctggcagggtaagatttgggttgacattcgtgaattttacatcaaagatggcaagcagttgcctggcaaaaaaggtatttcactgtccatggatcagtggaatgt

SEQ ID NO: 4711 - DNA, 404 bp, Cicer arietinum
actgattaattcattattcacaaagaaccataaaattcataacatcgtaaacttattctactgggccaacacaggccctatcacttccacaacaagtaaaagaaacatcagacagatattaatcccacagccacagattagaaaccaccacgaagacggagcacaaggtgaagggtggactccttctgaatattgtaatcagcaagggtccttccatcctccaactgcttccctgcaaagatcaacctctgctggtccggtgggataccttctttatcctgaatttttgccttcacattatcaatggcatcagagctctccacctcaagggtaattgtcttcccagtcaaggtcttcacaaaaatctgcataccaccacgaagacgcaacacaaggtgaagggt

SEQ ID NO: 4712 - DNA, 198 bp, Cicer arietinum
actttttctaggctgcgactgtgttgtagatgcagactcgtcatgtggtccaaaagcaaacacaggaccacccatcataggattcattttatagtaaggaaaatgagaaggtgggccagaaggaaagtgaggaggaacggcaggaaaatgggaaatcatctggcctgaagaattttgtgtatttggtaagggagacca

SEQ ID NO: 4713 - DNA, 292 bp, Cicer arietinum
gattcagatttaacccatagattagatctaaaatggcaacaaccacctttgtaaccgtcgtaggaatgggtggcgcatcacgtctcgcctcagggtttgtgaaaccacaagtgatggccaggaatcgcttgaggcaagctatggcacggggaaatggtgggagggttacatgcttccagagggattggctgcggagggatttcaatgtgattggttttgggttaattggttggttggcaccgtctagcataccggctatcgacggtaaaagtctgactggacttttctttga

SEQ ID NO: 4714 - DNA, 427 bp, Cicer arietinum
actcgtcgtgttccttcttgtgacggtaagggtgtgactttgactgaggcggatcgtttggttcaagagaaaaatcgtatcgaagctgatgaagaggctactgaagaggagcttattcagctacagcggcaattaaatgagcgtttgtccaaactgatgcgccttcgtcgtcagaagcgccttattcagactaaggggttgcgggcgttggaaaatgaattggctacgatgagcgatagtgagaaggcggaatgtctggttcctgaagccgatagggtggttgagtcggttgaggccggtgctcctgaccttatcgattggtctgttgtttttgatccttctttcgtggttgagaatgaaacttcttcaggagtcgttgggcattcatgaggtgtttcggtggttcccatgtgttttcgctttctgg

SEQ ID NO: 4715 - DNA, 202 bp, Cicer arietinum
acttgtgcaatttgaagtgttcattcttttgtttaggaattgtcgattacttactttactccctaaaattaaaataaattactcgacatggaggagctaaatctgaatttactgtatttatgtaattaatttggaacgtgtattaactcctcaatagcagactatctttccttctttacattgcattgggctatatactagc

SEQ ID NO: 4716 - DNA, 343 bp, Cicer arietinum
  misc_feature (17)..(17): n is a, c, g, or t
  misc_feature (29)..(29): n is a, c, g, or t
aattcgattagcggggncgcggccgaggnacagagcttatttccagaccgtggaacggggcaattgcctcgtctacagagcagcgttctggccgccttgggtttttcccctgcaaggggtttccccaaggatgcatagtcctagggttgcagctactggcgagcttagggatcatggttctcctgcctttgggcgtggaaagccacctgatctatctgtgcaagagaattctaggctggagaggaatagttcccgctgacgggatgacctcttgaaagtagagcgcctttgtgccgatgatatgctggatgaactagatgggagacgctgctggagggaatct

SEQ ID NO: 4717 - DNA, 190 bp, Cicer arietinum; identical to SEQ ID NO: 1999

SEQ ID NO: 4718 - DNA, 424 bp, Cicer arietinum
agagtattattatcgtcaaaaagccattaattaattagcatcttaattattccaaatggcttcaaaatttgctattattcttctttccctcaacatcctatttttcactatggttacctccaattatgttccatgtcctccaccaccccccaagggtcacaaaccccaccacccaccttcctcaaaatctccaacttgtcctagagacacaattaagtttggtgtgtgtgctgatttattgggtttgattaatgttcaacttggtaagccaccaaagacaccatgttgttcactcattgatggtcttgctaatcttgaagctgctgtgtgcctttgcactgcccttaaagctaatgtgttgggaatcaaccttgatcttcctattaacttgagcttgatacttaactattgtggaaagggtgtt

SEQ ID NO: 4719 - DNA, 312 bp, Cicer arietinum
acacgagaggccttagtatgcacacaagattggatccaaaatgaatcaggagatataaatccaacgccaagccattccgctctaccacttctccttgaatcaagttaactttcccaggtattcttcagcgaaacttgtatcaaatgtttgtaatctctctactttcgcttgttgaacattgtgcttaaaacttattaatgtgcagtgttccaaggttgattgttctgttactggttcgctagttacttttatctttttgttttacgatttcaggtagtatcatcaaagaagctatctttgaattgtaactgt

SEQ ID NO: 4720 - DNA, 201 bp, Cicer arietinum
acaatgcctttcacctcattactcagagagaggctgttagtcgagaaataaggaagatattgactgaaagggcctcccaattcaacattgcattggatgatgtgtcaatcacaagcttgacgtttgggagggagttcacggctgcaattgaagccaagcatgttgctgctcaagaagcggagagagcaaaatttgttgtag

SEQ ID NO: 4721 - DNA, 423 bp, Cicer arietinum
ctagatagttgcccctaattcataaaccaaaacatgttaccacttgctcttctagcttttgctctcttgctattcttcttcttcaaaaaacacaaaacatctaagaaaccaaatcttccaccaggacctaaaggccttccattaattggaaacttacaccaacttgatagttcagttcttggtgtagacttccatgaactctcaaagaaatatggctctttagtcttccttaaacttggttcaagacaaacacttgttgtttcatcagctaaaatggccaaagaagtaatgaaaacacacgatatcgaattttgtaaccgacccgctttaaccagccatatgaaattctcatataatggattagaccaagtatttgcaccatatagagaatattggagacacaccaaaaaattctcattcatc

SEQ ID NO: 4722 - DNA, 216 bp, Cicer arietinum
acaaatgattatccatacacatcagcgtctccatcaagagcacgaagagacgattcaacaaatctagcagctgcataagccattgacaaagtagcagaccctgcaccagcctttgcctcaacaacttcagttccagcattttgaatcctaactgttagctcatcaatttcttcatcagtgaaactcactgaaggtcttgtctttgacaagatagga

SEQ ID NO: 4723 - DNA, 428 bp, Cicer arietinum
acaaatgagcattcatacacatcagcgtctccatcaagagcacgaagagacgattcaacaaatctagcagctgcataagccattgacaaagtagcagaccctgcaccagcctttgcctcaacaacttcagttccagcattttgaatcctaactgttagctcatcaatttcttcatcagtgaaactcactgaaggtcttgtctttgacaagataggaagaatggtaatcccggcatggcccccaacaaccggaacatctacatcaatcagcctcaggttcttcctctgagaaacaaacgtgttagccctcacaacatcaagtgtagtaacaccaaagagccttttaggatcatagacacccttttgtttcaaaatttcagcagcaataggaacagtagagttcacagggttactgataatatgaataaa

SEQ ID NO: 4724 - DNA, 226 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtttttaagttgtatctcgtactcgtatgtcgtggcggcagggaaaaaccttgggaa

SEQ ID NO: 4725 - DNA, 432 bp, Cicer arietinum
actgatccagatgacgcaggtaaaatttcacgagaagacttccttgagggtgttatcgatctcctcgatgctgaatcacttcgtggcatttttatttggaatgctaatgactctgcaacccctccacccaacggaaaacctttctcctttgagataaaggcacaagaactcctcactaaatcaggataattaattactatctagctatctagctacctagtagttatttaaaacgcattctacgggtcattaataaataatagctagatcttgtcatgataaagtttgtttcttatatcttctaaataagacccgtctggcttgaatggatgattttactattgcatgggtgtttgtgtatcgcacaattttcttattttatttcattatgtatttgtatgatatctcctgtcatatgtggattttttttat

SEQ ID NO: 4726 - DNA, 427 bp, Cicer arietinum
gatttggctagcttagagaaatctaaggctatcattagtaatttgacaatggttccaagtgttggtgatgtatataggaactgtgaaatcaaatcaatagctacgtatggagtttttgtagagatagctcctggacgggagggactttgccatattagtgaactgagttcaggttggctacctaaggcagaagatgttttcaaggtgggagatcggattgatgttaaacttattgagataaatgataagggacagctgcgtcttagtcaccgagcactgcttcctgatgcagatccagacaattcaaattcaaatgctacagcagctttgccagactcagctaataatggtttgtcggatgaagctacaagcctgacaaatgctggtttagttgaagggaaaactgaacagactaatgataatttta

SEQ ID NO: 4727 - DNA, 382 bp, Cicer arietinum
acgcggggataccccgctagaaaaaaggaaaacattttttttggggtttaagagagaaaagaggttttctgcatctattacgttcgtgacacaacaattgcagtgtaccagattttatttgagcatgtgagattgcatccacggcaagagaaattacagagcaagggatagaaaaattacgacatgtttcatttcaataggaagaatccttccgattggcttgctgctgcagtaattcctccctaacccttttgatctccgcttctttctccaacctctctagcttttcgtcctgatggagagccatccagacatggaccttgtccatggattgccagaaagcgaaagctgccaaagtggtgccaaagtacgcggggggtaa

SEQ ID NO: 4728 - DNA, 153 bp, Cicer arietinum
caggtacgcggggtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 4729 - DNA, 377 bp, Cicer arietinum
accaggatgcatccaccaccttaatatcaggctccttcaggttatcataaagccaatccacagacacaactggctcatttgtgggtgcagatcgtgttgaatatgcagctcttctaccaactattgaagaagccatacaaggagcccaaccagtcaatttggtgttttgggctgtagaggttggaacagtttgtatagagaacagccgtttagagaagaaagaagagagaattggtgggtggtgagtgataatcgagcgaggacctaaaagaatctttgtcaaaaaggaagaagccattatcagcaatgaccatataaaaggagtggcctcgaattactcgaagagtcgtaggttgttccaaaatcgaaattaagtt

SEQ ID NO: 4730 - DNA, 357 bp, Cicer arietinum
actgatccttttgccgcaggtaaaattgaaagagaagacttccttgagggtgttatcgatctcctcgatgctgaatcacttcgtggcatttttatttggaatgctaatgactctgcaacccctccacccaacggaaaacctttctcctttgagataaaggcacaagaactcctcactaaatcaggataattaattactatctagctatctagctatctagtagttatttaaaacgcattctacgggtcattaataaataatagctagatcttgtcatgataaagtttgtttcttatatcttctaaataagacccgtctggcttgaatggatgattttactattgcatgggtgtttgt

SEQ ID NO: 4731 - DNA, 365 bp, Cicer arietinum
acacaatttctactcggcaacccagatggcggccatacccataccagttcctacacacatagatgttgcgccaaccttctggcctgttcgcttcaactcatatagaagagtagagacctgtcgggcaccagtgcagcctaggggatggccaaaggcaatagcacctcccttggggttgatcttctcttggggaatacccagctcgttggcacaccacaagcactggctggcaaaagcctcgttgatctcccagatatcgacatcatccttggagataccggcaaggtcgagagccttggggatagccttccaggggccctgtcccataagaaggggcttgacaccaacaatcgaggcgcaaacgt

SEQ ID NO: 4732 - DNA, 188 bp, Cicer arietinum
acgttgggtattcacataacgagctctacatgtgttgttactggagcggatataccgaagcaacaggggattacgcagcttagcaaatggaactgcttgtttattactattgcttggggattcttctttcgattcctcttacttggctttgctatttggaagcaagaacaagaggaagtaaacgagga

SEQ ID NO: 4733 - DNA, 360 bp, Cicer arietinum
cgcggccgaggtacgcggggggcgagggtaagggctttctttctgccgtgtcgtttgctgttattttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaacaaaaattttttatgagaaggctctaaaggagttaaatcctaaggcacaacagaagggatcttttggaggatctgggctcaagaaaagtggaaagaagtagaggagctctttctcatgatttcatacctccagtattgagctctgtaattac

SEQ ID NO: 4734 - DNA, 280 bp, Cicer arietinum
  misc_feature (234)..(234): n is a, c, g, or t
actacccaggtcaagatattgcaaacaacttggactgggtcaatgtaatgacttatgaccttttcacctcagatgggtatccaaccacgacacagccacctgctcctttgaaaaaccctactggccaattcagtgtagatgaaggtatcacaaaatggattgggttaggagtacatgagatttctctgcagccttgattggttctcagcacattcggtgagcttgccagaattntggctttcaacaatcttgagaattaaggatttgttctcatctaggt

SEQ ID NO: 4735 - DNA, 437 bp, Cicer arietinum
acatctgagtagttacccctacgtttctgcttatttgattgttctctttttttagatattcaatttggttgttaagatcttccatgtgttgttgtttcttcattcttgatcttcgtgccgattccctattcgattgcattctcttccttttcttttgatccataacatgcacctgttgttgttgaatatctccctctgatccagatccagagttttgaagagagcttgttccagatgaatatgctccaccaggagaagccataggtagttaggttttaaatcgcggtcgcgagttgcgatctttgatttgattgatgcagcctcaattgcagatgcgactgttcgcttaagactcaaaaactttgatgtggcgatttagatagtggtaattagtatttaattagatagttaaattgattagatagatagaatgaaac

SEQ ID NO: 4736 - DNA, 423 bp, Cicer arietinum
ctcaattccatcctattagattttcacttgttaaattcaaccattttcatctctcttgaattcttcattcatcaactttgttaaccatgtcgaatactgctggtcaggtcatcaaatgcaaagctgcgattgcatgggaggcggggaagccgctggtgatagaagaagtggaggtggcgccaccacaagccggtgaagtccgtcttaagatactcttcacctccctttgtcacactgatgtttacttctgggaagctaagggtcagactccactgtttcctcgtatatttggtcatgaagctggagggattgtggagagcgtaggggagggtgtgactcatctggaaccaggggatcatgctctgcctgtattcactggggagtgtggggaatgtccacattgtaagtctgaggaaagcaact

SEQ ID NO: 4737 - DNA, 429 bp, Cicer arietinum
  misc_feature (233)..(233): n is a, c, g, or t
actacttttgctcaagatgggagatggtgcgagggagagaaagctattccattaaagaaaaggagaggaaggttcgagaatgataagatattggagagtaataatgatagtaagaaagtcgtgaagggtaagatgatgaagacgaagatgaataagaaatgttcaacggtaaaagatgaagaagatgaagaagaaagcgggagtaagaataagaagaggatgaggaaaagggnaagtgcagtagtgatggaaggttcgcggtgcagtcgcgttaatggaagaggatggaggtgttgtcaacaaacacttgttggttactctctttgtgaacatcatttagggaaaggaaggttgagaagtatgacaagtgttagaaatagatctattggtattggattttctaatactactactactactactgcacca

SEQ ID NO: 4738 - DNA, 146 bp, Cicer arietinum; identical to SEQ ID NO: 2441

SEQ ID NO: 4739 - DNA, 437 bp, Cicer arietinum
acaccttgtttactctaaatggaatagctcgcaagggttgatcaatgtctctatctccactttccaatttccaatcaaaggaattaatcaatgatcctaacatagtatgcaacattctaattgcaagtggcatgccaggacatattcttctcccactaccaaatggtgtcaattgaaaattttgtcccttgaaattaatttcggaccccaaaaatctttcaggtgaaaacaaagttggattgacccaaatttttgggttccttcccatggcccattgattgactagaatttgtgcaccttgtggaatagtgtatccatgaattgtaacatttgttttggcttttcttggtagcaaaagtggagctgatgggtgcagacgtaacgtttcttttactattgcttgcaaatatgggagtcttattatgtctgattcctca

SEQ ID NO: 4740 - DNA, 436 bp, Cicer arietinum
cttttggtgcctaattttgctgattttctttcacttgttggaagcagtgtgtgtgttgttcttggatttgtgttgcctgctatgtttcattgtatggttttcaaggaggagttaggttggagatgcattctttctgatggggtagttatggtttttggattttttgttgctgttgttggaacttttacttctgtcacagagattctttctcctaaggcctaactgaattttggctcaaaaagtttgtgacagatgaaagcctctttggtcttgatggttaattgagcaacttgggtcatcaattggatttgatactggtatcaagtgttttttgttgattgaatcatgattatctatcatgaacctacaaatgtatgtttttcttttatgtaaaaagttgtagctctatttgttggaattgaagaattaaagagaa

SEQ ID NO: 4741 - DNA, 293 bp, Cicer arietinum; identical to SEQ ID NO: 1098

SEQ ID NO: 4742 - DNA, 326 bp, Cicer arietinum
acgagaatcttatccatccttcgatggagtcatcgattttcattgatttggatcaaaatgaagcagtgttgaattcgtggaggttgttgagtatgttttatgaggcgtttgttgggatggctagttctatatggacactccataagttgtcccatgcctttgatcctgcggttgagatctttcaagtggaaagaggtgtggagttctctatggtatacatggatgatgtgactaagaggttaacctggccaaataagggaaggacaaaagttgggttcactgtttttccaggttttagaattggaaagatagttattcagtcacag

SEQ ID NO: 4743 - DNA, 216 bp, Cicer arietinum
accttacttgttgccaggagaaggtgataatgaagatggaattgatgagtttgatgaagaggagggtgaaattttacagtaaatttaaagtttgctctttgttgctcaaagattttgaatagtaagattgtaatctcgtgttaaaccatttttgtttccatcatacatatattgaagtgtagaggggcatgaaaggtcactaaagttatttggaaa

SEQ ID NO: 4744 - DNA, 215 bp, Cicer arietinum
acttatggtatgatcgaagctgaagagggaactgtcagttctagaaccctgccaagattacgaaatattgttactcaaagtggcacaacgtctcttaaatccagcaacgatatttttcttggacagcttgcttctttggtatcaaccacagtggaacatgtcatagcacctgatgttaggtttgaaactgtagatcttacttcaagattgcttgt

SEQ ID NO: 4745 - DNA, 255 bp, Cicer arietinum
acgcggggattctcgtgaagcgtgacgagctcaccttggaaggtattaagcagttctatgttaacgttgagaaggaggaatggaagctggacacactccgtgatctttatgagaccctagccatcactcagagtgtcatttttgtgaacaccagaaggaaagttgattggttgactgacaagatgcgaagccgagaccatacagtctcagcaactcattgagacatggatcagaataccagggacattattatgc

SEQ ID NO: 4746 - DNA, 438 bp, Cicer arietinum
aggggtgtcctgagatcacattcaacaatggttaaggctgtggcagttcttggtagcagtgacactgtgtctgggactattaacttcagtcaggagggagacggtccaaccactgtaactggaaatcttgctggtcttaagcctggtctccatggcttccatattcatgccttaggggacaccacaaatggctgcatatcaaccggaccacatttcaatcctaatgggaaagaacatggttcccctgaggacccgattcgacatgctggcgatttaggaaatatcaatgtcggtgatgatggaactgtaagcttctctattactgacaatcagatccctctcactggaccaaactccatcataggaagggctgttgttgttcatgctgatcctgatgatcttgggaaaggtggtcacgagcttagcaaaactactgga

SEQ ID NO: 4747 - DNA, 285 bp, Cicer arietinum
ctgtcaacctgattcacacttggttttgcagagagtatgagtaatatcactgagaaattgggaatcaaggttgagacaaacccttctgaggaaaaactcactcaacttggtgttaagcaatggtccaaatggggttgtcctccaagcaaatttccatggacttatgatgccaaagagacttgctatctcttagaaggaaaagttaaggtaacaccaagtggagcaaatgagtcagttgaaattggtgctggtgacttggttgtgtttcctaaagggatgagttgt

SEQ ID NO: 4748 - DNA, 331 bp, Cicer arietinum
acaatcaaaagaagaaaacaagaagatacgacaagcatataagatatgaatcacgtaaagttcgggcagagagcaggacaagagttagagggcgatttgccaagatagaacactgaaatcatggtaagctgttacaacatcacgcgtaaattatgtaacttgtttttgtatagtgaaacttgtttaaatttttctagtgacgtatccttggatctatagctttgatattatgccgtcaaattaatgcaatacggttgacaagagtttatttcctgggcccgaggaagataagaaggtcgatttttctgtgaatcaaaattgaattcatggt

SEQ ID NO: 4749 - DNA, 433 bp, Cicer arietinum
acgctttatctcaaagatgctttggtgaaagaaagagggaggctttttgaccttttgaaggaagttccattccttaggccatttccaagtcattctaatttcattctttgtgaggttacacctggattggatgcaaagaagctaaagggtgatcttgcagagatgggcgtgatgattcgccactacagcaacaaagagcttaaagggtaccctggcagctgcatggtttgtattgattcctatttatatgtggctcaaagatcaaattgttcccaaaggccagccaatatgagagagatttgtagttagtaaacgttttgatattatcattgtctttgttcgaagttttttatcaagtgtaagattatttacacatgcagctgagaaatattttattaaacctcataatccttagtttctttacctatttgag

SEQ ID NO: 4750 - DNA, 210 bp, Cicer arietinum
ggcggctcttcccaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtg

SEQ ID NO: 4751 - DNA, 429 bp, Cicer arietinum
acttaaactttgccacggatcttatgatataagattaaggtccttaaatttgattagtgaaaattgagatctaaattgaagagaaaaaggttttgttttgttttgttttgtttttgtttcacttaaatggagagttttggtatcttaagcaacgccaattagcacaattctttaaacagctactatacaaccatttatctccattaactcccatgtgtctacctttcttttttctcaacacttgttcttttcccttttcttcacccatcaaacaattccaacacaacaacaaagtgaccaattaatatgtatgtttttttgacaacactgttttggtctcttattattcttctacatcattacactttcaaattttataggttgttgagaagaaaacaaagaaagatgagtgggagattggaaatgaat

SEQ ID NO: 4752 - DNA, 433 bp, Cicer arietinum
acctatcctgatttctactttaaaatcactaacagtgaacacaaagttgaactcaaagagaaattccaacgcatgtgtgataaatctatgatcaaaagtagatacatgtatctaacggaggagattttgaaagagaatcctagtgtttgtgaatacatggcaccttcattggatgctaggcaagacatggtggttgttgaggttccaagattagggaaagaggctgcagttaaagctatcaaagaatggggtcaaccaaagtcaaagattactcatttgatcttttgtacgcggggggatgaatatggcataaaatttgggatgccaaccaaacaactagtaatcagaaggctaacatgcatttcaccatacagtgcaaccatagccttgggaagtgaaatgtcaggagggatacaagatgttagagctgaag

SEQ ID NO: 4753 - DNA, 404 bp, Cicer arietinum
actgtatggtcaccgtgttctgcgctaaaaaagactcctacaacaaatattacagcaattgggcgcagaatgacaaaggtcgcagtttcagtaaaggacgttctacgcgagatgaaagaattgaagccagattctagtgatgatcctgttgacaatagttgtgcagaaacagagtctgaaccatgcaataataattcaagtgacggtgatatagggaacgacctatcacctgaagagatgaaagtggctgaaagagccattgcagttgtgtctgacacactttcagtcctgaaagaacttattcgctccatcacaggcttgattaagatggaaaaaccaaatgacaacggcagttttgtagattcacttgaaaaattgttgcagctttgtacagaacttggcca

SEQ ID NO: 4754 - DNA, 435 bp, Cicer arietinum
acgctgggggtctcagaaaattcgttaagtggtatgttcgttattacgggattcagtcgaggctaaaaaaggaaaatcacaatgataatgaattacccgaggattccgcttgattgctggcttggctggttattattctccttgcatcacatgcctctcattttcaaaagaaaaacaaactttttcatttttcttgttttgctttgttaaattattattgttattattataattattttttctttttgttaaaatgttgttaattattattgtgtcggtccgtgtggatgagactgacggtgaattaagttgttgatgtggcaaatatagatttatatatataaatttggtatagaggaaacaaggacataaatgtgaaagaaacagaaagcaaaagtaaggaaattgaaggaggaagtgtagatctgtgagttg

SEQ ID NO: 4755 - DNA, 223 bp, Cicer arietinum
accggtgatgcaagcaatttcgtccccgtcggcctagtaatccttacatggggtttcgaggcagaactccatatccacctccttttgcctttgctcctgctccttatggatatggtaaggttccaaggttcagaatggggatgcgctacagcccctactattgaatgcccaattctgctgaaacggatttattgattattggatggatggatggatggatggg

SEQ ID NO: 4756 - DNA, 403 bp, Cicer arietinum
caaaggttgaatgttgcacctgaaaggatttcaattgttcaaggttcaagttctagtagttttagtcatgataacagtaagtggaaaaagcgtgctcaacactacaagaagttggttcctgaacttggaacagaaaaggtaagaaatgtgatggacatgaatacagcttatggaggttttgctgcttccttgatcaatgatcctttgtgggttatgaatgttgtctcatcttatagtcctaatacactccctgttgttttcgaccgcggcctcattggaaccttccatgactggtgtgaagctttttcaacatatcctagaacctatgacttacttcatgctgatggactcttcactgcagaaagccacagatgtgaaatgaagtatgtgatgttggaaatgg

SEQ ID NO: 4757 - DNA, 327 bp, Cicer arietinum
acaatgaactctctccaaatggtgagtttgaggtcgtttttatcacagctgatgaggatgatgaagcctttaaaagctacttttccaagatgccgtggttggctatcccgttttctgattcagatacacgcaatcgccttgatgaactgtttcatgtaaatggaattcctcatcttgcattgcttgatgaaactggcaaagttgtcgccgaatatggagttgacattatccgtgaatatggacccgaagcattccctttcacatcggaaaggatccaagagttaaaagatcaagaagaggaagctaagaggaatcagtccttgagat

SEQ ID NO: 4758 - DNA, 292 bp, Cicer arietinum
acaactaaattcattattattatttctggtaagaaaacgaaagagaaaacagcagaaactcagatttaaccagtgttttgcaatccagcagcaatacccttcatggtgagaatgagagtatcttccaaaccaggtgcatactcacttgttgggttcagtgttacaagttcatcagcagctttacttatctctatagactctttagagatgtgagggcgtagcttcacattatagtttggatctcggatacgtttcaatgtgtaagcttggcacacatttagggtagtaatgt

SEQ ID NO: 4759 - DNA, 292 bp, Cicer arietinum
acagatcgtcccgtgatgatctccttgttaccaacccaaagcgtgtggagaaagctattaaggagaagtcttgcaacgcccttttattgaaggtgaatcaaattggtagtgtaactgaaagtattgaagctgtgagaatgtctaagaaagctggctggggtgtcatggctagtcaccgaagtggtgaaactgaggataccttcattgctgatctctcagttgggttagcaacaggtcagatcaagaccggagctccctgcagatccgaaaggcttgctaagtacctcggcca

SEQ ID NO: 4760 - DNA, 438 bp, Cicer arietinum
acgaattggcttacacagaagccaagggaaggatcaagaaaggagatagaacatggcaaatagcattcggttctggattcaagtgcaacagtgcagtatggaaggctctcaggacaatcaatcctgcgaaagagaagaacccttggattgatgagatccaccattttccggttgatgttccaaggatttctgccatttaaatgttgcagtttaagattgttattttgtatgtatcatcaacattaggtggtagctgttgaactggtggacgcggaccagtgttaggtcggtcatgcttgaaggttaggttttgttaattcgatttagtcacaggtctcgtgcatgagctttggagtgctgagttttgcagaaatttattgtcttgtggtagtgatgtgtgttagagcatctgaaatgtaatccaaacctaattcgtga

SEQ ID NO: 4761 - DNA, 438 bp, Cicer arietinum
acccttaatgcacggtctggaaaagaagagaatgtgaagaatgcacaagatgctttgttgacaagggctaaggctaattcagaagctactcttggaacttacaagggtaactctcaacttggtgaaggtgcctcagagagtctccatgttaaggactacaagtattgatcaaagttggtgtatcccttaaagagggtaggtttggcatttaagggtataacaactgaacattgtgagggttgaattttcttgttattgagtattgtggaataattgcttggagtttttctttttgttttctctctgtttgtttgatcatagctttagtctatttggtcaaaacccgagcaaaagggtggacataagacactattctaagtcaggttatttgtttattttgcacttatctttgttgcggtatttttatttttactctct

SEQ ID NO: 4762 - DNA, 320 bp, Cicer arietinum
acccttatggcctggtctggaaaagaagagaatgtgaagaatgcacaagatgctttgttgacaagggctaaggctaattcagaagctactcttggaacttacaagggtaactctcaacttggtgaaggtgcctcagagagtctccatgttaaggactacaagtattgatcaaagttggtgtatcccttaaagagggtaggtttggcatttaatggtataacaactgaacattgtgagggttgaattttcttgttattgagtattgtggaataattgcttggagtttttctttttgttttctctctgtttgtttgatcata

SEQ ID NO: 4763 - DNA, 256 bp, Cicer arietinum
acccttattgcacggtctggaaaagaagagaatgtgaagaatgcacaagatgctttgttgacaagggctaaggctaattcagaagctactcttggaacttacaagggtaactctcaacttggtgaaggtgcctcagagagtctccatgttaaggactacaagtattgatcaaagttggtgtatcccttaaagagggtaggtttggcatttaaggttataacaactgaacattgtgagggttgaattttcttgttat

SEQ ID NO: 4764 - DNA, 434 bp, Cicer arietinum
acattagtgatgggtttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagttaataattaatgtaataaatgtgtgctgtaatatatatgtggtcgcggtttgcttgggttcttaatgaaataaaagta

SEQ ID NO: 4765 - DNA, 237 bp, Cicer arietinum
acacaacgccttccgacattttgtagagtcgctttcaacggtttgaatccagcagctatcatatcatcaatcactgctagagcagatttgacatctcggttaatcaggtgggcatcaacaagcagggaatacgactttgcattaggcttgacgcccaaacttactaggtgttcaaacacctttgaagcttcatgtgtcttcttgagcttcccaaaggtttacatcagcccattgtat

SEQ ID NO: 4766 - DNA, 435 bp, Cicer arietinum
  misc_feature (401)..(401): n is a, c, g, or t
acagcagaggatgcaaggctttccaatggactcataggcaatggagtcgaccttatcatctctttgaagatagcaccgtagtccagggatgattctgcttcaatacaaatgcgagccatgattttcacagcaagttcaggataagctccggcagcactttcaccactaagcatgacacaatctgttccatcaagaactgcattagctacatcagttgcttcagctcgggttggccgcggagacttgatcatggattcaagcatctgggtagcagtcaccacaggcttgccaacaagattacacttatatatcatcattttctgtgcaagaaaaatcttctcaactgggatctccattccaagatccccacgtgccaccatgaatgcatcagtctcacgcangatctcatcaaagttcatgactccctcttgattc

SEQ ID NO: 4767 - DNA, 406 bp, Cicer arietinum
actcattatttcatatgtggtttctcgggacactgctccgctggtcaaaagctttcaatcaacgttggtgctaaaactatcagccctgccacatcaccttctccaaccgccgcatcgccttcaccctccgccgattctccatcgtcgtcttcttcaaccgtcaatccttcttctcagtctccaaacactgccgtcagtccacctcctcagaactcggctgctgtgtccgttcgagttgcgggattatttcccaccgttctctcaattgctgctgcatttttctgttagagaaatgagatcctggttaggactatggattatttgttcttcatttctatgcgtcattcttttttttttttgtcattgtgtgaggggacattttattttacaataatgtgttattagc

SEQ ID NO: 4768 - DNA, 209 bp, Cicer arietinum
accaagccaaacacgaaccccttttctcggatcgcgtatttctgcagcccattttccccatggacgttgtcggattcctctgtagaggtttttcctctgttttttcaccggtttctctacttgctcactaactgtgggagtgtaggatcttttgagagtgggtggtggtggtggttgttgatcaccacctgtttgagaaaaatcgaaat

SEQ ID NO: 4769 - DNA, 433 bp, Cicer arietinum
acggattagccgaatccgactgtttaattaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcc

SEQ ID NO: 4770 - DNA, 213 bp, Cicer arietinum
  misc_feature (174)..(174): n is a, c, g, or t
  misc_feature (176)..(176): n is a, c, g, or t
  misc_feature (182)..(182): n is a, c, g, or t
caggatatgttgcatataattcatatatttctgcatcgacgactagatatgcagcacttggtgctcctactttgtatgattatcccagttcaatttatggaagaggagaacctgttcgtggaatgtgcaaaaagatttttgttggccgtcttccccctgaggcaaccactgagngnaatctntcccgcccctgggtattttttggaaagaatt

SEQ ID NO: 4771 - DNA, 402 bp, Cicer arietinum; identical to SEQ ID NO: 4167

SEQ ID NO: 4772 - DNA, 423 bp, Cicer arietinum
aaagagaaaaagctattggaccacggagacccaaactgctaaaaccgaatcagatgcaaaaattacaattgggctgagcccagctgagcttgttgttgtgaatccaaacaaaaaaactgcggttggaaacgaggtcggataccgtttgattccagcaattccagctcatccacttttaacggaagatgattacccacaaatacgtggcgcatttaccaattataatggttgggtcacaccttataatataactgagaaatgggctggtggactttatgttgatcatagtcgtggagatgatactttagctgtttggactctaaagaatagagacattgagaacgaggacattgttttgcggcacgtagtgggaattcatcatgttccagcacaggaagattttccaattatgccattgttgag

SEQ ID NO: 4773 - DNA, 430 bp, Cicer arietinum
acgggctcggccgtcatctagcaagcactaaattatcaagcaacaagacaatcaaaaggattcgtgttcgagggggtaatgtgaagtggagagaaattagattggataccgataacttctcatgggacagtgaagcaataactcgcaagactcgtcctcaggatatggtttacaatgcctcaaataacgagctcgtccgaacgtagactcttgttaagagtgctattgtctaggttgatgctgcaccattcaagcagtatggtgttgaaattggtagaaacatcactatggtgttgaaattggtagaaaaaagaaatcagctgcaaccaagaaggattctgcagagtagttggcttttctttcaaatcggatgtcttttttctcaagatcgtcagctagattcccacattgaagagcagtttggtggtgg

SEQ ID NO: 4774 - DNA, 259 bp, Cicer arietinum; identical to SEQ ID NO: 952

SEQ ID NO: 4775 - DNA, 415 bp, Cicer arietinum
acagagtttacccggagaccgtggaacgaggcgactgcctcgtccacaaagcagcgttctagccgccttgggtttttccctgcgaggggtttctccaaggatgtatggtcctaggttgcagctactggcgatcttaggggatcatggatttcctgcctcagggtatggaaagctacttgatctatctgtgcaagagaattctaggctggggaggaatagatcccgctgacgggatgacctcttgaaagtaaatgcgcctttgtgccgatgatatgctggatgaactagatgggagacgctgctggagggaagctctgcgaggatcaactgtattgatgtccaatgggacatgcttcaccgacaactactgtagggcgagctacgagtagagaggtgcctcttgggggtaatgagt

SEQ ID NO: 4776 - DNA, 283 bp, Cicer arietinum
acatagaggcagatccagcagggtagggtggacgatacagcagtcagcagccatcgtgttgcctcgctgccttttgcttttgtctttgccttcttgtcctaccacacccgtccctctcgctacagcaagctcttccaaaggcccccaccggtgagccatttctcccatgcctattgcgttttgaatagtagaattgcgcagtggccgaggtaaaagtagataaagtgcttggtctcgtgggtaacgaagctaccgaaatttcggccaacaatgcagtgccagg

SEQ ID NO: 4777 - DNA, 394 bp, Cicer arietinum
acagcttgttacctgcagctcaaatacttttcaaaattgagcacacagatgttcctctttcctactataccggaattctgggtatgccaggattgactgcttatgctggtttctttgaattaggctctcctaaaaaaggagggaatgtttttgtttcagctgcatctggtgcagttggtcaacttgtcggtcaattcgctaaattaacaggatgttatgttgttggaagtgctggaagtaaagacaaggtgaatctattgaaaaataaatttgggtttgatggaggtttcaactacaaggaagagcctgaccttaatgcagctttgaaaaggcacttccctgaaggcattgacatttactttgagaatgttggcggcaagacacttgatgcggt

SEQ ID NO: 4778 - DNA, 434 bp, Cicer arietinum
actacttttactacccttcttttctttctcctaataataactttcctttcaattgcaatttcaacaccaacaaatttcatcaaatcatcatgtagcacaacacaatacccaacactttgtgttgaatcactttctacctatgcatcaacaattcaacaagaccctcatcaattagtccaaacagctatatcaataagcctcaacaaaacccaatccactaaagattttgttacaaggtgcaaaaatatcaagggtcttaaagcaagagaatatgctgccttacatgatcgtagtgaagaaattagtgatagtgttgataggcttatccgttcattaaaagagcttaaaatttgcaagatcaaaggtgaggatttcaattggcatataagtaatgttgagacatgggttagctcagctttgactgatgaaacaac

SEQ ID NO: 4779 - DNA, 424 bp, Cicer arietinum
tgggtcctaccatgcaaagatatcagattttgggctagcaaagctgggtccttcagctagtcaatcccatttgtcaacagcggttatgggcacacttggttatgcagctcctgaatacatgcaaacagggcatctatatgtaaagagtgacgtgtatgggtttggagttgttttggttgagattctgacaggcctacgagcagtagatgccaaccgtccaaccgggtttcacaatctaacggactggatcaaaccacacctacaggatagaagaaaactgaagaatgttatggatcgtcaattgggagataaatatccaattaaagctgcacttcctgtagctaagcttgcttcaaaatgtctagcacctgagcccaaaatgcgcccatccatgaaggaagtcttggaggacttgaagggtatt

SEQ ID NO: 4780 - DNA, 178 bp, Cicer arietinum
gctcagcttacccggagaccgtggaatgaggcgactacctcgtccactgagccacgttctggccgctttggggttttctcctgctagggttttccccaaggatgcacggttctagggttgcagctactggcgatctttggggatcatggacttcctgcctcagggtatggaaagctac

SEQ ID NO: 4781 - DNA, 403 bp, Cicer arietinum
acaaaaggattaagcattcattgaactgtccccaaattcaactacttgtgttcactcctaaactatgatcagcgtgttttgccaaatcaattaaaagccatctcttatttgttagagctgcaatagttgtggaatgagcttgaaaagaaaagacagctcctgttgtgaaaactgaggctttgagttcacttgcaccttcccaatcccttcattcaaaccctcttcctctccaatctttgctggcttcatcatatccgcaacggcctctgttatttcttgcacaaaatctactatcaccccatcgattcccattaggtgctgcatgtaaaccgcttctggaacattgtttaatttgccatatgttaaaagagaaagatttgactccttgatcttggtaactgct

SEQ ID NO: 4782 - DNA, 341 bp, Cicer arietinum
actcgttaggcaattgcaaagcacatatccagttttctttttgactaatggaggttgtgaaatctatgaagatttgagaagaaactccttggaggaagccctgaaactctgtttggagaacgggttggaaggaattgtctctgagattaaagggatatttagaaatcctggagcagttaccaagatcaaggagtcaaatctttctcttttaacatatggcaaattaaacaatgttccagaagcggtttacatgcagcacctaatgggaatcgatggggtgatagtagattttgtgcaagaaataacagaggccgttgcggatatgatgaagccagcaaaga

SEQ ID NO: 4783 - DNA, 341 bp, Cicer arietinum
atggctacttctgcaggaggcgatgaacacaaaaaccctgcttttgacccggatttggatacaccagaaaacccggatcacgagtttggtgagttcggtgcgggttgtttctggggtgtggaattggcctttcaacgagttgtgggagtggtgaaaacagaggttggatattcacaaggtcacacaccagatcctaactacaaactggtctgcaccggatccaccaaccacgtggaagtggttcgggttcaatttgacccgaaaatttgtccatacacaaatctcttggatctcttttggtcacgacatgaccccactaccctcaatcgtcagagagaaga

SEQ ID NO: 4784 - DNA, 293 bp, Cicer arietinum
actaggtttaaccatattgcgacacagaaaatcagtagggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 4785 - DNA, 293 bp, Cicer arietinum
actattttcaattactattgcgacactgtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 4786 - DNA, 261 bp, Cicer arietinum
cgcttaaccgacatcgtcgttaagacgaaaatcacggtttgtgaagcgcgtgaggaagatggattctccgacggtgatgtcttaatttttcctgaaatgatcaaatacaagggtttggaggaatcaaatgttgatagctttttcaatgatgtggtggtgagtggtaattcatggggtggtggagtgcagggtgtgataacaggttcatatatttttgtgtgtgctcatggaagtcgcgacgtgaggtgtggtgtttgcggg

SEQ ID NO: 4787 - DNA, 436 bp, Cicer arietinum
ttcctgcttcctctaaaaaaggagatgtaattgtggcggatgagggagtccactggggaattcagaatggcctatatctttctagaagcaccgtggtatattttaagcacaatgacatggattctttaaaagaaactttagagaaaattacttctaaatacaagcacaccaagaatttgaggcggtatattgttgttgaagctctctaccagaattctggccaaatagcaccattagatgatatcattaaactaaaggaaaaatatcggtttcgtattttactggatgagagcaactcatttggtgtgcttggaagttctggaagaggtctcactgaacactacggagttcctgttgagaagttagatcttataactgctgcaatgggacatgcattggccacagaaggaggattttgcactggaagtgcaagagt

SEQ ID NO: 4788 - DNA, 425 bp, Cicer arietinum
tttcgagtgccgcccgggcaggtacacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtactactacatcaatcaaccttatccaactacagagagagggttctttgggggaacaaagttgtgg

SEQ ID NO: 4789 - DNA, 267 bp, Cicer arietinum
acagcgttatctactcgaagaagagggccttgatttcatagaaccgcagccgggcctgattcgtgttgtgatatattgagccaagtgatatgaacaagaagtatacaagtttttgacagtaaaaatccatgaacatagagatgttgtagtcattcttgtatcatgtatatgggaagaaatgctgaaaaaaatgaaaaaaaaataagatctttagaagaaaaaaatggaaaagattagaatgaaagagaagggttgtagtagaattgt

SEQ ID NO: 4790 - DNA, 321 bp, Cicer arietinum
acccgagggatcgatgactcaccgtcctcatcgtcatcgtcatcatatgcctcactgtattgttgcttctttcgactcatctcctccgcaatattgacatcatgcaaggcggtctcctcacaattatctagctctttttgcgacaatttcttgctggtcttttgaggaaatatcttttctaatgcctggctttgggtagggggaagaaaacctgagtctgggaaatcaacactaaactttatgtaaagacgtcccctcatgaaaggcctattgtgttgcgaaatcccctcatcatttatagctttatgttgacctggcttg

SEQ ID NO: 4791 - DNA, 200 bp, Cicer arietinum
actgaacttttgatcaggaagcttcctttccagaggttggttcgtgaaattgctcaggacttcaagactgacctacgtttccagagccatgctgtgcttgcattgcaagaagctgcagaagcataccttgttggactctttgaggacaccaacttgtgtgctattcatgccaagcgtgttacaattatgcctaaggatat

SEQ ID NO: 4792 - DNA, 176 bp, Cicer arietinum
ctaacctttacccaaattaaagaaaatgaaaaatatatattttttttaattctaatagctattgataaataaattattttctctaattcaagttttatatttcaaattgtgtgtgtggatgttaatttttattgcttcacagatgcaacaagaggtctagtggattgaactatgcc

SEQ ID NO: 4793 - DNA, 307 bp, Cicer arietinum
cagaaatatggggaagagatacattgtgcaatcataccaagagaaggatcaaatattgatgaagaagaggtcctaatatattgcaagaagaatctcacatcttttaaagtcccaaaaaaggttttcattactgattctttgcctaagacagctactggcaagattttgcgtcggcttgtcgcagaacacttggttggagggaaacttgggatttaagaggaagatatttattgagtataataggttttgattattattgtgatgtgagaaacaatgcaatgtttaaagaatttttcatattgtgtac

SEQ ID NO: 4794 - DNA, 406 bp, Cicer arietinum
acatgggttctgttctctcaaaaagcaatatccccaagcgtatggaccatcaggtgcacttgaccatccacctgtcgtttcgtgagatgtttgtcccaagaaagccgcaatctctcttttcttagttgcagtatctccgttattacccaaatcagggaaatacttagcagctgcaatgaaagcttcgtaggtgtagaatcctttcccctcacaaccactatcgtctcgatgcttcagcatctggttgaaggtgtccctcgatatgatgctaccaacaccaccaccgccgcttccacattgactctggcaaccatcaccgcaatagtcactggttgaaccacaccaaccaaatttgctgcagcataatccaccggggcacaacgcaccaccagcttgttttccacat

SEQ ID NO: 4795 - DNA, 414 bp, Cicer arietinum
acagagcttacctggagaccgtggaatgaggcgactacctcgtccacagagcagcgttctggccgctttggggttttctcctgcaagggttttccccaaggatgcacggtcctaggttgcagctactggcgatcttaggggatcatggacttcctgcctcagggtatggaaagctacttgatctatcagtgcaagagaattctaggctggagaggaatagttcccgctgacgggatgacctcttgaaagtaaagcgcctttgtgccgatgatatgctggatgaactagatagaagcgttgctggagggaagctctgctgagatcagctgtattgatgtccaatgggacgtgcttcaccgacaactactgtagagctggctacgagtagagaggtgcctcttggaggtaatgagt

SEQ ID NO: 4796 - DNA, 327 bp, Cicer arietinum
tgtttctaattctaccactttaacacgtatcaatgagcaacacgcaaaaaatagtgtcaccctaagctagcccagaaaatattacataaaaaatttaccaactataaaattaatgcagcaacccttttcaatgattcagatgccttgtgaagatcagactctgaatgccctgcagaaacaaacaatctaattcctaaaggcaaacggcacttgcccaatgttgatcttctggaagttaccacaaatacagaatcttctttcaaaacacgctcagagatgttttcaagcagatgtaggtcattgttcaaagaacccgttgacttcttt

SEQ ID NO: 4797 - DNA, 433 bp, Cicer arietinum
acactaacgtcagttcgacgttaagtgcttcggtggaagagaaaaaaaacgcggtgagtggtaatttggtaaaaaactgggttgaaccgggtaaattctttagagaaaaaatgttgaaagaaggaacagttatgcctatgcctgacattagagataaaatgcctgaaaggtcgtttttaccccggagtattcttgcgaaattacctttttctacctctaagatctatgagatgaaacggttattcaaagcttcggataatggttctatggagaaaatgatgagagattctttaggggaatgtgagagagttccgagtcgcggtgaaacaaaacgatgtgtgggctccattgaggacatgatcgactttgcaacttctgttttaggcagaaacgtcgtcgttcgaacaaccaaaaatttaaacgggtcaaaagg

SEQ ID NO: 4798 - DNA, 290 bp, Cicer arietinum
tccattgtaaacctgagtgtgaaggagaacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatgtcatactctcttcttcttttcattttgttgtggaagtgtgagattgtaagtcaagtgtgtacctacccg

SEQ ID NO: 4799 - DNA, 419 bp, Cicer arietinum
acaacgtatcctcatggaacttttgaatcagatggatggtttcgatcagacagtgaatgttaaggtcataatggcaaccaatcgggcagacactttggatcctgccctcttgcgtcctggaaggcttgatcgcaaaattgagttccctttgcctgatagacggcaaaagaggcttgtatttcaggtttgcacagccaaaatgaacttgagtgatgaggtggacctggaggatcatgtttcccgtcctgacaaaattagtgctgctgagatatctgctatttgtcaagaagcaggaatgcatgctgttcgtaagaatagatatgtcatactgccgaaggacttcgagaagggttacaggacaaatgtgaagaagcctgatacggactttgaattttacaagtgaatggtttttctgattt

SEQ ID NO: 4800 - DNA, 433 bp, Cicer arietinum
acggataaggggaatccgactgtttaattaaaataaagcattgcgatggtccctgcggatgttgacgcagtgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcatcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggtgcgctgc

SEQ ID NO: 4801 - DNA, 382 bp, Cicer arietinum
aggtacacaaatgaccctggagaagttgtcaagggagtctgctcaaatttcttgtgtgacttgaagcctggatctgaagtaaagattactggaccagttggtaaagaaatgcttataccaaaagatcctaatgccaccatcatcatgttgggaactggaactggaattgctccatttcgctcatttttatggaaaatgttcttcgaaaagcacgaagattatcagttcaatggtttggcatggctcttcttaggtgtccccacaagcagttcattgctttataaggaggaatttgaaaagatgaaggagaaagcacctgagaacttcaggcttgactttgctgtgagtagagagcaagtaaacgaaaaaggagagaaaatgt

SEQ ID NO: 4802 - DNA, 167 bp, Cicer arietinum
actctaatttgcctggatccagaggaagtaacagtaacagtaatttaattagttagacaccctttagtgtccagttgactttgtggggtccatgagcatgaggcttaatacgggcgttgaagttgttattatattcatatgaattgacatagcgaacatcacctcca

SEQ ID NO: 4803 - DNA, 176 bp, Cicer arietinum
gctaatgattggcagatctttacagaaaaatttgatttttttccattgaccgcattggttgaatcagaaatattttgcttgcatggtggactctcgccttcaattgagacccttgataacataagaaactttgaccgtgttcaagaggttcctcatgaagggcccatgtgtgatct

SEQ ID NO: 4804 - DNA, 405 bp, Cicer arietinum
acatctgattagtcccccctacgtttctgcttatttgattgttctctttttttagatattcaatttggttgttaagatcttccatgtgttgttgtttcttcattcttgatcttcgtgccgattccctattcgattgcattctcttccttttcttttgatccataacatgcacctgttgttgttgaatatctccctctgatccagatccagagttttgaagagagcttgttccagatgaatatgctccaccaggagaagccataggtagttaggttttaaatcgcggtcgcgagttgcgatctttgatttgattgatgcagcctcaattgcagatgcgactgttcgcttaagactcaaaaactttgatgtggcgatttagatagtggtaattagtatttaattaga

SEQ ID NO: 4805 - DNA, 437 bp, Cicer arietinum; identical to SEQ ID NO: 4735

SEQ ID NO: 4806 - DNA, 318 bp, Cicer arietinum
acatctgagtacttacccctacgtttctgcttatttgattgttctctttttttagatattcaatttggttgttaagatcttccatgtgttgttgtttcttcattcttgatcttcgtgccgattccctattcgattgcattctcttccttttcttttgatccataacatgcacctgttgttgttgaatatctccctctgatccagatccagagttttgaagagagcttgttccagatgaatatgctccaccatgagaagccataggtagttaggttttaaatcgcggtcgcgagttgcgatctttgatttgattgatgc

SEQ ID NO: 4807 - DNA, 421 bp, Cicer arietinum
acaattgaacgagagggcttggaaagatgttgtttgaaggagagtagtgaataaaactagacaaaaactaaaaaagctaataaaaaaatgcttgcatgcacgggacggaatatcagtagggaatatcaggatggcttgcgagcacagttggagtaagcagctgatctgaatttcttgattccaccgttaggacgaatgtcttcaatgttgtatccgaggggggcttcgtagaataatgatgatgatgaattactactactactactagacttctttttacctcctttagactccattagctcattcagtcctgatttgataagatcaaattataaaatgccgcagctttcaataccttcaacccaccgagatcaaatcgaatgaaatagatacgagtgggaacttgggagaagggaaagcg

SEQ ID NO: 4808 - DNA, 208 bp, Cicer arietinum
gtttcaaattgcaactaatataataagcaagctacacattgtgtcaagaaattgaaatggcggagaacaatgtggttttgttggatttttggccaagctcatatggaatgagagtgaaaattgccttgggagagaagggaatctcatatgagtgtaaacaagaagattttcaagctaaaagctctctgcttttggagacgaacccgat

SEQ ID NO: 4809 - DNA, 401 bp, Cicer arietinum
acagctccccattacgtgctctatttgtttgagcagtaatccaccgaaactcaccattcaaattatactccttcatgagatcgtgcatcttctcaatctctgcaatttcttctctgtcactggacttcttcacatcaatataaccagctacaacgacaaggttgaccagttccctcaatttgctgttcttagcatagctttctaccaaaccagttatgtttttaactctgtctagccttgccatggagaaaattataggctttgaccggtccttcagtgaaccaatgcactcgtcagtctgctcggtatcatataatagcttttcaattgaaccatgcagggacgtgagtcttttctccttttcagagtaggggaaatatattgtcatatctgctccagga

SEQ ID NO: 4810 - DNA, 166 bp, Cicer arietinum
  misc_feature (35)..(35): n is a, c, g, or t
cgactacgtttcccaacttggttaggggagattgnggactgcgtgaggagatgtagcgatgcgtgagagaattctggtcggtggaaaaagtcgacagtatgcccccggacccgctgacgggtgacgggctcgagaaaatacagcgccttttgtgccttggtatgct

SEQ ID NO: 4811 - DNA, 439 bp, Cicer arietinum
acggttctggaagcggacaacaatcagttaccggttttcccactgttgatgattccaacagttattggattgttaggcccgaacctggaacttctgctaaacaaggtgacgccattaagagtggcacaatcattagattacagcacatgaggacaagaaagtggctacacagccatctgcatgcttctcctacatcaggcaatcttgaggtcagctgctttggtggagaatctgaatctgacaccggggactattggaggcttttaatagaaggaagtgggaagacttggaagcaggatcagagggttcggcttcagcatattgacacttcaggctatctacatagtcatgataagaaatacagtcggattgctgggggacagcaggaggtttgtggtgttcgcgaaaagcgccctgacaatgtctggttggcagctga

SEQ ID NO: 4812 - DNA, 127 bp, Cicer arietinum
aagctgttatgtattttagctttttatttattttgacagttgtaaagcagtctgttctgctgctaattaatagtacatgcaaacgctgatgatgtgtagttttcgacctgctgctttgcagaagggg

SEQ ID NO: 4813 - DNA, 438 bp, Cicer arietinum
actatactcctcaggaagccgagcttgctagagagaaaactcatggatacaaattggatcgttcacacatatttgccttgagtatgtttgatgattttgaccggtttatgaaagttccagatgagtgggctcctcctccaaataaggaatatgctcctggggaaaatcttcaacactggcttactgatgctaaagcccgagaccagtttgttattcgtgctggttcagaaaccgaggttttgtggaatgatgctagacatttaaagcctgaccctgtttataaacgtgcattttggacggagagttatgttcaatggtctcctttgggcacatacttggcaacagttcaccggcagggggcagcagtctggggaggagctacaaccttcaaccgtctcatgcgttatgctcatcctcaggtcaagcttattgattttt

SEQ ID NO: 4814 - DNA, 319 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccggtgacgggatgacctcttgaaagtaaatgcgcctttgtgccgatgatatgctggatgaactagatgggagacgctgctggagggaagctctg

SEQ ID NO: 4815 - DNA, 260 bp, Cicer arietinum
actaggttgatattcctattgcgacactgtcatcagtagggtaaaactaacctgtctcacgacggtctaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaagga

SEQ ID NO: 4816 - DNA, 434 bp, Cicer arietinum
agcgataacatcatcctcatggcgaagggaaagaagcaactgatgtcatcggcaccatggagaggcgaagaggacaccgaacaattcccagacgcaaacctcaaagttaccagtcaacctgatggcacttcaactatgcatgttcctcgctccaaatccaacaatcacaatcatgatgatgatttaattgagattgatcctgaacttcgatacagtttccaacgcaattttcagtttcttcatagagtttttagcattgacaccgtggtgaaacctctcccacccgtcatggcttacaatgtctctcgcaacttgaacttcttcacgcgcattttcactcaattctttgatcccgaaggcattgcagctgcccagaaatccatgggcataggacaggaagacagagatcgcagagttcgttgaagatacttgca

SEQ ID NO: 4817 - DNA, 293 bp, Cicer arietinum; identical to SEQ ID NO: 3887

SEQ ID NO: 4818 - DNA, 342 bp, Cicer arietinum
acttgggaagatgggagcacctccaaagagtgatgttccaattattacaccaaatgagctcactgaagctgatggtttgttgtttggttttccaacaagatttggaatgatggctgcacaattcaaatcatttttggatgcaactggaggcctatggaacaaacagtcacttgcaggaaagcctgctggcatcttttacagcactggttctcaaggaggtggccaagagactacaccgttgacatctattactcaacttgttcaccatggaatgatatttgtgccagttggatacacatttggagctggcatgtttgagatggagaaggtgaaaggtggttc

SEQ ID NO: 4819 - DNA, 334 bp, Cicer arietinum
acacgccccaacccaatttcaagagacctctccaattgatgtaattcttcaacattcagaccatgaagatcttctcccctcatctgccttagctgatgactcttctcagcaatttccttgctcaatgtggagcagttgatgttttcaactagctgcaactctagagatggttcttccagctctgccaggttctttgagtgcaaatgatgcctttcaagtatttccctcatgcttaaattagaatactcaaagagctttccggtggaagagaaaatgatgagagcaacatcagcatcacacaaaacggagagttcttcaccttttttgaacaagc

SEQ ID NO: 4820 - DNA, 350 bp, Cicer arietinum
acattttactcgtggctacaaagcagaagctcgtgatttcttatgttggaaaccatgatggtcaagtgcatgacacaatggaaattttgagatctggagaagttgtcaatggtaatggtaatggcaatggtggtattgatagtgctaaacctgaagttcagattgaagaatccacattgtcgtggtatgtccagggaggaagtgttttggtgcttggggcctttatgggctacattcttggtttcatttcacgtgccaggaagcaacctgagtctaggagtggttttactcccgtgaagaccgaggaaacatgattagtttattacagtttacctcttttttttataggg

SEQ ID NO: 4821 - DNA, 334 bp, Cicer arietinum
ttcacagagatcctaagtcatggagtgaggccacaagcttcaagccggagaggtttgacaaaaaaggggagattgaaaaggtgattgcatttgggatgggaagaagagtgtgtcctggagaagctttggctcttcgaacaattagcatgactttggcattattggttcaatgctttgattggaaacgtacaagtgatgacaagattgatatggcagaacgagatggattcgttttaacaaaattgattccattaaaggccatgtgtaaaactcgtccggtggtcaacaaggttttcaagtaattaacttatatcgcaattggttgatagtccga

SEQ ID NO: 4822 - DNA, 271 bp, Cicer arietinum
acaaattcaccaagaagacatggctcgttggctactcgtggctcaacgttagcatctccaacgacggcgatgatgagattgatgttttcgctcaactgggcaaacaggatgcttcaggaactcagttagtcaacatgaatgttcctttaaaggaccttattcctcctgtcgacaggcacacagaagctgcatacacatgcttcctgaaatacctgggtcctacaggttccctacgaggtagtcatgctgccacaaaggtgacacctaagcc

SEQ ID NO: 4823 - DNA, 437 bp, Cicer arietinum
acggacaaggggcaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccc

SEQ ID NO: 4824 - DNA, 253 bp, Cicer arietinum
ctttcttatttcttcttcaaattagtgcagcagaaaaagaagatgatgaggttgaagttgaagtatttggctatgaagatgttgttggagccatggccaaataaatgatggcacaagaattatacatatatatgccttctaggcaagtctgatgcttggcttttcatctctgtttgttggtttagtttttgtgagaatcaaatcaaataaggcatgggaatttattattttctagctagtatattatataata

SEQ ID NO: 4825 - DNA, 433 bp, Cicer arietinum
acagatatttgcccaccagacatgtagtttgattttgcagcagaattaattatgtgatctattgcctgcatggaaaagttaaatgtcataaactccacaacaggctttagaccataataggcagcaccaactccaatcccagtaaacccagcctcagtgatgggagtgtcgagaaccctctcagggccatacttctctaggagtcccttggatatcttatatgcaccttgatattccccaacctcttcacccatcaagaagactttaggatcagctgacatttcctcatcaagtgcggagttcagagcatctctcactgtcatctgtttagtagaagaagagaaatgtcggaatgcggagaaggtggggcgaacagtcttgtgccttataacacccaacatattgcttgctttcctcgaacttgaatgaagca

SEQ ID NO: 4826 - DNA, 172 bp, Cicer arietinum
accatactggcaaagctcttgcaactgagatctcctgaaatccaaggccaagtattccatcaaactttcccgccagaaatgaaagacttccttctcgggtagcctcaatgaaatcctgatacttgacaacagcattgccaactttgacattatcttgactgaagaaaccaga

SEQ ID NO: 4827 - DNA, 329 bp, Cicer arietinum
acctttcctgttctctgagcttttcaatttgctccctgaacaattgattctttcttgccctaattttgcttaggctacgttcgatttgttcttcaatctgttgtaattcgtcaatagcacatgtatccaattcatttcctaacagcttcctacaatacatggaatgaaaatatcctatgctgagaatatataatgattcgtgtctttttttctcaatacaaataccatgcagtcaaaatgaaaccaaattaaagaaagttggttttgaaaaccttttggaaagttctaggtgctcgatcttcttcgttgcgctgttatcacattccttt

SEQ ID NO: 4828 - DNA, 140 bp, Cicer arietinum
caggtcattaaatacaacggtggccttgagacagaggaagcatatccctacaccggagaaaatggtctctgcaaatttacatctaaaaacgttgctgttcgaggccttgaatctgtcaatatcaccttgggtgctgagga

SEQ ID NO: 4829 - DNA, 476 bp, Cicer arietinum
agtcgcatgctcccgtccgccatggcggaagcgggaattcgatttcgagcggccgcccgggcaggtacaagttataccttggagaagttttatctactgttcctaccattggtttcaatgtagagaaggttcagtataagaatgttattttcacggtttgggatgttggggggcaagagaaattgagggcactctggaggcattattttaacaacacagatggtttgatatacgttgttgatagtctggaccgcgagagacttgggaaagcaaagcaggaatttcagacaatcataaacgacccatttatgctcaacagtgtcatcttggtgtttgccaacaaacaggacctgagaggagcgatgacggccagagaagtatgtgaaggattaggtctctttgatctcaagaatagaaaatggcacattcaaggcacttgtgcacttaagggcgatggtctttatgagggtttggac

SEQ ID NO: 4830 - DNA, 356 bp, Cicer arietinum
accatacaaggaatagacctgaaccattaacaatgagaagaagagagtgatcttgaacttgctaataagagattccttgagctatgtcaaaagtgtgttcaagccaatattcctttgttggttgatgcagagcatacatcagttcaacctgcaattgattattttacttactcatctgctatattgcataacaaaggtgaaaaccctattgtgtttggattctttcagacttatttgaaggatgctaaggagaggttgatcttggcatcagaggctgctgataaaatgggtattccaatgggatttaaattggtgagaggtgcttatatgtctagtgaaaggaaattggctgctga

SEQ ID NO: 4831 - DNA, 420 bp, Cicer arietinum
acctcatataactcaaatatatacatgggattgtggccttgcttgtatattaatggttctgaaaactattggtgacaacaattgcgatattcaagcactggctgaactatgctccacaactagcatttggactgttgatttggcatatttgttacagagattttctgttactttttcctacttcacagtgacatttggtgcgaacccaaactattgtgttgaatccttttacaaggaggaattgcctaatgatctagaaagggtggatatgctgtttcaggaagcaatggaggctggaattgatatacaggtcaattagtgagcaagagatttcctttctcatattgtctgggaaatatataggcattgcattagttgatcacagtaaattgagtcatgcagggcaagatgttcatgtcc

SEQ ID NO: 4832 - DNA, 225 bp, Cicer arietinum
actggtgtttattcaactacaacagtcaaaatagatagatagatagataatgtggtcaactcaaacttctatacacatctcagatgcaccaactctatcacgcggaatcagacgaagctctgaaccatgcttaaggaagacatttcctgcactctgttgaggatttatcccgacaccatcattggtgataatagcgcttgtctgtggaggaaccttgaattcttc

SEQ ID NO: 4833 - DNA, 200 bp, Cicer arietinum
ccagtttattcccctcttcgggaacgcagctgttgtattccagaagagcaaactcgcggcccgaaggcccatgagcaaccaaaaaaacatggtcacagcccaaggtagagaagatccaaaccaaaacgactgcaacttcaattcaacaatgtgacgtaataccaagctcggacctcaagcccgtggtgagctcgatcaaa

SEQ ID NO: 4834 - DNA, 245 bp, Cicer arietinum
acttagttttattcactccaagttacaaggatgctatgatgttggttggagaaagttacccttttgttaaaggaaactattacatgactattcttggtgaacaacaagaggattatattaaagaatttgcttcttttaaggaatctaaggttatcatagcacctaggacttggttggatttgaggattagagggtcacagttaagtcaaaattttaggaggaaatgtaagattggtccaaaaggg

SEQ ID NO: 4835 - DNA, 381 bp, Cicer arietinum
acattttctcttgaccacgggtagtggtgggtgcatgcggaatgtctctttcacgacggctctaatgtacggaagattttgaatatctgattcgtcgactagtctatcttttccaacaacagagtcaacctcctctcgagctttcttcatcactcttgggttgttgatcagctctgataaacaccaatctgttgccacagcggttgaatctgttcctgcagagaagaaatccacaacaagacccttgatttgttccttggtaattttgatctccatggtctcatcctcagcaaaatcaagcaaagtatcaagaaaaacaacactctgctcaccctcttcaagttcaccatttctctcctttcttcttctcctaacatcttg

SEQ ID NO: 4836 - DNA, 437 bp, Cicer arietinum
acaatacagccaattgcggcctcttgatccatctgtgtctgctgcacctggtcttgcccaattgtgtagccttgcatacattaagataccaaacttggaagaagattttggtcaagaagcagctgaatacttgagcgaactcactttaagcagtggaaaagaatttagagcaatggttgaggagagagatactacaggaggaaaagtgaaaggacagggaactggaacaattactgctgtaactcttgttgctgtggatgctgagatcagcgtcaatgctgccatgcttcaggaaggacttgctagaatggaaaaaagaaacaggtgggacagatcagcaagaaagcaggcccttgatagcttggaagcgttccaaggagaggctaggacaagcaggcgtggaatgtggcagtatggagatattcagtcagatgaag

SEQ ID NO: 4837 - DNA, 203 bp, Cicer arietinum
actcgacaggtccccattaccggagaactggttgagattatcactggtgctactgcctctgcggacatgtaaggagtgggagaacaagatggggtgtaatgcttccctttgtaacaaatgtcatcgggctaccatccatgtatggtttcccccattgtatcaaagccttcaataaattccttagtggcccatgcagtcaatgt

SEQ ID NO: 4838 - DNA, 362 bp, Cicer arietinum
acggtggacgatttctccgatgaatggtgggccctcgttcaatcatccccttggtttcgtgattactggcttcgtgaacgcttccaagatccccaaaatcataacgacacttcctacttctctgatttcgagatcgatgaagatgatcttttccatcaaatcgagccacaacacgaagatgaaggaggagacgggaaagaaatgttgaggttgcgagatttgaaatggagccgatgtgatggatgggctgaagttcctaggtatgcggaaaaggccccgaagattgttaagcccagagtgagcccacgggctattcatcagcctaggtagatgatgacaagtggaaacaccgtttgcgttgt

SEQ ID NO: 4839 - DNA, 432 bp, Cicer arietinum
caacgccaaccgcaatagtcggctctcaatattgtgctccatatccacttgatcttgcgttggttaaaaaagttgggaccttttcacatggaaacttcgccgtcactgatgttaacggcaacatcgttctcaaagttaaaggttccattctaacccatgattaccgtgtcttctttgatgccgccggtaaccccatcctcaccctacgtaagaagttagtgactatgagtgatcggtgggaagcttttaggggtgaaagcatacatgctaaagatcttatatttacattgacgcgatcctctttattcccatatgcatccaaagttcactttaacgaatgctttaattggtaaagaccattacatggtcagagtttatcccaacgttgattacgctttcataatagcgttaattgtgattcttgacgagatg

SEQ ID NO: 4840 - DNA, 430 bp, Cicer arietinum
caacgccaaccgcaatagtcggctctcaatattgtgctccatatccacttgatcttgcgttggttaaaaaagttgggaccttttcacatggaaacttcgccgtcactgatgttaacggcaacatcgttctcaaagttaaaggttccattctaacccatgattaccgtgtcttctttgatgccgccggtaaccccatcctcaccctacgtaagaagttagtgactatgagtgatcggtgggaagcttttaggggtgaaagcatacatgctaaagatcttatatttacattgacgcgatcctctttattcccatatgcatccaaagttcactttaacgaatgctttaattggtaaagaccattacatggtcagagtttatcccaacgttgattacgctttcataatagcgttaattgtgattcttgacgaga

SEQ ID NO: 4841 - DNA, 166 bp, Cicer arietinum
aaaaattctttcttggaacgcactgttagtgcactgttaggagcgggattttctacgggctactcggccacacaatactgcggggacgccatcggctccctaacagcagttttcagagaaggaattttggagagttcaccttctctgacaacacctttgtcggatc

SEQ ID NO: 4842 - DNA, 176 bp, Cicer arietinum
acaaaaggttacactaattcctcggggtcaagctcggggtcttacatggttcattccttccgatgacccgactctgatctcaaaacaacaactctttgcaagaattgttggaggattaggtggtagggctgcagaagaaattatttttggtgagcctgaggttacaactggtgcag

SEQ ID NO: 4843 - DNA, 422 bp, Cicer arietinum
aaaggagaaaacttcaactaccagactttggtcatcgccaccggctcaactgttataaggttgacagatttcggtgtagaaggagctgatgccaaaaatatattttatttgagggaagttgatgatgctgacaaattgtatgagtcaatcaaagcaaagaagaatggaaaagctgtggttgttgggggaggatacattggtctggagatcagtgcagttttgaaactcaatgatgttgatgttaccatggtctacccagaaccttggtgtatgcctagactttttacttctgaaatagctgcgttctatgagggatattatgcaaataagggtgtcaacatcgttaaaggaaccgttgctgttggattcactactaactccgatggagaggtaaaagaagtcaaactaaaggatggtagggt

SEQ ID NO: 4844 - DNA, 144 bp, Cicer arietinum
cgcactgttagcccactgttaggagcgggattttctacgggctactcggccacacaatactgcggggacgccatcggctccctaacagcagttttcagagaaggaattttggagaggtcaccttctctgacaacacctttgtcg

SEQ ID NO: 4845 - DNA, 138 bp, Cicer arietinum
taggtgcacaaacaacaaggagagacgaagcacataatcaatccttgcttgattttccaaattgttcgctcagccgtgagatctgataatctaattcggcgggatctggcgccaccttaagcggtggccggaaaccgt

SEQ ID NO: 4846 - DNA, 403 bp, Cicer arietinum
ccgcaaactagtgcccaaaaaaatacaactcttatgcttaatcattttttcagtcataactaaacttcaattgtttcacatcagatcaactcatttcaatccttgactgatgtccgaagtatcttcacgtcatggatgggcctgtcattgttatctgtttggacactgccaagtcttttgataatttccattccccgactcactcttccaaatattgtgtgttttccatctagagaagggcacggtgcgagagtaataaagaactgactaccattcgtattaggaccagcattagccatagataaaataccagctccagtgtgcttcaactcttgtttaatctcatcttcaaatttcgcaccataaattgactctccacctcttcctgtcccagtgggatccc

SEQ ID NO: 4847 - DNA, 383 bp, Cicer arietinum
acaaagatgttattgaagctctagcagctaagggaattgaggaagatcctcggaactatttgacattcttctgccttggcaatagagaggtggtgaaagaaggagaatacgtgcctactgaaaaaccagagcctgatacagattacatgagagcccaagaggccaggcgtttcatgatttatgttcatgccaagatgatgatagttgatgatgaatacataatcgttggatctgccaacatcaaccaaagatcaatggatggtgctagagactctgaaatagcaatgggtgcttatcagccctatcatttggctaataggcagcctgcaagggggcagattcatggtttccgcatgtcattgtggcatgagcatcttggcgtg

SEQ ID NO: 4848 - DNA, 154 bp, Cicer arietinum
cggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtgga

SEQ ID NO: 4849 - DNA, 185 bp, Cicer arietinum
accgatgactcgaaccttatgagggtgattataacaaggagcgagattgatctacagtatatcaaaggtgaatatttaaagaaatacaaaaagacgctgaacgacgcagttcactcagaaacatctggacactacagggcttttcttctctcacttttaggtcccaaccagtagtaccagcccgg

SEQ ID NO: 4850 - DNA, 325 bp, Cicer arietinum
ctcctcctccttaccattaatagagagtggtttaccatatcatccatggatttgaggaatatatcgaaaataaagcgaagatagtgcacataaggaatatgcattgtgcaattatacaaaggaaaaatagtggaagcaaagtttctgaagatgtatcgcacaattattaatttgtctcataaaaagaaaaaagtgtcactctttttctcttcgtgtgttttatttaggaataaattatattctcattattgtatgaattttgaatttaagatgttgtaaagcactttgtgtcataccgtatgtcatttaatcatatatgtgaatg

SEQ ID NO: 4851 - DNA, 247 bp, Cicer arietinum
acagtataccggtgaaagagactcacacaaagaagtgcactacaggaagcaaatgtgtgaagataaagtcaaccctaagaatgattgatcgttgatttgatcagttacatgtgttgaataactttatatataggaaacttgtcgccaccaggttcgactaaacacaactttaatttgttgtgtatgtgtatgtatttactttccaatgccaagttcttttgagatatctcttgacaagctaaattgc

SEQ ID NO: 4852 - DNA, 362 bp, Cicer arietinum
acacaaggaaagaaaaaacatgcacaaaagaagaaatcagagaaattcaataaaatacacaatttcatttcccatctagtagtcagtggtagggagttgctcgtgggtgtggctaatgaagacgacctcgtagataagcccagcaagcccaccaccgataagtggcccagcccagtagatccagtggttggaccagctccagcttacaacagctgggccgaatgacacggctgggttcatggatgctccggtgaaggctcctccaaccaaaatgttagcaccaacaatgaaaccaattgcaattggtgcaataattccaatattacccttctttgggtcaacggcagtagcatacacggtgt

SEQ ID NO: 4853 - DNA, 238 bp, Cicer arietinum
caatttttggctttgaagctaaagggttctccaaagaagaaggcgcaactctgcttcgaagaagtgtcgagcttgcacgtgaagcacgtgatatttattatgataaatgctctaaagattcttttgacataatgagagatgaaagatatagaagacgccccattttaattgcagcttctgttggaagttatggcgcatatttagctgatggctctgaatatacaggggactatggtga

SEQ ID NO: 4854 - DNA, 351 bp, Cicer arietinum
acattagagactcctgccagcattgtgggcaaagagagaattgttgtgtccacctcctgctcacttcttcacactgctgtggatcttgtcaacgagaccaagttggatgatgaaattaagtcatggctagcttttgctgcccaaaaaattgttgaagtaaatgcattggctaatgcattctctggcaacaaggatgaggccttcttctctgctaatgctgcagctcaggcttcaagaaagtcctccccaagagtgaacaacgaggctgttcagaaggctgcttctgcattgaagggttctgatcatcgccgtgctactaatgtcagtgcgaggttggatgctcaacaaaag

SEQ ID NO: 4855 - DNA, 285 bp, Cicer arietinum
acattactaccctaaatgtgtgccaagcttacacattgaaacgtatccgagatccaaactataatgtgaagctacgccctcacatctctaaagagtctatagagataagtaaagctgctgatgaacttgtaacactgaacccaacaagtgagtatgcacctggtttggaagatactctcattctcaccatgaagggtattgctgctggattgcaaaacactggttaaatctgagtttctgctgttttctctttcgttttcttaccagaaataataataatgaatt

SEQ ID NO: 4856 - DNA, 318 bp, Cicer arietinum
gcgatgatgagattgatgttttcgctcaactgggcaaacaggatgcttcaggaactcagttagtcaacatgaacgttcctttaaaggaccttattcctcctgtcgacaggcacacagaagctgcagacacatgcttcctgaaatacctgggtcctacaggttccctacgaggtagtcatgctgccacaaaggtgacacctaagcctgggaggttcactggtgactggcctgagtacaccaacacgagtcgaaaggctattcctgccggcactgttgccaagctcgaggttcctatctggccgactggtatcatctttg

SEQ ID NO: 4857 - DNA, 344 bp, Cicer arietinum
acaaggacctcgtcagcgtcttcggcggcgagaagacctgcaagaccttccagatcaagaccaagactgagctcaacgagctcctcaccaacaaggagttcaacgctgctgagtgcttgcaattcgtcgagctctacatgcccagagaggatgctcctcgcgctctgatcatgactgccgaggccagtgctaggaacaacgccaagaagcactaaacggttactcaagaaagagcgaaatttgatagacggggttttggaaaaggttcctggagaacataataatgatttaagtggtttatggtttatactatagagtggcggacgatggtttatgttttaagt

SEQ ID NO: 4858 - DNA, 360 bp, Cicer arietinum
accaacaaggttgccttgcaggtggcacggtgcttcgtttggctaaggatttggctgagaataacaaaggtgcacgtgtgttggttgtttgttctgaagtcactgcagtcacatttcgtggtcctagtgatactcatttggatagtcttgttggacaagctttgtttggagatggagctgctgcattgattgttggatctgatccaattcctgaaattgagaaaccaatatttgagatggtttggactgcacaaacaattgctccagatagtgaaggtgctattgatggtcaccttcgtgaagcaggactcacatttcaccttcttaaagatgttcctgggattgtctcaaagaacattg

SEQ ID NO: 4859 - DNA, 239 bp, Cicer arietinum
acatggaagctagaccgttggaagatgggcttgcagaggccattgatgaaggcacaattggaccaagggatgaccccaaaatccgttctaaaatcttgtcagagcagtatggttgggataaggatcttgctaagaagatttggtgttttggacctgagaccactggacccaacatggtggttgatatgtgtaagggagtccagtatttgaatgaaatcaaggattctgttgttgctgga

SEQ ID NO: 4860 - DNA, 398 bp, Cicer arietinum
acttcaattgagatcccatttccaaccacagcagagaatctttttgcaatggatgcagagaaattgcgacggataagatcgaaattcaatggcttgaagacaatggcatcatccacagaatccagaagctcgcgaggttttgagggtgaccttccattgtgattgttgtcttcatggtccactgtgaaatcactggaattgagtgatccatctgccctgtcttcatcaccatccgcggcttcatttagatcaaatgataaacctgaattcacttcctttctaggcttcaaagacctgtcttcattggataaccaactgggtctgcgcttagataccttcttggacactgataaccgcagttgccaacctccacttgctgaatttgcaagcttttcttc

SEQ ID NO: 4861 - DNA, 269 bp, Cicer arietinum
caccaattggctttttgattacgctttgatggacgatattcccgtccctgatggctccttcaacttcacgtggcccccaccggacccttccaatgttggtgttgaaattgatggctctctgggggattctgatggtatcaaagatcctggttcgaagaagaggggtagatcggattcatgtgctccttccagctctaaggcgtgtcgagagaagttgcggagggataggctgaatgacaagtttgctgaattaggctcaatcttggagc

SEQ ID NO: 4862 - DNA, 428 bp, Cicer arietinum
tttaaatagacaattgagtttagaggatctcactaagccagtggaggaggagaatattaagattacgatggatgactttttgaacgcactccatgaagttattcctgcatttggagcttcgactgacgatcttgagcgatgcagactccatggcatggtggagtgtggtgatcgacataagcacattcatcagagagcaatgctaattgtggagcaagttaaagtgagcaaaggaagcccccttgttacttgtcttctggaaggttctcgtggcagtggtaaaaccgcacttgcagctactgtaggtattgatagtgacttcgcatatgtcaagatagtttcagctgaaacaatgattggtctacatgagagcactaaatgtgcccagattattaaggtttttgaggatgcatacaagtcacctttga

SEQ ID NO: 4863 - DNA, 433 bp, Cicer arietinum
agatattgcttcccttatttcatgcaacaataataatcctgaacaatcccctcaaatgttagatcgaattctttttcttctttcttcccactctctcctcaaatgttctctccttcaagatcaacatattcttggatcctatcaccgactatacaccatcactcctgttgccaaattctttgcttctaattccgatggcgtttcattagttcccttgttggcattgcatcatcatcaaatcttcttagatagctggtctcagcttaaagattctattcgggaagggggtattcctttcaacagggttcatggcacacacgcctttgattatcccagcctcgactccaggttcaatcatgttttcaatactgccatgatcaattacaccactattgttatgaacaagctccttcaatgttacaaaggttttgat

SEQ ID NO: 4864 - DNA, 352 bp, Cicer arietinum
caggctggcaaaccattgctcgaaaattatgaggagtatgctagacatgccaggctttacactggaatacacgcaaaagcaaagcccaaattcaaaagcggggctataaccgaatcaactaccgctttaaatgttgatcagacgaacacctcggtgcttaatgctgacatcaaaaccacaccagcaagcgctgctttgccattaccattgtcattgccctcaaccactgcagctagaggagctagtcaggatcaggtggtgggtgttctgaccgagtcatctgttaatgtttctaccgctgcggcggtagtttctgctgcttctgcaccacaaaagaaagaagttggaactg

SEQ ID NO: 4865 - DNA, 435 bp, Cicer arietinum
gcttcttcgagaagcggattttctgaatttgcatcaaatgctaatgggcagtctgcagttgctaaacttaggccgaaggctgacattagcaaagtttcgagtgatggaaatggaagctctgaagtattgggagagcaaaatcgaggccctaggagtagtagatcaaaacatcagctgtccgtgaaagcttatacaaccaaggtaggaggtggtaacgaggaagggaacatcatcatttataccgatcaatacaacaaagaggatttccctcttgactatgataatgcaaagttttttgttataaaatcatacagcgaggatgatgtgcacaaaagcatcaaatacaatgtgtggtcttctacacctcatggaaacaagaagctggaaaatgcttatgaggattcaaagaaagtatcagctgaaaaacccggagtc

SEQ ID NO: 4866 - DNA, 391 bp, Cicer arietinum
caatcgccttcacccgctcccgttccgatttcgatgtctccggcgttcataacttgcccagttactttccccctgatgatgatagaggaaggctccaagtaattagagatactgaatcccttgatgcatcctatgagcgttacctccgtagtgcgcaagtttcatcttatggtccgggacaatctactagaaccattgatgggagagttcccagtcattctattgatgattcacatgtcgcaaatattgggggagtagaccgaagaacagatgcaaaagacagaatcctggaattaagtagtagaaggtctgagcattctcttcctccaggtgctaccaatacgctattcgtggagggtttaccttccaactgcaccagacgggaagtagc

SEQ ID NO: 4867 - DNA, 341 bp, Cicer arietinum
acgacactgttcacggtcaatggaagcattttgaccttaaggttaaggactctaaaacccttctctttggtgagaagaccgttactgtttttggaactaggaaccctgaggagattccatggggtgaggttggagctgattatgttgttgagtcaactggtgttttcactgacaaggataaagctgctgctcacttgaagggtggtgccaagaatgttgtcatttcagccccaagcaaagatgcacccatgtttgttgttggtgttaacgaagatggatacaagccagagcttaacattgtttccaatgctagctgcacaaccaattgccttgctcccctt

SEQ ID NO: 4868 - DNA, 141 bp, Cicer arietinum
acgacactgtccatggtcaatggaagcattttgaccttaaggttaaggactctaaaacccttctctttggtgagaagaccgttactgtttttggaactaggaaccctgaggagattccatggggtgaggttggagctgatt

SEQ ID NO: 4869 - DNA, 424 bp, Cicer arietinum
acattagtgatgcgtttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagttaataattaatgtaataaatgtgtgctgtaatatatatgtggtcgcggtttgcttgggttcttaatga

SEQ ID NO: 4870 - DNA, 308 bp, Cicer arietinum
aaattctttcctggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccgggctctgatt

SEQ ID NO: 4871 - DNA, 361 bp, Cicer arietinum
acatgcttcaccgtcacacagatatggatgctgttgggtctctgcaatgcattcaaatgccaccctttggatgacatgatatcgttcacttcaaatatatccagaacatcggatccaaagccactattgtcatatcgggttttccaatgataaacaactcagcaatctcctcaatgcctttttgtagtctttttgatccttccataattgcttttgtattttccaagtaaccttctttccctagagacatcattgctgcccatgcaccagcaataagggatccaggtctgcttccagctatggttggagatacatacaatccaccagaccactcgggaacggcaacaaattgatgctttct

SEQ ID NO: 4872 - DNA, 317 bp, Cicer arietinum
actgcaaaaatgacccgtgagtatgcacggattaccaaaatagctaacggaagacaccacaacagagtttaaaaggatggcaacaaaaataacataaataacgatttccaacatttcaaagcagcagccataactaagctttgaggcgtccatagaacttctgtttctcttgttttgtctggaagcgactatgcccaaactttgaagaggtatccataaacttaagtttgatatcctccaaggcattgcgagaagtctgcttgagtagagactgacgcaaagcaataacccttttcttgggaccaacaacacctccc

SEQ ID NO: 4873 - DNA, 150 bp, Cicer arietinum
actactctgaccagatcatcaaaggccttgctttggccatgctccttgctggaaccgactcatctgctgtaactttagagtggtcaatgtctaatttgttgaaccatccagagatattgaagaaggtaaaggatgaattggatattcatg

SEQ ID NO: 4874 - DNA, 434 bp, Cicer arietinum
gaagccttcacaatgatcaaacaaaccgttatttggcgtaaggaattcggaatcgaagggcttcttcaggaagatctcggaaccgattgggacaaagttgttttcactgacggctatgacaaagaaggtcatcctgtttgttataacgtgtttggcgagtttgagaataaggatttgtatcaaaaaactttctctgacgaagagaagcgaaacaagtttattcgttggaggattcagtttttggaaaagagtgttagaaaactcgactttgctccatcagctatatctacttttgttcaagttaatgatcttaaaaattcacctggacttggtaagagagagcttagacaagctactaatcaagcacttcagttgcttcaggataactatcctgaattcgtagccaaacagatttttatcaatgttccttggtg

SEQ ID NO: 4875 - DNA, 410 bp, Cicer arietinum
ggttacaattaatacatttcactttaatacgctaattgcagaaatattatgacacaaacaaaaacaatacacatagaaaatagaaaatagataaggaattgaactcaaatggttaatattctagttaaagacaaattattaagaagaatttgagttcaaattctagccgaaataattttgatcgaaactttacttacatctagattattaaggccctattgccatgagaaatggagggtttaaaacaaaacaaaacacacacacacaaaatagatcaatgaaacaagcttagcagttatctggaggagtgagattacatttagcaggaagtgaagaagcaagaattgggtcaattccaaataaaggtaactctgatgagttcttataagaacaaagacatctcaagtcag

SEQ ID NO: 4876 - DNA, 438 bp, Cicer arietinum
agggaattttgctcaagcctagcatggttacacctggggccgatcacaaggaaaaggcttctccagaaaccattgccaaatatacactaaccatgcttaacagaagagttcctcctgcagtccccggaatcatgtttttgtcaggtggacaatcagaagttgaagcaacactaaatcttaatgctatgaaccaaactcccaacccgtggcacgtctctttctcatacgcacgagccctgcagaactccgtgcttaagacttggcaaggtcgccccgagaatgttgaagcagctcagaagtctctgttggtccgtgctaaagctaactccttggctcagttaggaagatactccgccgagggtgaaaacgaagaagccaagaagggaatgttcgtcaagggttacacctactagaaaatttaggtgtcccgtgtggctt

SEQ ID NO: 4877 - DNA, 376 bp, Cicer arietinum
accatctttccgctcattgatgttgctgctcctcttcttgcgttttctgttgcacctgctgcgtatcctcgtctagtaagagagttggagaatccgtcggcaacaagaacagagatagccttggcgttaatgaaggagcgaaccattgatgattcaaattaaaattagttaaaaatttgtaggaggaggaggagaagaagggttatttttaaatttgatggaagcaaggtgggaagagcttgatttaatagaaattttttgattttgtgttactaatgaaaaggagaaaattaaaggaacaagttgtcgacagcgagaaacttatgtcacatatatgtggtgtgtgagcttccagcagacacaaaggaattgtaac

SEQ ID NO: 4878 - DNA, 343 bp, Cicer arietinum
accatctttccgctcattgatgttgctgctcctcttcttgcgttttctgttgcacctgctgcgtatcctcgtctagtaagagagttggagaatccgtcggcaacaagaacagagatagccttggcgttaatgaaggagcgaaccattgatgattcaaattaaaattagttaaaaatttgtaggaggaggaggagaagaagggttatttttaaatttgatggaagcaaggtgggaagagcttgatttaatagaaattttttgattttgtgttactaatgaaaaggagaaaattaaaggaacaagttgtcgacagcgagaaacttatgtcacatatatgtggtgt

SEQ ID NO: 4879 - DNA, 437 bp, Cicer arietinum
gcttccagcgcccagggtttcactcagatttcacatctagggtctatttttctccgccgatccatggctcccaaaggtgatgtttcaaagaagactgacccaaaggcacaggccttgaaagctgctaaagcagttaagtcaggcactgccattaagaagaaggcaaaaaagatccgaacatctgttacattccataggccaaagactttgacaaaggagaggaacccaaaataccctcgtattagtgctacaccaaggaataagcttgatcactatcagattctgaaatttcctctcactactgagtccgcaatgaagaagattgaagacaataacacattggttttcattgttgacttgcgagctgacaaaaagaaaatcaaggacgcagtgaagaaaatgtatgacatccaagccaagaaagttaacaccttgat

SEQ ID NO: 4880 - DNA, 435 bp, Cicer arietinum
acggttctggaagtggacaacaatcagttaccggttttcccactgttgatgattccaacagttattggattgttaggcccgaacctggaacttctgctaaacaaggtgacgccattaagagtggcacaatcattagattacagcacatgaggacaagaaagtggctacacagccatctgcatgcttctcctacatcaggcaatcttgaggtcagctgctttggtggagaatctgaatctgacaccggggactattggaggcttttaatagaaggaagtgggaagacttggaagcaggatcagagggttcggcttcagcatattgacacttcaggctatctacatagtcatgataagaaatacagtcggattgctgggggacagcaggaggtttgtggtgttcgcgaaaagcgccctgacaatgtctggttggcag

SEQ ID NO: 4881 - DNA, 437 bp, Cicer arietinum
acggttctggaagtggacaacaatcagttaccggttttcccactgttgatgattccaacagttattggattgttaggcccgaacctggaacttctgctaaacaaggtgacgccattaagagtggcacaatcattagattacagcacatgaggacaagaaagtggctacacagccatctgcatgcttctcctacatcaggcaatcttgaggtcagctgctttggtggagaatctgaatctgacaccggggactattggaggcttttaatagaaggaagtgggaagacttggaagcaggatcagagggttcggcttcagcatattgacacttcaggctatctacatagtcatgataagaaatacagtcggattgctgggggacagcaggaggtttgtggtgttcgcgaaaagcgccctgacaatgtctggttggcagct

SEQ ID NO: 4882 - DNA, 326 bp, Cicer arietinum
taaaattcttccttggcacgcactgttagtgcactgttaggagcgggattttctacgggctactcggccacacaatactgcggggacgccatcggctccctaacagcagttttcagagaaggaattttggagagctcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctgtgaaggcaagccgcaccgccagcctctgattcctgcccaaggttttt

SEQ ID NO: 4883 - DNA, 436 bp, Cicer arietinum
  misc_feature (49)..(49): n is a, c, g, or t
actcaagaaacattagaagaaggttgtcaattaattgataaaacatggngagagttttagtgatgtccaggtgaaagatcggactttaatatggaacacggacttgatcgagactattgagttggaaaatcttctgataaatgcctgcatcacaatgcactctgcagaagctaggaaagagagtagaggagctcatgcccgtgaggacttcacgaaaagagacgacgagagctggatgaaacacactttgggattctgggagaacgagaaggtccgattggattacaggccggtccacttgaatacattggatgatgaggttgaatcattccctcccaaggctcgtgtgtattaatataattacatattgatggttcaggcatatattgtttccacttgcgcaagtgaaatagatgcaataatatgtcttggatgt

SEQ ID NO: 4884 - DNA, 432 bp, Cicer arietinum; identical to SEQ ID NO: 3956

SEQ ID NO: 4885 - DNA, 433 bp, Cicer arietinum
acatgaaagtatagctacagaacttttgaataggatggtgaaatggatcaaaaacatcaaaatttcagatcccttggaagaaggttgcaggctaggacctgttgttagcgaaggacagtatgaaaaaatattgaagtttatctcgaatgctaagagtgagggtgcaaccattttgactggtgggtctcgaccagagcatctaaagaaaggattctttgttgaaccaaccattatcactgatgtgactacttccatgcaaatttggaaagaagaagtatttggacctgttctgtgtgtaaaaacatttagcactgaggaagaagctattgatctagcaaatgacacaatctatggcttaggggctgctgtaatatcaaatgatctagaaagatgtgagcgcattactaaggcttttaaggctggaatcgtatgg

SEQ ID NO: 4886 - DNA, 237 bp, Cicer arietinum
actagggtaaactcctttcttgtataatctgaagtcatccaccacctgaaatgccacactaacaggtcgagcaaatgcaactgcatgtttcaactcatcctcagcacccaaggcgatattgacagattcaaggactcgaacagcaacgtttttagatgtaaatttgcagagactattttctccggcgaagggatatgcttcctctgtctcaaggccaccattgtatttaatgacctg

SEQ ID NO: 4887 - DNA, 433 bp, Cicer arietinum
gattagcggtcgcggccgaggtcctccaaccttcaatttcgcattttctatttcaattccaacaaagaaacatggaggtgggtcagatgcggagacaatgggtagactacatcaaatccttgttcaccgaggagtttttggatggtcaatttctgcaacttcagcagctacaagatgagaataaccctgagtttgttgttgaagtggtttctcttttctttgaaggttctgagaggattctcaaagatctctccttttctttggatcagcaaagtgttgacttcaaaaaagttgatgctcatgttcaccaatttaagggtagcagtgcaagcataggtgcacagagggtgaaaaactcctgcattgcttttcgcagcttctgcgaggaacaaaacatagatgcttgcctcagatgtttgcagcaagtgaagca

SEQ ID NO: 4888 - DNA, 421 bp, Cicer arietinum
acccagcagaactctctatgacagcttggatttgctttttgggtatctttgaaggtgctattgcaacttttatatttgaacgtgacgtgagtgtttggtctttaggcttcgattctaggcttctagcttgtgtttactctggtatagtgtgttctggaatggcatactatatacaaggagttgtgacaagggaacgtggccctgtctttgttacttccttcagtcctttatgtatgattatcacagctgctttgggtgctgttgtcttggctgaacaaactcatttgggaagtataattggagcaattatcattgtgtgtggactttacactgtggtgtgggggaaaagcaaagatagtgtgaacaatacaattgatacaacacaaagtgagggacaagaattgccaataaaagatggtac

SEQ ID NO: 4889 - DNA, 129 bp, Cicer arietinum
gtaaggtccttctttctgccgtgtcgtttgctgttattttctgtcgttttcctattcagaccgaaccctaatttttcacccaaaccatgtggaccaagcaaggtggaaaagctaagcctttgaagaaac

SEQ ID NO: 4890 - DNA, 381 bp, Cicer arietinum
gatttcgagcgggccgcccgggcaggtgagagagagtgtgtctgtgtgaggtaacgatggtgtcgctgaaacttcagaagcggctcgcctctagcgtcctcaagtgtggtcgtggcaaggtttggcttgaccctaatgaggtcaatgaaatttccatggccaattctcgccaaaacatcagaaagttggttaaggatggatttatcatcaggaagccaactaagattcactcccgctctcgtgctaggcgtatgaaggaggccaagaggaagggacgtcattctggatatggtaagcgcaagggaacaagagaggcaagacttcccaccaaaatcctttggatgaggaggatgcgtgtccttaggaggttgctccgcaagt

SEQ ID NO: 4891 - DNA, 432 bp, Cicer arietinum
acaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaggtgttgtcagagaaggtgaactctccaaaattccttctctgaaaactg

SEQ ID NO: 4892 - DNA, 435 bp, Cicer arietinum
acaagggtccaacccttcttgaggcccttgaccaaatcaatgagcctaagaggccatcagacaagcccctccgattaccacttcaagatgtctacaagattggaggaattggaactgtgcctgtgggacgtgttgagactggtgtcttgaaaccaggatttgtcgtgacttttgcaccaactggattggcaactgaagtcaagtctgttgagatgcatcacgaagctctgactgaggcccttcccggtgacaatgttggatttaatgttaagaatgttgctgtcaaggatctcaagcgtggttatgttgcatcaaactccaaggatgaccccgccaaggaggctgctaactttacatcccaagttatcatcatgaatcaccctgggcagattggaaacggttatgcccctgttcttgactgccacacctcccaca

SEQ ID NO: 4893 - DNA, 426 bp, Cicer arietinum
atcatattactcacagagagagagagaaagatacgaagaaaacgaaaacacaaagcaattcgtcgtttgatctgtttccatgtcgccaacgaatctcttctaaccgtttggattccgatctccgtgctgactactcagactgccataggatagtataggatattaggatcactgttcatcaaccgccatggcagcagcaccggcaagagctcgtgccgattacgattacctcatcaagcttcttcttatcggcgacagtggtgtggggaagagttgtcttcttttgagattttccgatggttccttcacaaccagttttatcaccaccattggaattgatttcaagataagaaccattgaacttgatggcaaacgcattaagttacaaatctgggatacagctggtcaggagagattccgaactat

SEQ ID NO: 4894 - DNA, 384 bp, Cicer arietinum
aaatatggaacatgaacaaatgtactggagttgttggtgtatttaactgccaaggtgctgggtggtgcaaggtagagaagaaaactcgcatccacgatacatctcctggtacactcactagctctgtcagtgcctctgatgttgatcaaatcaaccaagtagctggtgttgaatggcatggggagactattgtttatgcttacagatcaggtgaggtgatacggctaccaaaaggggtttcgattccagtgacactaaaggttctggagtttgaacttttccatttctgtccaatccaagaaatagcaccgagtatatcatttgccgcaataggcctaatggatatgttcaacactggaggagctgtggaagaggttgaaatcc

SEQ ID NO: 4895 - DNA, 265 bp, Cicer arietinum
tggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagttaataattaatgtaataaatgtgtgctgtaatatatatgtggtcgcggtttgcttgggttcttaatgaaataaaagtatgataagttttattgt

SEQ ID NO: 4896 - DNA, 390 bp, Cicer arietinum
ttaagaaagaaagaaagcgctttcagtgactgagagagtgataaaacgctattccaacatgccgatcagaaatattgccatcggaaatccacaagaggcaactcacccagacaccttgaaagctggtctcgctgagtttatctcaaccttcatcttcgtcttcgccggctccggttcaagcatcgcttacaacaagctaaccaacgacggtgctgctactccctccggcctcatctccgccgctatcgctcatgcgtttgctctctttgttgctgttttcgtaggtgccaatatctccggtggtcatgttaaccccgccgtcactttcggtgccttcgttggtggtaacatcaccctcctccgtggtatcgttgacattatcgctcaact

SEQ ID NO: 4897 - DNA, 311 bp, Cicer arietinum
  misc_feature (15)..(15): n is a, c, g, or t
ggcggaacaccgggnaggtacaacactgctgttggtaacatcattatcgtcttggctggtgctgtccctggttactgggtgtctgttgccactatcgatacccttggacgaaagactattcagcttggtggtttcatcattctgactattctcttcattgtcatgggtttcgcttacaaccatatctcctccttcggtctcctcgctatttacgtccttgcccagttcttcttcaacttcggccctaacactaccactttcatcgtccctggtgaggtcttccctacccgctaccgatctacctcccatgg

SEQ ID NO: 4898 - DNA, 437 bp, Cicer arietinum
gtggattgatgaacaatgcatttgaatacctactccagtctgggggagtagtgcgagaacaggactattcttacacaggaagagatggctcctgcaaatttgacaaaagcaagattgctgcttccgtatctaatttcagtgttgtttccgttgacgaagaccaaattgctgcaaatttagtaaagaatggccctcttgcagttgctattaacgcagcctggatgcaaacatatatgagtggtgtctcatgcccatacatctgtgcaaaatcgcgtttggatcatggggttcttctagttggttttggaaatggttttgctcccatccgattgaaggaaaagccttactggatcataaagaattcatggggacagaattggggtgaggaaggatattacaagatctgcagaggtcgaaatatatgtggagtggattca

SEQ ID NO: 4899 - DNA, 312 bp, Cicer arietinum
gtggattgtatgaccaatgcatttgaatacctactccagtctgggggagtagtgcgagaacaggactattcttacacaggaagagatggctcctgcaaatttgacaaaagcaagattgctgcttccgtatctaatttcagtgttgtttccgttgacgaagaccaaattgctgcaaatttagtaaagaatggccctcttgcagttgctattaacgcagcctggatgcaaacatatatgagtggtgtctcatgcccatacatctgtgcaaaatcgcgtttggatcatggggttcttctagttggatttggaaat

SEQ ID NO: 4900 - DNA, 114 bp, Cicer arietinum
acaacctttgccaacaccgtcggcgagttcggtaatttgaacggcggcgagtggattattgtgaccggaataagaaatcatcacatcgtgagcgaagaattctttgaagcaagg

SEQ ID NO: 4901 - DNA, 423 bp, Cicer arietinum
accggttcaggtttgggttccctattgttggaacgtctctccgttgattatggcaaaaagtccaaactcggattcaccatctatccttcccctcaggtttctactgctgttgtggaaccatacaacagtgttctctccacacattctctccttgagcacaccgatgtcgctgtgcttttggacaatgaggcgatctatgacatttgtaggagatctcttgatattgaaaggcctacttacacaaacttgaacaggttgatatctcaaatcatatcctcactcacaacctcattgaggtttgatggggcgattaatgttgatatcactgagttccagaccaaccttgtgccttatccccgtatccacttcatgctttcgtcctacgcacctgtgatctctgctgccaaggcataccatgagcag

SEQ ID NO: 4902 - DNA, 403 bp, Cicer arietinum
accctaccatcctttagtttgacttcttttacctctccatcggagttagtagtgaatccaacagcaacggttcctttaacgatgttgacacccttatttgcataatatccctcatagaacgcagctatttcagaagtaaaaagtctaggcatacaccaaggttctgggtagaccatggtaacatcaacatcattgagtttcaaaactgcactgatctccagaccaatgtatcctcccccaacaaccacagcttttccattcttctttgctttgattgactcatacaatttgtcagcatcatcaacttccctcaaataaaatatatttttggcatcagctccttctacaccgaaatctgtcaaccttataacagttgagccggtggcgatgaccaaagtctggt

SEQ ID NO: 4903 - DNA, 419 bp, Cicer arietinum
accgaatgtccttaatggaatgtaaaggtctggtgcatttatgtcataaatcggtggtttataagagagcctaccacccactggctcggtgattctagtccaatgacccctgtgcagaaatggaaacaaaaccaccttcaatttgttcttaacataatggtcattcacttgaaagtagtattggggatcagagaaataccgacttatattgctttggacatactcagagctggatcctaatatttttcctccataagcacccaatccacctcgaatgagtcctgaaccagcaacttgaaatgcactcccaaaaggattaggttgttgtgtgcttgctggaggctgcgccacccctggttgcggtccaacattattatacattcttactgaagagaagcttgaagagagagtggtgagag

SEQ ID NO: 4904 - DNA, 433 bp, Cicer arietinum
cgagtttcttgcattcgacccgaatactggatccggaacaataattgactcgggtacggtgataacccgttttgtggaaccggtttataatgccgtgagggatgagtttaggaaacaagtgacgggtccgttttcgagcttgggagcattcgacacgtgttttgtaaagacgtgtgaaacattggcaccggcaattacgttgcgttttacggatttgaatttgacgctgccaatggagaatagtttgattcatagcagttcggggtcgttggcttgtcttgctatggctgcggcaccaagtaatgtgaattctgtgttgaatgtcatcgctaattttcagcaacagaatttgagggttttgtttgataccgtcaataataaggttggaattgcccgtgagctttgtaactagctagtagctacctacctactt

SEQ ID NO: 4905 - DNA, 324 bp, Cicer arietinum
acaacagaactcagaaaaatgacaactaaaggaccagctctgattcccctccctttttctctgaagatatttattttagaggagttgccaaatctggagaatgtttggaatgaagatcctcgtggaattctaaagattgaactgctaaaagaagtatatattggcaagtgtaaatgcctcacaagtttgtttccagcatcagtagccaaagatcttgtgaaacttgaaaaactacacgtaaaacactgtgaggagttgacggttattgttgcagaggataatgcagatcccaagggaacagatttagagctcacgttcccttgt

SEQ ID NO: 4906 - DNA, 152 bp, Cicer arietinum
acggtggacgatttctccgatgaatggtgggccctcgttcaatcatccccttggtttcgtgattactggcttcgtgaacgcttccaagatccccaaaatcataacgacacttcctacttctctgatttcgagatcgatgaagatgatctttt

SEQ ID NO: 4907 - DNA, 435 bp, Cicer arietinum
acaattagattcaatcatttctattaactgtagccatgccaaaccctagagttttcttcgatatgaccgtcggtggcacagccgctggacgtatcgtcttcgagctcttcgccgatgtcactccaagaaccgccgagaatttccgcgctctctgcaccggtgagaaaggtgtcggacgtagcggcaagccacttcacttcaagggatcctccttccatcgtgtgatccccaacttcatgtgtcagggaggtgacttcaccgccgggaacggcaccggaggagaatcgatctacggatccaaattcgccgatgagaacttcatcaagaagcataccggtcctggtatcttatctatggctaacgctggtccaggaaccaacggatctcagtttttcgtctgcactgcaaagaccgaatggctcgacggtaaacacg

SEQ ID NO: 4908 - DNA, 149 bp, Cicer arietinum
acaatcatcacataggattcgggttttccgatgatggtggcgacggtggaggtagcttcagagaggatggaagaggtgtcgacgccgtcgaggttgacgttggtggagagattgaggcacggcatcgttttgctatcttggaaatggtc

SEQ ID NO: 4909 - DNA, 245 bp, Cicer arietinum
gttggaacatgatctggtggcagagaaagtgagtaatcacaaaggatgctgcaaatcagggccagggtatgcttctcctcttgaagccatgtctggtcccagagagactctcgtttatgtcgctgctgtctattcaggaacaggaatagagaagcctgattatttggctacagtggatttggatccaaactctccaacttattcaagagtgatccatagactacctgttcctaatttaggtgatg

SEQ ID NO: 4910 - DNA, 186 bp, Cicer arietinum
tgcactgttacgagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtg

SEQ ID NO: 4911 - DNA, 302 bp, Cicer arietinum
gttgacgcaatgtgatttctgcccagtgctctgaatgtcaaagtgaagaaattcaaccaagcgcgggtaaacggcgggagtaactacgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaa

SEQ ID NO: 4912 - DNA, 142 bp, Cicer arietinum
actaggttgaattactattgcgacactgtcatcagtagggtaaaactaacctgcctcacgacggtctaatcccagctcacgttccctattggtgggtgaacaacccaacacttggtgaattctgcttcacaatgataggaag

SEQ ID NO: 4913 - DNA, 246 bp, Cicer arietinum
acaagacagactgatagtcatacacaaaaaactcaagatactgaactttaaaagctcaggtaacagtttcaatgaccagaacataagctaagttgataaataaaaagaaaacagtttaaataatttaaagcttgtcttcgaactcggagagtggagtcatttgctccttcaaacccttcctcttacgaatatcagcaacaagtgttgcagcttgtgatccagcctccaatggatctgatgacatca

SEQ ID NO: 4914 - DNA, 148 bp, Cicer arietinum
actccactttacaacatcaaggcataccttcctgtcgtcgagtcctttggattctccagtcaattgagggctgcaacatcaggacaggctttcccacagtgtgtgtttgatcactgggatatgatgtcatcagatccattggaggctg

SEQ ID NO: 4915 - DNA, 322 bp, Cicer arietinum
acaggccaattgatgagattgaatattggaaaatggaaagagatcctgtgagtagattcaaaagatgggtagaaaggaatggttggtggagtgataaggatgaattggagcttagaagcagtgtcagaaagcagacaatgcatgcaattcaagtggcagagaaagcacaaaaacctccacttgaggacatgtttaatgatgtctatgaccaactttcatcaaaccttgaggagcaagaaagaatacttagaaaaaccattgagaagtatcccaaagtctatccttctgacgttcctttgtagatttttacaactcaaataat

SEQ ID NO: 4916 - DNA, 382 bp, Cicer arietinum
accctccagtttcaccaccttaccactactcctcaccaccaccaccaccaacaaagaaaccatactactaccataaccaccaccacctcctccgccatatccacctccaccaccatatcctccaccgccacctctgttatatccaccttcacgacgtccaccaccatatccaccgcctccaccatatccaccggcaccacggccgcctccaccaccgctaccacgagactgagcttcgttcacggtaatgttacgtccgtcaacatcttgaccgttcatcccttcaattgcgtctctcatggattgcccagttgaaaacgtgacaaatccaaaaccccttgaccttccagtctcacggtcgttaataaccttggaatcagta

SEQ ID NO: 4917 - DNA, 293 bp, Cicer arietinum; identical to SEQ ID NO: 3760

SEQ ID NO: 4918 - DNA, 198 bp, Cicer arietinum
gttcattctaccaatatcgctgtgtgatggcaatgagatcggcgctgagtcgagggatcgtgactcgttcgatggactcaacatctcgtggagctttcagtcgtttctacagcggcaaaggtaagattcttagcgaagaggaacaagccaaagaaaacgtctacatccagaaatgggagcgggaaaggttggagaaac

SEQ ID NO: 4919 - DNA, 430 bp, Cicer arietinum
acactaacgttagttcgacgttaagtgcttcggtggaagagaaaaaaaacgcggtgagtggtaatttggtaaaaaactgggttgaaccgggtaaattctttagagaaaaaatgttgaaagaaggaacagttatgcctatgcctgacattagagataaaatgcctgaaaggtcgtttttaccccggagtattcttgcgaaattacctttttctacctctaagatctatgagatgaaacggttattcaaagcttcggataatggttctatggagaaaatgatgagagattctttaggggaatgtgagagagttccgagtcgcggtgaaacaaaacgatgtgtgggctccattgaggacatgatcgactttgcaacttctgttttaggcagaaacgtcgtcgttcgaacaaccaaaaatttaaacgggtcaaa

SEQ ID NO: 4920 - DNA, 225 bp, Cicer arietinum
actaggttgaattactattgcgacgctgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcactatgaacgcttggctgccacaagccagttatccctgtggtaacttttctg

SEQ ID NO: 4921 - DNA, 270 bp, Cicer arietinum
actgcccttccaattcaggttcttcttactactactgaatgggatgaatgccagtcctggttaggttcacttaagcgaatgatcaaaacaaggcagagcgtgagactaagttaaaaaattacagattttgttttgctgattttggagaattttcatgtgattagtatctcttgaagtagtgattgtggatactctcatcattgtccaaaatactactgcctctagattgcaggtgcagggttttgattttatgcacttctaccatttcta

SEQ ID NO: 4922 - DNA, 131 bp, Cicer arietinum
accgttgtttccttggtggtctagcctggaccaccgacagcgacgccctagccaaagccttctcttcctacggcgaagttactgattccaaggttattaacgaccgtgagactggaaggtcaaggggtttt

SEQ ID NO: 4923 - DNA, 441 bp, Cicer arietinum
gttggaaggaattgagaatcaaaatcgaaatggctattatggagaggttgagaatgcacgttgctcaagaaccagttctcgctgcttcctgtctcatcgctggctttggtctttttcttcctgcgtttgtgagacctatgctggattcatatcagacaaccaaacaacctcctcaacctgctttgagcgacgtggttgcaggtatgactggtaaaaagtaagctgatttacttgagatacaaggggaaaattgtcaacctctctgcttgaactttttttcattgtgagtaataaaattgcccagttacaaaacatttgattgagcatccatttgtgacaacctatcagttccagattcgtctagtggcttcatttcatatttaggttaagtgttgggatgaatgtctgcttattgtgctgcctgattgattttgcctctac

SEQ ID NO: 4924 - DNA, 428 bp, Cicer arietinum
gaacaacataaccaagatgttaactctttgggtttgatttcatctagaaaaacaaatgaggctattgagatcttaaagttgatgtcttcaactttcttgattgcactttgtcaagcaattgatttgaggcatttggaggagaatttgaagaacactgtgaagaacactgtgagtcaagttgcgaagaggacgctaacgactggcgtgaatggtgaactacatccatccagattttgtgagaaagatttgctcaaagttgttgatagggagtatgtttttgcatatgttgatgatccttgtctctctacataccctttgatgcaaaagttgagacaagtgcttgtagatcatgcattggtgaatgttgatggtgagaagaatttgaacacatcaatatttcaaaagattgcaacttttgaggatgagtt

SEQ ID NO: 4925 - DNA, 328 bp, Cicer arietinum
tcaccaaaaaggtttaaactacatggtgggtggtgataacaactctctgacacacaatggaaatcatttatcagcaacaagggcttcaattttgtttacaatgtgagcttcatgatcctcaaggcgacctttgatcgaatcattctcccaacggatcaacgttggcacacctgtgagcttgaacctaggatccaccctccatggatgttttgagttcctccatgttggtctatctccaacataagctttcaaaagtgcaatttcatttgatgatgtttccagcttcttgtagatcacaggctcagctctcacacaatcagggcaccag

SEQ ID NO: 4926 - DNA, 418 bp, Cicer arietinum
acaaatcctgctagtgctgctatgtgtggaatgaaaattgtcaccataggaactgatgctaagggaaacattaacattgaagagttgaagaaggctgctgaaaaacataaggacaacttatctgcatttatggtaacatatccttcaactcatggtgtttatgaagaaggtattgatgatatttgcaagatcatccatgataatggaggtcaagtatacatggatggtgcaaacatgaatgcacaggtaggacttacaagcccaggttggattggagcagatgtttgccatctcaatctccataagacattttgcattcctcatggaggaggaggccctggcatgggtcctattggtgtaaagaaacacttggcaccatttttaccctcacatcctgtggtgccaactggaggaattc

SEQ ID NO: 4927 - DNA, 436 bp, Cicer arietinum
tctgaacggagacctctcttctggtcaccttctaagctgcaatcatggctgatggaccgcagtatccatcagttgctcagaagttagctggacattcttatctggtgtccaggcttagccctaactataactccagaaactattctacgtctggaactttcaccaatggtggcctgcagactccgggattggcatttgcgtcacatctttcatcaattactgtgccttctccagcagagaaaggagcaactgggtttatggtggattttctgatgggaggagtgtctgctgctgtgtcaaagacagctgctgcaccaattgaacgagtcaaattacttatccaaaatcaggatgaaatgctcaaaagtggcaggttatctgagccatataagggtattagtgattgttttgctcgaaccatgaaggatgaaggtgt

SEQ ID NO: 4928 - DNA, 349 bp, Cicer arietinum
actattaattaacagcagaacagactgctttacaactgtcaaaataaataaaaagctaaaatacataacagcttaaagaaattagagaaaaaaaacacaataacaatcttatcaccatataatagaaaaattaacgccttttctttcctgaagacaaaacgcggaaactttgcttcccttttttctctttcgatgtatcttccttccatcactttctttattttcatatattcttcataatctttcatagagagctatggtaataaaccactattattgtttactatctaatagtggtaaggaggaggaggtgaggaatagaggtaaggcttcttggttggagttggtg

SEQ ID NO: 4929 - DNA, 420 bp, Cicer arietinum
gattactacggtggaactggtggtggttacggtgttcctaccagttatggcggagggtatggtcaaggtgtgactagtgcttgggattagtgtagtgtgacatcactaattcattctcatgttgagtgtatataaacttaagactttaacattgtaaagttgtatcttctctaccatggtttgcctgaatccatgcattccttactacaggaaatcttttttcataggaaagatctacaattggcttggttttgctggttaggcacataggggttggttgggaaatgctgcatatggagaaagagaaaatgtgtaaacagcccgaaaatttctgacttgattactcatctgagtttctgtagaagagagagtgtaaactgattgctttggagactaaagtggtaagggctgatataagtg

SEQ ID NO: 4930 - DNA, 125 bp, Cicer arietinum
ggcatccgaacttcaggagggagcatgatgacctctatattgatcacaatctgagcttaactgaggctctatgtggcttccagtttactgtcacacatcttgatgggaggcaactattggtcaaa

SEQ ID NO: 4931 - DNA, 283 bp, Cicer arietinum
acaagtagctgcaattcaagtaatgaagaaaacaaatgaaactgagttgatgaataataatattaaggttgaagagacatgtcagtctcagtctcagatatcttcttgtaatgtgaatcctgcggtgtttcagggtgtattttgccgtgaccttgcggtggttgggaatttgttaactcaggtgggatttaatagaccgattccggtgaagtatgaagctttgagctgctaattttgatattggagatgttacaggcagagggaatctctggttcattattgt

SEQ ID NO: 4932 - DNA, 346 bp, Cicer arietinum
actcatagttgatatcaatgccatctattatgttaaagctccaaggatccttgacttcgttgtattgctggatgatctttttgagtgagtttacagcattgtcaggccattctacttttgaagcaggattgaatggatgtttatcaccacgaccaccgatgcttattacaaccttcacatttttatgattttgcttgagttccttcactttttcaggactgaagaaatgaacgttccaactggggttgaaaactcctgtgccttttccactatcatcgtaagtctctgtggcaaagcctaaaatgaagtggaattggtggatcttggagttgatgatatcagtggg

SEQ ID NO: 4933 - DNA, 427 bp, Cicer arietinum
acatcattttaattcgtctaagatcgagaacaaccagctaattagcccaatgaatctatgaaaattctagtaattaattaattaatctcatatataattgggatatgaagaaagaagattactaggtatgcatggagaattcctccaaaccctagcatgcatcttaagtatctcacttgctttctctttagtcttacttccacaatcaacttgaagaaccaaacaaagtttagccacaacaccaagtttaagcatttcttgaacaacatttggagttgcagagaaccttgaaacagataacagaatcctcacacctcgatcattcgccacgctcgaaacccttagaatcttcttcgatactacagctagccctgctccatgtctcaaaagttcagctcttccttcagcacactgacaaagattctcc

SEQ ID NO: 4934 - DNA, 268 bp, Cicer arietinum
acttcgttcagcgcttgtattgattaaaggttgtcgtagaactaaggaactattgacatccatcgccccggcaactcagtcatgtacctccagcctcctataccttggcgcagtttatttgccgcagttcttgcaagagcagctctggccacaggagcaagagctaggaccgccgcagttacaagtagatccacaatcgcaagccatgatgactgacgtaaagttatagagttgtatgtgacgagatagtgacttgagaaatttgaat

SEQ ID NO: 4935 - DNA, 165 bp, Cicer arietinum
accaggtgctgttgtagcacttcatggaagatttgagattctatcattaacaggtgcatttctacctggtcctgctcctccaggtgctacaggactcacagtttacttatctggtggacaaggtcaagttgttggtggaagtgttgttggatctttgattgctgc

SEQ ID NO: 4936 - DNA, 435 bp, Cicer arietinum
acaaaagcaccattttccattttacacttacattcttatcttagcaatagcattgtaaacaaaggatttaaatgaagatgccaataatatataatccttgcttcgaaaactatatatacctcttatttttcacattttcttaatataacaagttttagaaacgattgtcatcatcggcaggaggataccctgggtggtgaggtggcttctcatatggaggataccctgggtagtgaggtggcttctcatatggaggcccgtaaaccggtggtttctcaactgggggcttataaactggaggctcttcaattggtggcttgtataccggaggtttctctacaggtggtgtgtagacagggggtttctcaattggtggtttgtatacaggtggcttctctactggtggtttgtaaatcggtggtttctcaactggag

SEQ ID NO: 4937 - DNA, 134 bp, Cicer arietinum
cagagagagggagagggagaaagggagagagcgagcgagttcaagcttcatcaagatgggtatttctagggattccatgcacaagaggcgtgccactggtggcaagaagaaggcctggagaaagaagagaaagt

SEQ ID NO: 4938 - DNA, 428 bp, Cicer arietinum
gcaaaagattctacccgccgctcaataggaattgcgcttcaaggtgtcccgcaaggctcatccgccttacgaggtccaccaacgacacgtgcctctggggggccaaggccccctactgctggtcggcaagcgaacgacgggcacacgcatcgcttctagcccggattctgacttagaggcgttcagtcataatccaacgcacggtagcttcgcgccactggcttttcaaccaagcgcgatgaccaattgtgcgaatcaacggttcctctcgtactaggttgaattactattgcgacactgtcatcagtagggtaaaactaacctgtctcacgacggtctaaacccagctcacgttccctattggtgggtgaacaatccaacacttggtgaattctgcttcacaatgataggaagagccgacatcgaag

SEQ ID NO: 4939 - DNA, 440 bp, Cicer arietinum
acatctgagtagttacccctacgtttctgcttatttgattgttctctttttttagatattcaatttggttgttaagatcttccatgtgttgttgtttcttcattcttgatcttcgtgccgattccctattcgattgcattctcttccttttcttttgatccataacatgcacctgttgttgttgaatatctccctctgatccagatccagagttttgaagagagcttgttccagatgaatatgctccaccaggagaagccataggtagttaggttttaaatcgcggtcgcgagttgcgatctttgatttgattgatgcagcctcaattgcagatgcgactgttcgcttaagactcaaaaactttgatgtggcgatttagatagtggtaattagtatttaattagatagttaaattgattagatagatagaatgaaactag

SEQ ID NO: 4940 - DNA, 435 bp, Cicer arietinum
ctttatgagacattggcaatcacccagagtgttatttttgtgaacaccagacggaaggttgattggttgactgacaagatgcgaagccgagaccatacagtctcagcaactcacggagacatggatcagaataccagggacattattatgcgtgaatttcgttctgggtcttcccgtgttttaataactaccgatctcttggcacgtggtattgatgtccaacaagtgtctctggttattaattttgatctccctacacagcctgagaactatctccaccgtattggtcgtagtggaaggtttggtagaaaaggtgttgctattaactttatcactaaggaagatgaaaagatgctgtctgatatccagaagttttacaatgtgatagttgaggagttgccatcaaatgttgcggagctcctctgatgagatttt

SEQ ID NO: 4941 - DNA, 180 bp, Cicer arietinum
acagagcttacctggagaccgtggaatgaggcgactacctcgtccacagagcagcgttctagccaccttggggttttctcctgcaagggttttccccaaggatgcacggtcctaggttgcagctactggcgatcttaggggatcatggacttcctgcctcgaggtatggaaagctacttg

SEQ ID NO: 4942 - DNA, 437 bp, Cicer arietinum
tgatgataaagctaaagcgttattgaagaagatggaaggtgaggacttaagagagaatcggtgggtatgtcgaacgttgcttcccctctatgcaaacttggggatggccgatgaagttggaagagtttggaaggtctgtgagacacaccctcgaattgaggattgttttgctgcaattgaagcctggggtaagttgaagaaaattgatgaatcagaggcagttttcgagatgatgtcaaagaaatggaagcttacgcccaagaactgctcagtgctactgaaggtttatgcaaaccataagatgctagtaaaggcaaaggatcttgttaagcgaatggtggatagtggatgtcgattaggtcccttgacctgggatgcattggtgaaactatatgtccaagcaggggaagtggaaaaggcagatactgttctgcaga

SEQ ID NO: 4943 - DNA, 372 bp, Cicer arietinum; identical to SEQ ID NO: 3326

SEQ ID NO: 4944 - DNA, 238 bp, Cicer arietinum
caaattaaccctcctcatggtttgtgccttgagaaaattggtaatggatcttatctcaatatggttgctcatccagatggatcgaaccgcgcgtttttctctagtcaaatgggaaaagtttggttggcgagtataccggaagaaggatcgggaggacaattggagcttgatgaatcaagtccatttgttgatctgactgatcaagtttattttgatacacaatttggaatgatgggga

SEQ ID NO: 4945 - DNA, 256 bp, Cicer arietinum
  misc_feature (3)..(3): n is a, c, g, or t
tancgtggtcgcgcccgaggtaccctctgtgccccaccaggcatatcatcgtcctcatcatatgcctcttgctgttgctgatgctgcttcctcctcgtctcctcttccatattgacatcatgaagtgcagcttcctcacactcgtccagctccatatctgtcaactgcgatgaaggtttagctggcaaaacagcttccaaacccttcacctggtcaagactaacagtctcagggaactccactgtaaagtgcatat

SEQ ID NO: 4946 - DNA, 438 bp, Cicer arietinum
gaaaagtatagaaaagaaaagagaaagaaatcaaaagaaaaagaaaaggtaggttggagagaatatagcaaaactgcataaagcatcttcatcatcatcaccacaagaaaccgttgttcgatagatctgtggagaacaagatgggacacaaccagaaccaaaaatctctgatctacgctttcgtttctcgaggaagcgtgattcttgctgaattcaccgaattcagcggtaattttaattcgatcgcgtttcagtgccttcagaagcttccagcttcaaacaacaaattcacttacaactgtgatggccgcaccttcaattacctcgtcgataatggatacacgtattgtgttgttgcggatgaatcagttggaagacaggttcctgtggcttttctggagcgtgtgaaagatgattttgttgtgaaatatggcggtg

SEQ ID NO: 4947 - DNA, 147 bp, Cicer arietinum
aacagttcatgatgtttgttggatgattctaccagcttttttaggctcatatcctcgattttcgtcatgtagccactatctgtttcaatgggcgcatcatccacgaggcaaattacagccaatgacttctcctcaagctgaggaata

SEQ ID NO: 4948 - DNA, 410 bp, Cicer arietinum
acgttccaccgcgccgatgcgttgatcgtcagctaggtcgatgctgcggccgttcggcgcagtcctctcgtggctgtgcagacgtaatttttcttcctcactctgttggttcttgagtgagctgggagttctcgaaagaggctgccccagaagcaaacaatgtcaacgcatgagaaccccatctgtcctgacgatgggaccccgtctcttgcagacaatatctggatgtggttcagggcctggcgattgatgaaggtctagactagccattacgaagtatgaggtggatgatgaaggacagtcatgagcaacgatttaatgaaggaaatagcttagctgtctaggatagatgacgattgaatctattcatgaaatgaagaaaaaggggagagaggtgagagaaagcttgt

SEQ ID NO: 4949 - DNA, 438 bp, Cicer arietinum
ttcttacacaggacgagatggctcctgcaaatttgacaaaagcaagattgctgcttccgtatctaatttcagtgttgtttccgttgacgaagaccaaattgctgcaaatttagtaaagaatggccctcttgcagttgctattaacgcagcctggatgcaaacatatatgagtggtgtctcatgcccatacatctgtgcaaaatcgcgtttggatcatggggttcttctagttggttttggaaatggttttgctcccatccgattgaaggaaaagccttactggatcataaagaattcatggggacagaattggggtgaggaaggatattacaagatctgcagaggtcgaaatatatgtggagtggattcaatggtctcaactgtagctgcagttcatgcatccaacaattaataatacggagatgctggttctggtgg

SEQ ID NO: 4950 - DNA, 293 bp, Cicer arietinum
accaggttgaattactattgcgacactgtcatcagtagggtaaaactaacctgtctcacgacggtctaaccccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 4951 - DNA, 408 bp, Cicer arietinum
acaaaagtaccattttccattttacacttacattcttatcttagcaatagcattgtaaacaaaggatttaaatgaagatgccaataatatataatccttgcttcgaaaactatatatacctcttatttttcacattttcttaatataacaagttttagaaacgattgtcatcatcggcaggaggataccctgggtggtgaggtggcttctcatatggaggataccctgggtagtgaggtggcttctcatatggaggcccgtaaaccggtggtttctcaactgggggcttataaactggaggctcttcaattggtggcttgtataccggaggtttctctacaggtggtgtgtagacagggggtttctcaattggtggtttgtatacaggtggcttctctactggtggtt

SEQ ID NO: 4952 - DNA, 434 bp, Cicer arietinum
accgagtagaccacttggataagttggttgccaaagctataactgatagttttggcaaaggaatatggaaaaaggctataatagcactcacccatgcccagttctctccaccagatggattgccttatgaagaatttttctcaaaaagatctgaggctctcttgcaaattgtcagatcaggtgcctccttgaagaaggatgctgctcaggcttctgcgattcctgttgttttgatcgagaatagtgggagatgcaacaaaaatgaaagtgatgaaaaggttcttccaaatgggattgcttggattcctcatctggtcaaaacaatcacagaagttgcactgaacaaaagtgaatctattcatgttgacaagaatttgattgaaggaccaaacccaaatcagagaggaaagttatggattcctctcatatttgct

SEQ ID NO: 4953 - DNA, 368 bp, Cicer arietinum
accaaaggccgacgatgcttatctctctgctctggtattatgttttagtcggatttttcccgcaatactaaatgctgctgttgatctcaatttgtttgatatcatagctaaaacacaaagttcacatggttcaagcttatatgcatctgaaattgcttctcagcttcctaatcaacaccctgaattgactgataggctcgagcgcatgttgcctgtgttggccagttactctcttcttaattgctccattcgtattaatggagagggtaagagagaaagagtttatgctcttacaccaattggtcaatactttgcccttgataaagatggaggctctttgggtccactctcaacattaggacctgccc

SEQ ID NO: 4954 - DNA, 396 bp, Cicer arietinum
acccggatttttggggaaaaacggtgtggccacaagtgatttgagacggatactacgacttgatttggaatgattaattgatttcgtttgttaggtgttttgattactttcttccgaagtagacgatgaaaattggtggttgtttgtctgtttgttcgtatggtccctaacgtgcatcctttattttttcaagaggatttgccgtagggtgcgaacgcatgaagaagcgttgaaagttgaaagtcaagtgaaggtttgttgtttcagtgttcagttcgtgatagaagaaataatcaagttaggttttgtggttagttcatacgttgatgaccgaagggatgtaacttttgtaatttcctctagtctgatatacgtgaatctatagtgtttggattt

SEQ ID NO: 4955 - DNA, 414 bp, Cicer arietinum
actccaagaaggccttgggctaccgaaacttatatttttgctatgtttgatgagaatcaaaagagtccggaattagaaaaacattttggagtgtttaatcctaataaacaaaagaaatatccgtttggatttggtggagaaagaaggaatggagaaattgtcaacgatgacttcaatgcaactacggtttctcttaagagtgatatgtaagacgaaatagcgttttaaaatatgagtaatttttatctataaaataaatttaaaaaaattatcatgttagtatgtatgttcatttatccttcaattttagtcgtaaaaattgttgggttgttggatcttttttattttatatatctatgtatctcgtagtaaaaaaatatcaatgtatattatttgagttgatcaataaattga

SEQ ID NO: 4956 - DNA, 312 bp, Cicer arietinum
acgcgggcacggaattggaagcagcccgtgcttgttgcactgtcatattcgcaacaaatactggatgaaggagtaataccaattacttcaactgatgttccagttgatgctcttgtatctccagaaggtgtagtccccatcagttctgctgccttcaacaggatggatctctaagctgcacttaaagccgatgctgaacactttcaatggatgatgtattatttatcttctataaaattttgtggtttcttaagtattcagtgctaatggaggggtctgatcgaggggctttgtgtaacaaggaaaaagggt

SEQ ID NO: 4957 - DNA, 430 bp, Cicer arietinum
acatgaatttctcgcatcctttgatcaaagctcggtttaatccaaaggcttgtgcatgggcttatggaatgaatttctttgatttggatgcttggagaagggaaaaatgcacagaagagtataattactggcagaatctgaacgagaaccgaacactatggaagttagggacattgccacccggtctaatcacatattattcaacaacgaagccacttgacaagtcatggcacgttttgggactcggttataacccgagtataagcatggatgagattaataatgcagcagtggtgcacttcaatggtaacatgaaaccatggcttgacattgcaatgacacaattcaagccactttggtcaaagtatgttgattatgagttagagtttgttcaagcctgcaattttggcatctaaaaatggttttaagt

SEQ ID NO: 4958 - DNA, 120 bp, Cicer arietinum
actctttcctttatttgtcactaggatagtttcattgcatactttcttttaagtttatgaagcaaattgatgtttaggtcatgtttcaaatatttgctatagaatatggttttatttgtg

SEQ ID NO: 4959 - DNA, 151 bp, Cicer arietinum
acagtgtggttaacgagcaaagcatagtaaaaaaactagagtcctctgaatttccactcacttaccatctaggagttctaggatttagtggactgacagcttatgggggatttttcgaaatttgcaaaccccgaaagggtgaaaaagtatt

SEQ ID NO: 4960 - DNA, 359 bp, Cicer arietinum; identical to SEQ ID NO: 648

SEQ ID NO: 4961 - DNA, 280 bp, Cicer arietinum
actttgtcaaaatccgttctgatataggtggaggaaggatctttgaagcaagtcccttggcagcaagatcctgcattgtaatttgtacttttttttttttttttttttttgggaaaaaccttttaaactgaaagaggaaccaagttacaaaaaaataatgtagttattatttattaaaccagcaaggaaaacatcaacttcggatgtcttgctacaccttgaagttctggaaatcaataaccccagttaccattcctaatctcatcatcaattttctgct

SEQ ID NO: 4962 - DNA, 330 bp, Cicer arietinum
accatggaggtgttaatttggtgtctgatggttatagtaaaggcactgctttgggtgctgaaattattggtacatgtctgacttgcgacccaattgcttctgtgggagaataacttgcactgaatgactgtcattggtgtttgggattgggtggctcatgatggctattgcccttgcaaccttaccaactttcctcaccttgttgggcaagtatgatggatcacaaacaacttttttgcacttggcagtttccccttcagacgacacaccaataacctttccttcaccatcaaattcaaccttgcattcaggtttattcaacatgtatgt

SEQ ID NO: 4963 - DNA, 125 bp, Cicer arietinum
actcataagcctattttccattttttttaaaaagcctattttgaaactttaagtttcaatttcaactaattaaaaaaaaaaaaaaaaaaaaaaaaaaaaaaaagtacctcggccgcgaccacgct

SEQ ID NO: 4964 - DNA, 150 bp, Cicer arietinum
tacttgctcataatatcttagttctcacactagcaatattcttaattcatcatcatgggtgttttcagctttgaggatgatgccacctcagctgtagctcctgctactctctacaaatctctacttacagatgctgacaaccttactcca

SEQ ID NO: 4965 - DNA, 404 bp, Cicer arietinum
acgcgggggttgaataaatgtggtgttattagtccacgttttgatgttggtgttaaggagattgaaggttggactgccaggcttctcccttcaagacagtttgggtatattgtcttgactacctcagctggcattatggatcatgaagaggccaggagaaagaatgttggtggtaaggtccttggattcttctactaggctagttttttattaaggatcttttctatttcagtttttgatttaccgaatgtaatggaggatgtactagtatcttacaaatatcaagcttagctgaagctgttttgggatgtgatttattttgtttcgtgaaaccaagttgattactattatttatcggattcctttgtcgtttcttttattatacaagagtgtattgacagttc

SEQ ID NO: 4966 - DNA, 155 bp, Cicer arietinum
accatggtttgtgtattgctgctatttatataatgaactatatagcaagcgcgtaaaaataataattctgcatgttaattttcttgccagctggggaagtcattatcattattagttataacatattttgcttgaaaaattgacattctagaagc

SEQ ID NO: 4967 - DNA, 192 bp, Cicer arietinum
acagaaatacccactatcagccatcagaggtggcatctgttactgatgaattagggataccttctgttcctttggatgagctgctggctgatcttgatctgagtgaggatgaagatgaggaggataacatggcagaataagcaaaaattacttctattccgaaatagaaatttatatattgatgtcaagggt

SEQ ID NO: 4968 - DNA, 364 bp, Cicer arietinum
gcaagtttttaccttattgatgatactttattgtggactaaaagcacacattaaagtggtaactttggtcttcaacattacacttgattaaattaaagtgagggacattaactcctcaaacatttatgtttctttttagcacttggaagttaattttataaatcaccaacactcaaagaagttaatatcaacacgaagtcgaaaataaacttcaccttcaaatgcatcagtcataatagtagcaattcctctatgcataaagaaatcaccagttccaccaataacagagatatctctagttttcttcaaaattgggacagcaccagcaaaagtaatggttccttcatattgagtgctattaaga

SEQ ID NO: 4969 - DNA, 111 bp, Cicer arietinum
atcactaggaatcacgacactttgaattttaaaagatgattggttttacaatttctgtttttttacaacctctaacattaaagagaattgaaatacaaataacaaaaatgt

SEQ ID NO: 4970 - DNA, 409 bp, Cicer arietinum
acacttattgggttagaaaaacgacggaagatgcggcgccattgcctctgccacacaagctaaccacacaagattcttctcaatctcatcaccttggctctgcttggaatcgcgctgggacatgggaagagaaaaatcttaacaattgggctattccaagaattaaggagctgctcgtttcagtaggctccttaccattctcctccggcagagcacaagtggaagatgtgacaaactgtgttggagatgcatttatggtggtggttcggaacaagaaacgcgtcagtttcacgtatgagctgtccctaaaagtgaaaggggaatggattatacgtggagataagaggttgcttggcgggcacctagatgttccagagatctcattcggtgaactggatgacttgcagat

SEQ ID NO: 4971 - DNA, 424 bp, Cicer arietinum
actggacccaactctgatcagaacttatttactattctatcgcactgtaaccaattacggtctggtagttcttatgattcagtcagaaatagtgaccagtttcttgcaccaagaacttatggagtagatgcaagcactaccagtgtgaatgctactgctgcaccacaggcttcccttccattagattactttgctggacgtgagtcggcggcacctggtggagtggtgcctgatgacatgacatggatgaatttgcaacatccgaattctgcgttaaatgatcaaatgggaaagccgtatttaaggtcatggaaccggtaatggatgttctactttcaccccatatgtgatagcattttgtgatttagcaagatccttagaagcttggtatacacccttagatgagaaggtttctgtacctgcc

SEQ ID NO: 4972 - DNA, 424 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctcgg

SEQ ID NO: 4973 - DNA, 431 bp, Cicer arietinum
acacgcattacctcatcaaattataatccattaattgggtggatgcatggagctcagatggttgcatttaacatgcaggggtatgggagatctctttggttgatgcagggaatgtttaaagccaatggaaggtgtggttttgttaaaaaaccagattttctattaaagactggtcccaataatgaggtttttgatcctaaagctcctttgcctgtgaaaactactttgaaggtgactgtatatataggagaaggatggtattatgatttcaagcatacacactttgatcaattctcacctcctgatttctatgcaagggtggggattgctggagtccctttcgatactactatgaaaaaaactaagtcaatagaggataattggctaccttcttggaatgaggtattcgagtttcctctttctgttccgga

SEQ ID NO: 4974 - DNA, 366 bp, Cicer arietinum
acagagcttacctggagaccgtggaacgaggcgactgcctcgtccacagagcagcgttctagccgccttgggtttttccctgcgaggggtttccccaaggatgtatggtcctaggttgcagctactggcgatcttaggggatcatggacttcctgcctcagggtatggaaagccacttgatctatctgtgcaagagaattctaggctggagaggaatagatcccgctgacgggatgccctcttgaaagtaaatgcgcctttgtgccgatgatatgctggatgaactagatgggagacgctgctggagggaagctctgcgaggatcaactgtattgatgtccaatgggacgtgcttcaccgacaagt

SEQ ID NO: 4975 - DNA, 391 bp, Cicer arietinum
acgagtcgcatgctcccgttcgccatggcggcagcgggaattcgattcggccgcccgggcaggtacccattttggaggtggcaaatcaaccggttttggtttgatttacgatacagttgagaatgctaagaagtatgagcccaaatacagacttatcaggaatggtcttgacaccaaaatagagaagtcaaggaagcaaatgaaggagagaaagaatagggccaagaagatccgtggtgtaaagaagaccaaggcctctgatgctgccaaggctggaaaaaagaaatgagtttttagttgtcgtgtttgtgctttaaggttgttttgctttccaagtttttttgatagctatgttatctcatgcatggtctacaaaatgagatattttggt

SEQ ID NO: 4976 - DNA, 427 bp, Cicer arietinum
caagctcatggatacaagcaacaaaggcaagattaacattgatgagctgcgaataggattgcataaactaggccatcaaattcctgatgcagatgtccagattcttatggaagctggcgatgtagacagggatggacacttggattatggagagtatgttgccatttcagttcatttgagaaagatgggaaatgatgagcatcttcacaaagccttcgattttttcgatcagaaccaaactgggtatattgagattgaggagctgcgcaatgccttatctgatgaaattgaaacaaatagtgaagaagtgattagtgcaattatgcatgacgtggatacagataaggatggaaagataagttacgaggaatttgcttcaatgatgaaggctgggacagattggagaaaggcgtcaaggcagtattcg

SEQ ID NO: 4977 - DNA, 437 bp, Cicer arietinum
actttcacaaggcaccggacaaggaagagtttcacagagaaacatgccgcaagattaaagcactccaccaatatgattgccagagagccaataaatcaacttttgcttggggtctagaagctagagtacgcggggaggccacctcaattgtagctcctgctactctctacaaagctctagttacagatgctgacaaccttactccaaaggttattgatgccattaagagtgttgaaattgttgaaggaaatggtggtcctggaaccatcaagaaatccactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaat

SEQ ID NO: 4978 - DNA, 155 bp, Cicer arietinum
acttgagcagcaaactgcaaattccacaaaacatcctctatggatggcctttctgctggctctttaatcagacacctcacacaaatctccatcattgtcttcaatgattgatccaagcaagccttgcgaattgcttgatccacaatgctcctccg

SEQ ID NO: 4979 - DNA, 293 bp, Cicer arietinum
accttcatacttacttactggcaaagaaggtcctaatgctccaaagggttgcagggtgctggacccggctgctactccatgtgaacttctcgttgtaataaaagttgtggaggaggaaaacatggccgacgtcatggatagtgtaacgaaagaaactaattgcgaggaaatggacattgataggagaaaacttggcggagcaaaggagggaaagatgaaagttatccatgtaatagaatcttcagacgaagacagagggaagaagatatgcagaggcttgtagcagtgacggt

SEQ ID NO: 4980 - DNA, 298 bp, Cicer arietinum
actgttaatttacgatcatgcagtgcaacattttcaatagctataacagagtaaaggaaccacgactatgttctgtttcactatccaggaactaggatccaatgtagcatctactcggaatcctgcatattctgagtaggagcctctgagcccttagtgagtgatagcttggttggaggtccatcaaacagacgggaacattctgtgtatgcagatcctattccaactccagcaccaaaagcaatggatgcccagcgagtctgaggactcctgaaaaagaggagaccgccaaatgcac

SEQ ID NO: 4981 - DNA, 428 bp, Cicer arietinum
tcttaattcttcctcatgggcgttttcagttttgaggatgaggccacctcaattgtagctcctgctactctctacaaagctctagttacagatgccgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagc

SEQ ID NO: 4982 - DNA, 422 bp, Cicer arietinum
cggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctctttttggatccaaggctgacttcggttggccaatccgggcggaagacattgtcaggtggggagtttggctggggcggcacatctgttaaaagataacgcaggtgtcctaagatga

SEQ ID NO: 4983 - DNA, 318 bp, Cicer arietinum
acgcaatatgtccatcgaaatggatgcagaattgtttgaagagtgtcagaggcatcatacagagaaacgggcaaaagccaaagatgtggcagagcagcgggaattgaactggaagagactggcagaagcggctgcacagaacggcgtggcagatatggtcacagattagtcttgctagttttaatgcctcagctctggaagtgtgaattaaatatgtggaggatgatgaatatgctcctctttttcattttggtgcaattatttattggtttctttttttttttgtcagcctaattctttgctcctcttccttctcct

SEQ ID NO: 4984 - DNA, 237 bp, Cicer arietinum
acttccatctaagactgatacaacaagaggattatctttgagttcatcggcgatggcgaggatatagtgtttgaggatttgagaagcctttgaaggagcgtattgagtctcagtggataaggaagcttcggggttactacggaggcggttgaggacagaggctttgagaggatcgggtaatggaagaccgaagagagaaagagaagcttgtgaatgtgcaatgtcgagtatttgagc

SEQ ID NO: 4985 - DNA, 438 bp, Cicer arietinum
acattagtgatgggtttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagttaataattaatgtaataaatgtgtgctgtaatatatatgtggtcgcggtttgcttgggttcttaatgaaataaaagtatgac

SEQ ID NO: 4986 - DNA, 112 bp, Cicer arietinum
acaacgaatttattccctagcacagctaaacaactagttgctgccattgacgggcttccagatcctggtggccccacagttaaagacgataagcgtgagtctaacttcaaaa

SEQ ID NO: 4987 - DNA, 434 bp, Cicer arietinum
  misc_feature (42)..(42): n is a, c, g, or t
  misc_feature (61)..(61): n is a, c, g, or t
  misc_feature (295)..(295): n is a, c, g, or t
catgctcttcgccgccatgggaaacgcgggaattcaatttcnagcggtcgcccgggcaggnacgcggggctgcaattattaaagccagaaagctttcaagtgcattatctgccgctagcgctgcttgtgaccacattagagattgggttcttggaactcctgagggaacctgggtatccaggggagtttattctgatggatcatacaatgtgccagctggactgatattcatttcccgtcaactgtcgcaacggggaatggtttttagttcaaggactttcaattgatgagttcncaaggaaaaaattggactcgacagcagaagagctttctgaggagaaggctttggcttactcatgcctctcttagacggcttgtttccttgtttagtgtcaatggaggctccattgtttgtcaatttttgaataatgctg

SEQ ID NO: 4988 - DNA, 144 bp, Cicer arietinum
acaacaaaggacttgctttcactgagaaagagagagatgcacactatttgcgtggtctcttacctccctcttgtagcacccagcaacttcaggagaagaaacttatgaacaatatccgccaatatgaagttcccttacaaaagt

SEQ ID NO: 4989 - DNA, 162 bp, Cicer arietinum
actatgttgaatgtggcgggattatccaaactttttctgtagtattttttataatggactttgtattgcaatttgagggtggtagttttgctctctttttcatataatgaaaatgttaaccctgttattttgtccctatttaatctaagtaaaatttatttg

SEQ ID NO: 4990 - DNA, 131 bp, Cicer arietinum
accgcaccattttcctgagaccaatcctgtttggggacggaaaaacaaatctaacagtcaaaacttagatgctgcagctgcatgatccttacttgtttgcaagtttcatggtttgccttatggcgatggca

SEQ ID NO: 4991 - DNA, 366 bp, Cicer arietinum
acgcggggactcagaagaggttcttcgtttctctgtcaaaagatggattgggaaggacaaaagctggcagagcaactgatgcagataatgctgcttgcatttgctgtgatagcatcttcagctggatatttcacagcttcattccaaacaatgattctcacatatgctggtggtgtggttctcaccacattagttactcttccgaattggcccttcttcaaccgccatcctcttaagtggttggacccaagtgaggcggaaaagcatccgaaaccacaaccatctgtgaatgtaactacaaagaagaaatccattaaaaagtaggtttattttacattttgcttatgtgggtatactagtacctcg

SEQ ID NO: 4992 - DNA, 254 bp, Cicer arietinum
acgcggtgttgccatatataaattataaatgtaatttagaaatttgttattcctaattaggaatcagcaagctcttctaaattatataagtatggaaagaaattattgtagaatttaagctatatattaaagagatttatttatataaataggtttgctagctgattgtgtatatacgcaggccaatgcttctaatttcatagcaagctcgcttgctatgaaataggcaaccagtaatataagcaagtgtgtgc

SEQ ID NO: 4993 - DNA, 261 bp, Cicer arietinum
acacctgtgctaacgtgtcaatattcagacggttaagagaattgaagatgtgaccactaggtttgtcattacttttattttatgcactaatgttaatgattttttttttttttttcaacatctacattaatgtattatgaggtagttgtaaaaattattaaattaaaaaaaattactttttaaaatttaatggtctttacaactacgctacaaatatatatcaaatatatgtcgtagagcgtctaaatagttttttttaat

SEQ ID NO: 4994 - DNA, 122 bp, Cicer arietinum
acaggcactccgttacaacttacttctggttgtaagacaacgttttcttcaatttataataaatggtattgtgaccaacaaaaaaaaaaaaaaaaaaaagtacctcggccgcgaccacgcta

SEQ ID NO: 4995 - DNA, 285 bp, Cicer arietinum
actccgaattatcctggtatggtggaggattgttgttgtgattatgaaactgtggacaatcttaacaaggaagtattgtatccgtctctccaagagcttgtgaaaaccccattctttcggtattttaaggtcaagctatggtgcgactgccctttttggcctgatgatggtatgtgccggttgcgggactgtagtgtatgtgaatgctcggatattgagttcccagaatcatttaagaatcccgatcgccttccattgaatgatcctgtttgtcaagaaggaaaa

SEQ ID NO: 4996 - DNA, 230 bp, Cicer arietinum
acgcggggtttttggtcaggtggttgagggaatggatgttgtgaaggagatcgagaaagtggggtccagttctggtaagacctcaaagccggtggtcattgctgactgcggccaactctcttaaacaacataccattgcatatggattgtgcgacgttgagtcttcttcttcttctaaaaacctattttccttttcggttattttatgttatgtcacttccgttgttttc

SEQ ID NO: 4997 - DNA, 399 bp, Cicer arietinum
accaacagcaaggacaacaccgagaaggacggacataccccagagcttggggaggttccgcttgacgggagtctgggagaagggagcgttgtcgtaagcaatggcaagagtagcaatatcagcgaagatagcaatgaaaacgacaagctcaatgttcaagctcctgttgaggatggcgatccagagaccaaggaagatctccatgtggagagacagagcaatacggtagacgacgtaagcatacatacgatggaaaatctgtcttgaagtcttcaaagcgtcaatgatagcaccaagaccaggagcaaggaaaacaatgtcggaggcagagcgggcagcatcggaagcgccctcgacagcaataccagtatcagccttcttcagagagggagcatcgtt

SEQ ID NO: 4998 - DNA, 298 bp, Cicer arietinum
actgttaatttatgatcatgcagtgcaacattttcaatagctataacagagtaaaggaaccacgactatgttctgtttcactatccaggaactaggatccaatgtagcatctactcggaatcctgcatattctgagtaggagcctctgagcccttagtgagtgatagcttggttggaggtccatcaaacagacgggaacattctgtgtatgcagatcctattccaactccagcaccaaaagcaatggatgcccagcgagtctgaggactcctgaaaaagaggagaccgccaaatgcac

SEQ ID NO: 4999 - DNA, 421 bp, Cicer arietinum
  misc_feature (231)..(231): n is a, c, g, or t
  misc_feature (329)..(329): n is a, c, g, or t
acattagactggtggctacaaagcagaagctcgtgatttcttatgttggaaaccatgatggtcaagtgcatgacacaatggaaattttgagatctggagaagttgtcaatggtaatggtaatggcaatggtggtattgatagtgctaaacctgaagttcagattgaagaatccacattgtcgtggtatgtccagggaggaattgttttggtgcttggggcctttatgggcnacattcttggtttcatttcacgtgccaggaagcaacctgagtctaggagtggttttactcccgtgaagaccgaggaaacatgattagtttattacagnttacctcttttttttataggggacggcgaaggttaggaatttagtatcacttgatatttgtttgataaaaacacccgagttgcaacctgata

SEQ ID NO: 5000 - DNA, 311 bp, Cicer arietinum
gctacagcaaataaagtttattatgtctctatgttacatgatttacaatcttattctgtaatgtggcatatggcatatataagaaatgacatctgatcaccaaacttattttacagacaaatatcaacaaagacttatcatcagacaactatcaacaaagacttatcatcgtatcgggacattttacgttcacgatggacaactacaaagcataacgtacctactacttcaaaaggtgaagcactagttgaaactatgaaaccaaaggcagctacaaagttgtcaaagaagaaaaagaagtcagaagaagg

SEQ ID NO: 5001 - DNA, 396 bp, Cicer arietinum
gtttgatgttgagattgatggaaaggctgcaggtcgtgttgtaataggtctttatggcaagacagttccaaaaactgcagaaaacttccgagctctttgcacaggggaaaaggggaccggtaaaaatggaaagcctcttcattacaaaggcagctcattccacaggattatccctagctttatgatccaaggaggtgactttacacacggcaatggaatgggcggagaatcaatttacggagagaagtttgcagatgagaacttcaagttaaagcatactggacccggacttttatcaatggcaaatgctggtcctgataccaatggttcacaatttttcattacaactgtaacaactagctggttggatggaaggcatgttgtttttggaaaggt

SEQ ID NO: 5002 - DNA, 397 bp, Cicer arietinum
gaatcgattttgcagccgcgccccaatctcgtttctcacttcttccctccgagccacccaaaatgactaagagaaccaagaaggccggtattgttggcaaatacggcacacgatatggtgccagtttaaggaagcagattaagaagatggaagtcagtcagcacagtaaattcttctgcgagttctgtggaaagtatgctgttaagaggaaggctgttggtatctggggctgcaaagattgtggaaaggtgaaagctggtggtgcatacacattgaatactgccagtgctgtaactgtgcgaagcaccatccgaaggctgagggagcagaccgagagttagacaaccagtttacattattctcattttgttttctaagtcattgcagaaacttttgt

SEQ ID NO: 5003 - DNA, 138 bp, Cicer arietinum
gaaataagaatatatcatattggaaaaaacattggttcaagcaaaaacataaaatcgtttatacttgcacaagcattaaaggacaccatacacaaaaaacatccttattatattcaaaagcctaggccattgtaaatt

SEQ ID NO: 5004 - DNA, 413 bp, Cicer arietinum
actaataagatacatagacccttaaaaagctaggccaaacttaccctaataattaagtttcgtggcaatacaaaaaaaaggagatatagaacatttaagtgcacatacgagaaaaatatgtaagtgcatatttgattttacgcgaaaatagcaaaatcatgatgaatcattataattttgcaataactataaagtatagcttctacaaaatcacaataactcgccacgattttgttaatccaaacgaaaaaccaaatatacaaaaattacaaattacatccaaatactaaaagcagatccaagaatcattacaaacacaatcaatttgtgaatggatagttggatggaagatgaaggaggaggagcatcacacaaattatatccataccaagtgtcactagggatggaggtgt

SEQ ID NO: 5005 - DNA, 302 bp, Cicer arietinum
acttcgtctacaacgacatcttcaagcttgtcttcggttaatcgaaagcagttacactgccggccggcgcctttggttgtttgaatgagttgagcgatgtttataaacacacaaacacaccaagtggggcgacagacgaggggaaattaaagcggcaatggcaacggaatagcttcttttttgacgataagatgaatttagagcatggcttgaagtaagcgcaagtgtttgactcggctgtgattatcttgaatttcttcccgctgatgaagcggaattattggttcccaaagctatgagta

SEQ ID NO: 5006 - DNA, 102 bp, Cicer arietinum
acaatcagatccgttccgtaggcactctattgccggatcaacaattagagatgacgagagccttgctagctctccatcagttccaagttatatggtgccaac

SEQ ID NO: 5007 - DNA, 430 bp, Cicer arietinum
acatcctcttgcctcttccacttattaaataacacaacggaaaaaagtgggcagttgaccaaagaacttggttcatctcaccgtcggcaacaacactcaaatgaaaggaatgaccattcaaattataaaaaatttaataacggaaaattttgttgtttggcattgccaagaaagagttcctaaattattaaatttagcaattatagagaaaggataataaaattgtgattaagctgaggcatgtgattcatttgcaatcttctctgccttagcaatgacctcgtcaataccaccaaccatgtaaaatgcctgctctgaaaggtcatcatatttgccatccaacacaccctggaaactagtgatgttctccttcaattcaacatattttcctggggcaccagtgaagacttctgccacatggaaaggctgg

SEQ ID NO: 5008 - DNA, 180 bp, Cicer arietinum
gagtttgccttctctgacaacaccttatgtcggatctaatggcggcacctcagaaccagaacgccttagatatcggaggacggtgcccgtggcatcggtagcgacatcctcccgatcaacgacgccgattgcgatgggtttttcccctttgaaggcaagccgcaccgccggcctctgatt

SEQ ID NO: 5009 - DNA, 439 bp, Cicer arietinum
  misc_feature (218)..(218): n is a, c, g, or t
accatggtctaaaaggctgcgagatgttcaacctaatgtccttaactaattcgtccaacaaggactgtgttaaggaatggtatgaaagaatcttgatctccactaaataccataactcttacacctgatttgacaagtgtccctagaagagatacggttggagtatcataaaaacttttgctatcaatcccaagaactacgcaaccttgccataaggnacttttttttttttttttttttttttctatttggaaatgaacagatggaactaagtggaactgtgcaaaagttgatgaaccaatgaacaggaatacagtaaaggtctgattttcagacaatataaagcacaatgaacaaaacattcagctaaaatgtgctgttcagatagaagtataatcccacaagcgcaacaattcccacgacaactgcaattggaagt

SEQ ID NO: 5010 - DNA, 293 bp, Cicer arietinum; identical to SEQ ID NO: 796

SEQ ID NO: 5011 - DNA, 274 bp, Cicer arietinum
ccaggacagtggcattcacacagtgatgacataggatatgtcttctgtgatttttatgttggctgagttcctaaatcaaatgcacagaataaaaaagaaaatgaatgttcaatgattaagcaggactttcattggtttttccttttaggcattcttggttggcagttggtatgctgcagggcgaaataaggagaaaaacaaataaagaaaaataatttagtgtaaggaaaacaagaatcatcagtcttggtttttagtggggtattagtagagt

SEQ ID NO: 5012 - DNA, 266 bp, Cicer arietinum
acgggtctttttgttggtttgaacaagggtcacgttgtcaccaagaaggagttggctccacgcccctcagatcgcaaggggaaaacaagcaagagagttcacttcgtgagaaacctcatcagagaggttgctgggtttgcaccttatgagaagcgtataactgagttgctcaaggttggaaaagataagagggcacttaaggttgcaaagagaaagcttggaacccacaaacgtgccaagaagaagcgtgaggagatgtccaacgt

SEQ ID NO: 5013 - DNA, 436 bp, Cicer arietinum
gactggcctagacagagagaaagctttggttttcttcaaagaacaatcaggttcagctgccaagatgactgttaactctggcatcagaaagattcttccaaattctgaaatttgcgacttcgattttgaaccctgtggttattcaatgaattctgttgagggagctgctgtttctaccattcatgttactcctgaagatggtttcagctatgcaagctttgagactgtgggatacaatttgaaaacaatgaatctgaacgaattggtggtgagagtgcttgattgtttcgaaccaactgagttttctgtagctgttcatgtggacaacgcaagcaaatcatttgaacagggctgtttgctggatgttaagggatactgtcgtgaagagaggagccacgaaggacttggaatgggtggttctgttgtctaccaaaaa

SEQ ID NO: 5014 - DNA, 158 bp, Cicer arietinum
actttgttgaggctggagcaattgctgtgagacgtgtgcggaaagaggatatgcgtcatgttgccaaagcaactggggcaaccttggtctcaacatttgctgacatggaaggggaggaaacttttgaaccatcatttcttggaactgcagatgaggtt

SEQ ID NO: 5015 - DNA, 421 bp, Cicer arietinum
acaacaaccttttgctattggaggatctgggtccagttacttatatggattttttgaccaagcttggaaagatggaatgaccaaggacgaagctgaggaactagtcaaaaaggcagtttcacttgccattgctcgtgacggtgctagtggaggagttgtccgaacagtcataataaactcagagggagtgaccaggaatttctaccctggagatcaactgccgatatggcacgacgaactggagtctcataactcattgctagacattcttggtgccccagagccaatgaacatatgaagttgggactaaagagtcatcggctagattatatcccgcgctgtcagccctttctgtgaactattttatcgaatttgtgtaatcgttatattgttcggttagatattggttgttattatatat

SEQ ID NO: 5016 - DNA, 433 bp, Cicer arietinum
caaagctttacgtgacagagcaccttatcctcccaatcatgttgttggtcatctaagtggcagttttgctttcatactttttgacaaatccacttctaccctctttgtggcctctgatcaatttggtaaggtgcccctattttggggaataactgctgatggatatgtagcatttgctgatgatatagaattgcttaaaggtgcttgtggcaagtcacttgcttctttccctcaaggatgtttctactcaactgctgttggaggattgatgtgctatgagaatcctaaaaataaaattactgcagtccctgctaatgaagaagaaatctggggtgcaactttcaaggtggaaggtgcaacagttctggcagccagagaatagagctttttatgagtgaatgatttctgatgaacaagacatgcatgaggaggg

SEQ ID NO: 5017 - DNA, 294 bp, Cicer arietinum
acggattgagcctagaaagcctcgcatcgaagttaaccaaaaggaatgggatggatttttaaggatttgttttaaccgaaagaacaaaacgcttggcgcaatattcaggcaaaagaatgtgatatctttgcttgaaaagaattacaggactgtgcaggcactgaaaatttcgcaagaaggttcactgaaggaaacagacaccaaagtagacttctccgatttcacaaattttggcgacgatcaaggtatggagatggatgatgacggagtagatgatgatgatgaaatggatgt

SEQ ID NO: 5018 - DNA, 437 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccct

SEQ ID NO: 5019 - DNA, 295 bp, Cicer arietinum
acgtgatggtgtttgccaagtgacatacactctctttgatagagattttgatgagagtgagtgtcaattgccacaaagatgtggaaaatttgggctttgtgaggaaaatcaatgtgttggttgtccattagaaaatggaatatttgggtggagcaataaatgtagtgctaagcctatagcaacatgcaaagaaagtgaatttcattactacaaaattgaaggagttgagcattatatgagcaaatacactaatggtgatagtgtaagtgaagctaattgtggaaataaatgtacc

SEQ ID NO: 5020 - DNA, 438 bp, Cicer arietinum
  misc_feature (437)..(437): n is a, c, g, or t
accactcttaccaatttggacctaaccactcctgatacatttgactctgcctactattccaatcttaaaattcaaaagggattgtttcagagtgaccaagagttgttttcaaccagtggtgcagacactattgacattgtcaatagtttcaatgacaaccaaactcttttctttgcaaactttaaggcctctatgattaaaatgggtaatattaatgtgttaactggatctcaaggagaaattagacaacaatgtaactttattaatggaaactctgttgaccttgctactactgtgactagagagtcgtcagaagatggcatcgttagttcatactaagtaatttaattagcaaaagtaaggaacctaataaagattaaagagtgtggtctatcttctagaggcatatacatgccctgttcttgtggtggatggtng

SEQ ID NO: 5021 - DNA, 382 bp, Cicer arietinum
acaaagcttacctggagaccgtggatcggggcgattgcctcgtctactgagcagcgttctggccgccttgggtttttccccttcgaggggttttcccaaggatgcacggtcctagggttgctgctactggcgatcttagggattatggttctcttgcctttgggcatggaaagctgcttgatctatctgtgcaagagaattctaggccggagaggaatcagttcccgctgacgggatgacctcttgagagtaatgcgcctttgtgccgatgatatgctggatgaactagatgggagacgctgctggagggaagctctgctaagatcagatgtattgatgtcctttaggacgtgcttcaccgacacctactgtagggcaagct

SEQ ID NO: 5022 - DNA, 192 bp, Cicer arietinum
gttttacgtttggcggtgatgtcacggtggatctcgccgcgtcggggatactttatgtggcgagtgtgaagcaagtttgtttagcatttgcggctaatggagatgatagtgatttgactatctttgggaatgtgcaacaaagaaccttagaggttgtttatgatgttggtggtgggaaaattgggtttggtt

SEQ ID NO: 5023 - DNA, 138 bp, Cicer arietinum
acagtagggtttggcactcaacttgcatcacaatctgcttgcttgaatattcttggtgtgaagggtgcaagcaaggagtcaccgggatcaaactcgagactcttggcaaccattgttgccggatctgttttagcaggc

SEQ ID NO: 5024 - DNA, 312 bp, Cicer arietinum
acaaccattaaatacaacaagaataccatcacccgacgttcatggcatcctctcctttaactacacaaacctcgcataagctcaatttcattaaatcatgaaggggtttgcaacctggtgctgtccaaatgccattactatgttgcgtcaaaccattaattctcacaggtcctctatgctgcaaaagctcaatgaccggtttttccttttgatgaaaagaatctactaaaacctcggccatgtttctctggtgtaggggtggaagaagctgaagaagaggttgactttgtaggcttgtgatttggatgctgt

SEQ ID NO: 5025 - DNA, 436 bp, Cicer arietinum
accgttttggatgggaatttgaagctcagagtgttgtcgacgatgttaagaaaaatccagaggcgtgttcgagtggaattgttcttcggagaagattgcaacttatgatgtataatattatgtataggattatgtttgatagaagatttgagagtgaagaggatcctttgtttgtgaagcttaaagctttgaatggtgaaagaagtcgtttggctcaaagctttgagtataattatggtgattttattcctattttgagaccctttttgaaaggttatttgaagctttgtaaagaggttaaggatcgtaggttgcagctcttcaaagactatttcgttgatgagagaaagaaacttggaagcaccaagagcaccaccaatgaaggactgaaatgtgctattgatcacattttggatgctcaacagaagggtgagat

SEQ ID NO: 5026 - DNA, 427 bp, Cicer arietinum
gatcttcttaccatgatgtgataagggtatctgagattcagaaggtgttggacattactggggttcaaacctacattattaatagtgcaagggttgtgttcttaaatgaaaggccacaacctaggccaggaaaaggtgtcacaaacacttgtgaagtttgtgagcgtagtcttcttgattctttccggttctgttctcttggttgcaagattgtaggaacatctaagaatttccagaagaaaaagaaacattcagcagcaatggcatcagattctgaggaatcatacagtggcaacaacaacatccacagccgtcagatgaaaatcaaatatcaaagcttcacaccatctacaccacccccaacttcagttaattacagaacaaccaagagaagaaagggaataccacatagagccccattaggggg

SEQ ID NO: 5027 - DNA, 428 bp, Cicer arietinum
ttgaacagtgttccatcagagaaggaagacactgctcaagaacttgtgtctcataagaacttacttgctgaattgaatgatgcgcaatcaaaatccttcgaaattcattctgccaatgaagcacgcgtcctcgaagtcgaatcacagttacaagaagcattgcagaagcacactgagaaggaatcagaaaccaaagaattgaatgagaagctgaatactcttgaaggacagataaagatttatgaagaacaggtgcgtgaaactgttacaacctctgaaactcataaagctgagctggaggagagtctcataaaattaaagaatcttgaagcagtagttgaggagcttcaaaacaagtcacttcaccatgaaaaggaaactgctggaataaatgaggaaaaatcaaaacttattcaggacttagctag

SEQ ID NO: 5028 - DNA, 242 bp, Cicer arietinum
ctgataggattttcaagcttgcacaagagcttggtttgcaaccaagacgagttgctgtttggttccaaaaccgtcgtgctagatggaaaaccaaacaattggaaagagattatggtcttctcaaagctaattatgatgcgcttaaacttaattatgacaacctccaacgtgacaatgaaaccttgctcaaagaggttaaggaattgaaatcaagaatgcaaatagaagaagaaaacacaagt

SEQ ID NO: 5029 - DNA, 205 bp, Cicer arietinum
accgaatgtcactaatggaatgtaaaggtctggtgcatttatgtgggagggcggtggtttataagagagcctaccacccactggctcggtgattctagtccaatgacccctgtgcagaaatggaaacaaaaccaccttcaatttgttcttaacataatggtcattcacttgaaagtagtattggggatcagagaaataccgactt

SEQ ID NO: 5030 - DNA, 295 bp, Cicer arietinum
gactgctcattccccagaagagcttcttgctacccatctcgaacaacaaaagatccatcatgatgagcctgtagttgaggatgatgatgatgatgaggacgacgatgatgaggatgacgatgatgaggacgatgacaatgcagaaggtcatgaaattgatgcatctggtaggtccaaacagacccgaagcgaagagaagagtcgtaaggcaatgctgaaacttggaatgaaaccagttactggtgtcagtcgtgtgacagtcaagaagagcaagaatatcttgtttgtcatctcc

SEQ ID NO: 5031 - DNA, 383 bp, Cicer arietinum
accttgctgagtttcagagtggcgctgagcgtaaagacgctgctgaaagcactcttactgcttataaatctgctcaggacattgcaaactctgagctgcctccaactcacccaatcaggcttggtcttgctctgaacttttctgtgttttactatgagattctcaactctcccgatagggcttgcggccttgcaaaacaggcttttgacgaggctatcgctgaattggatacattgggagaggaatcatataaggatagcactctaatcatgcaacttctccgtgataacctcaccctttggacatctgacatgcaggacgatggtgctgatgaaattaaagaagctgcacctaaaggtgatgaacagcagtgaacatattgt

SEQ ID NO: 5032 - DNA, 423 bp, Cicer arietinum
tggatccattagaagtgacaaacatttgatgagccacctttggatcattaagattatcatacccaaattgtagacatggaagttgattaattgtgataacccctaaatattttccattatttcctttaaatgtgacatatgttttgggaaattgaaagattgatttccaatctatgacatggaatacgtctttagagccggtatcaatttgacttgattcggcaaataagtatgatacgaaggacccaccaacggtataattttctgtataatgacctaattggacgtgcaaaagtcgaacctttttcatgttaccttcttctacgtaaagtggtttgaataatgtgcatgcccaattgcttttattttcatctggttcattggctgatgctgtaatccaataatgattgggagaccacctaa

SEQ ID NO: 5033 - DNA, 320 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtgga

SEQ ID NO: 5034 - DNA, 382 bp, Cicer arietinum
cacttattctccactagaatttacaagatggttacccacgagcacgtccgaaatatcttcgcaggccccagcaagggcgacatggccagcttctggccccacgtcgagcccaacgtcgactggaccgtaaaaggcacccactgcaaggtctctggccgctacaggtccattgaggaattccaacaggggacaagggctttgtcatccacttgggcaggccccctgcatcttgtcgttcaaaacatcatcattgagggaaaccaagctgccgtggagcttaacgccgtcaacactaagactaagagcggcgatccctttccaaatgaatatacctgggtgctgggctttagcgacaacggcaagatcgcaacagtgagggcgt

SEQ ID NO: 5035 - DNA, 362 bp, Cicer arietinum
acggtggacttttcctccgatgaatggtgggccctcgttcaatcatccccttggtttcgtgattactggcttcgtgaacgcttccaagatccccaaaatcataacgacacttcctacttctctgatttcgagatcgatgaagatgatcttttccatcaaatcgagccacaacacgaagatgaaggaggagacgggaaagaaatggtgaggttgcgagatttgaaatggagaggatgtgatggatgggctgaagttcctaggtatgcggaaaaggctccgaagattgttaagcccagagtgagcccacgggctattcatcagcctaggtagatgatgacaagtggaaacaccgtttgcgttgt

SEQ ID NO: 5036 - DNA, 376 bp, Cicer arietinum
accgttgtttcgttcgtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtggaggtggatatggcggaggagg

SEQ ID NO: 5037 - DNA, 374 bp, Cicer arietinum
actagtgatttcgagcggccgcccgggcaggtaccggtaatgtaggaatcacggtaaaattgtctgttggagtgtgcatacagagtgtcttgaaacgcgtcaatgctgcatctgttgatgacggattgatctgcaccgactcgtagagcaactgcctggtgcttctctgggcctgctgtgttttggaatccaatgtcctgatttataaacccatccccaacagcagcgacagttgcacttttgaaagtggctgatccatcaatgacattcaagctgcctgtgattgttgttacatccataccatcacctacaagcatgacattcttctttttctttcctatttctacattctctttgtagattccctttttcac

SEQ ID NO: 5038 - DNA, 298 bp, Cicer arietinum
tgcgttgtttttatttgcagaatcgaagtatgccgctgaaggtgtccgaagccacaatttctacctttgatgccgtctttgagaagttccgatcagagagtccccaaaacaaagccaacctcattctcttcttggctgacaacgacccttctacctctctcagctggtgccctgttttgtgtgagagctgagcctgtgatctacaagaagctggaaacatcatcaaatgaaattgcacttttgaaagcttatgttggagatagaccaacatggaggaactcaaaacatccatggaggg

SEQ ID NO: 5039 - DNA, 354 bp, Cicer arietinum
accaggcttgctccgccactgcccgtcgtggtgccatcgactggagcccccgcttcaaggacgccctgaagcccgtcttcaactccctctacgacgccgtcaaggatggttccgagaccaagcgatctctcgagtacaacacccagcctgactaccgtgagaagtacgaggcagagatgaaggagatccgtgatctcgagatctggcgcgccggcaaggccgtccgatctctccgacccgagaaccagaagtaagcggctattaatgttgaatgataatttgtgagcgggagatggacatgggatgggatgcctaggaaacggcttttatgaaccacatgaactttctgtctgt

SEQ ID NO: 5040 - DNA, 177 bp, Cicer arietinum
  misc_feature (70)..(70): n is a, c, g, or t
gtgacagaggaacttttgaaatggacaaatagcactatttctaggatgatgttgggtgaggctgaagaanttagagatattgctcgtgatgttcttaagatttttggggagcatagccttactgactccatttgccctttgaaaaagctcaaccttggccaatatgacaagaagatt

SEQ ID NO: 5041 - DNA, 109 bp, Cicer arietinum
aactgaactcacatcaaataaaatcatatgagcaattaccagagaccacctcaagaaccttaccctccaccaaggttcggatctccttaccttccaccatcaccccatc

SEQ ID NO: 5042 - DNA, 164 bp, Cicer arietinum
actaggttgatttcctattgcgacactgtcatcagtagggtaaaactaacctgtctcacgacggtctaagcccagctcacgttccctattggtgggtgaacaatccaacacttggtgaattctgcttcacaatgataggaagagccgacatcgaaggatcaaaa

SEQ ID NO: 5043 - DNA, 427 bp, Cicer arietinum
agtgaaacagctgtgattgctgaaacaggggactcatgggggaggctggggaagctgaaattgcctgagggatgtgggtatgagtttcaaatgcaatatggctcaattggatggtccgttggtgcaactcttggctatgcacaagcggtcccggagaagcgagtgattgcttgcattggtgatggaagctttcaggtaactgctcatgatgtatcaacaatgctgcgatgtggacagaagaccatcatctgcctgataaacaattgcggatacacaattgaggtagaaattcatgatggaccatacaatgttatcaagaactggaattacactggattaattgatgcaattcacaatggtgaaggaaaatgttggactaccaaggtagtgtgtgaagaggagctagttgaagcaattgccactgcaa

SEQ ID NO: 5044 - DNA, 400 bp, Cicer arietinum
tgcttgcttcttgtccttatgatgggcgtgtcattctatggaaggaggggaaccaaaacgaatgggttcaagctcatgtctttgatgatcacaagtcatctgtgaattcagttgcttgggcgcctcacgagttgggtctctgtttggcttgtgcttcgtctgatgggaatatatctatattcactgcaagagcagatggtggatgggacacctcaaggattgatcaagctcacccagttggtgtcacctcagtgtcttgggctccttcaatggcaccgggcgcccttgttggttcaggtttacttgatcctgtgcagaagctttgctctggtggttgtgataatactgtgaaggtgtggaagctcaacaacggacactggaaaatggactgcttccctgc

SEQ ID NO: 5045 - DNA, 228 bp, Cicer arietinum
gatttcgagcgccgcccgggcaggtacacacgtgtaacgagagtgttgaagaagttgacgaacaaaacaaaaaaatcacttacaagctattcggtggagatattgatgagcactataaggtctttaaactcatcctccaagtatttgataagagtgatggaagtggtgctgttaaatggactattgaatatgagaagatcaatgaggatatctatcctcctaatggct

SEQ ID NO: 5046 - DNA, 293 bp, Cicer arietinum
tgtctagatggcgggattaccagtgattatgtgcctaaaatcaaataacaaccagaagtacttaagatatcaaagtgataatattcaacaatatggtcttcttcaattttcagctgataagattttagatccattagctcaatttgaagtcgaaccttccaagacttatgatggtcttgttcacatcaaatctcgctacactaacaaatatttggttaggtggtctcccaatcattattggattacagcatcagccaatgaaccagatgaaaataaaagcaattgggcatgca

SEQ ID NO: 5047 - DNA, 337 bp, Cicer arietinum
tgtgttgttactgattttatctttgtcttttgagaatatgtctggctgcaactgtggaagtagctgcaactgtggtgatagctgcaaatgcaacaagaggtctagtggattgaactatgccgaaggcggcgaaaccacagagacggtggttttgggcgttggtccgacgaagattcagttcgagggagctgaaatgagtgttgcagctgaagatggtggctgcaagtgtggatcaagctgcacatgtgacccttgcaactgcaagtgaggtgcatatagcaaatgaaagcttgaggcagagatattggaaccaatatgtgtaattgtgtgtatcggt

SEQ ID NO: 5048 - DNA, 296 bp, Cicer arietinum
taattatctattcacaaaattttaacggtacatctcatctacgtttcaagatgcaaatcttcgtgaaaacattgaccggcaaaaccatcacccttgaggtggagagttccgataccatagacaacgtgaaagctaagattcaagataagcctctgctgatctggtggggtaccctccttatcttgaatcttggctttcacattatcaatagtatctgatctctctacctccaaagtaatagtctttcctgtcaaagtcttaacaaaaatttgcattccacctctcaatcgaagtac

SEQ ID NO: 5049 - DNA, 401 bp, Cicer arietinum
acgcggggcacacaacacaagctagctacttgttaataatatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggc

SEQ ID NO: 5050 - DNA, 404 bp, Cicer arietinum
ctctcaccacctacttcccctgcatcatctatctctatggctagtgaaactgttttggttgatgaaatcccttacccttccaagatcactactaccaagcctctatctctccttggtcatgggattaccgacatggaaatccattttctgcaagtaaaattctattcaattggggtttatttggaccctgaagtagtaggtcacttgcaacaatgtaaaggtaaacctgccaaggagttggaaaataatgatgacttctttgatgctctcatatctgctcctgtggagaaggtaattagacttgtggtgattaaagagattaagggttctcagtatggtgttcagattgagactgctgttagggacagattggcagctgatgacaaatatgaggatgaagaaga

SEQ ID NO: 5051 - DNA, 148 bp, Cicer arietinum
actactagtgtctgaaacaaactcaatagtatcctgaaggtgagtcgccagaaacatagtagtaactttaccggccaaggagaaggaggttccacccatgatgtttttttttctttcacttaacccctcacgttttgctcccccgcgt

SEQ ID NO: 5052 - DNA, 148 bp, Cicer arietinum; identical to SEQ ID NO: 5051

SEQ ID NO: 5053 - DNA, 426 bp, Cicer arietinum
acgaaggttctcgaggactaacaaagcatgaaggaattttccctatgagacatgtttgatccgaactcaagtgatactaagttgcaagagggtaattggattcctgtgtggtgattcaaagcatttgaagaagaaggataaagcataaaagtgcatgaactcagaattgtactctgtcaaatcacgcccagcaaggtccaaccgaagaattgcatgaggaagagcgtaaccttcatatatgggcactgtgtggctcacaccatcaccccgcgtacaagagaagagcttcgtccatccatcatcgccgccgcccttctaccttaccaaccgtggattctctcttttttgttagtttgatggcaatttattttctattgttttttatttttatctcttcatcccctccctctctgtctctctccctcc

SEQ ID NO: 5054 - DNA, 419 bp, Cicer arietinum
acaagtctcctggcaatgcttttgctgaaggtgatgcttcgagtgccagttacttcctagctggtgcagcagttactggtggaactatcactgttataggctgtgggacaagcagtttacagggagatgtgaaatttgctgaagtcctcgaaaagatgggagctaaagttacatggaccgaaaacagtgtcactcttaccgggcctccacgggattcttctggtcggaaagtcttgcaaggcattgatgtcaatatgaacaagatgccagatgttgccatgacacttgctgttgttgcattatttgctaatggtcccactactattagagatgtggcaagttggagagttaaggagacagaaagaatgatagcaatctgcacagaacttagaaagctaggagcaacagtggaagaaggt

SEQ ID NO: 5055 - DNA, 190 bp, Cicer arietinum
acaattattttccacctttattaataagtggcaagtttttgccagtgggttggttgctattcaccaatcatgttgtgctttcattaaaactatattttagatacaaaaaattcagtttcttttggaatattttgaagattttagtgcctgcaatttgcggattgaattattggatataggggttcttcgc

SEQ ID NO: 5056 - DNA, 329 bp, Cicer arietinum
  misc_feature (329)..(329): n is a, c, g, or t
acgcggggggattaaataagaagcttaatgcacaacaaaaccatgaggaaattgagcttgctggaattgaagagtcccaaccttgggatgggtattatgcatcaaatccatggccaattgtcagcagccaaacacactccacaaactcggaggtcgtgcatattcttgcattaaaatagttagtttgtttttgtttaataattgctattattttttggtgttgattattgtaacatgtaaaataaacaagagtttgcttaggctttggagatcagacagggagataatctagttatggataagtgaatagtggacgtatttaattggcn

SEQ ID NO: 5057 - DNA, 301 bp, Cicer arietinum
acttcgtctataacgacatcttcaagcttgtcttcggttaatcgaaagcagttacactgccggccggcgcctttggttgtttgaatgagttgagcgatgtttataaacacacaaacacaccaagtggggcgacagacgaggggaaattaaagcggcaatggcaacggaatagcttcttttttgacgataagatgaatttagagcatggcttgaaggaagcgcaagtgtttgactcggctgtgattatcttgaatttcttcccgctgatgaagcggaattattggttcccaaagctatgagt

SEQ ID NO: 5058 - DNA, 249 bp, Cicer arietinum
acacgcgtcttctaaatactaagctgtaacttctggccatattgagccaaggaacaactagttcagagcataaatttcatccatctgtctcgaaaagcaaataacactaacattgcacatatgagacacgtgtatacaacaacttcctcctttttcattgttttatggatacgtctatacaacagctgaacagcttctgaaatcaaaacttggcctcaagaagaatggaggagtatggagctatactgt

SEQ ID NO: 5059 - DNA, 128 bp, Cicer arietinum
tgtttcgttggtggtctagcctggaccaccgacagcgacgccctagccaaagccttctcttcctacggcgaagtcactgattccaaggctattaacgaccgtgagactggaaggccaaggggttttgg

SEQ ID NO: 5060 - DNA, 159 bp, Cicer arietinum
actgcatatgttccttcaatttaggcccaaattctttgttaaggctgttaggagcagctgtagatgccttcccaccgccatatttcacaacaaaatcatctttcacacgctccagaaaagccacaggaacctgtcttccaactgattcatccgcaacaa

SEQ ID NO: 5061 - DNA, 352 bp, Cicer arietinum
actagagagtaaaaggctggatgccgatctcaattcctacactgctgtggacaagtcaatcccaaaagagattcatctggatttggacgatagtcaagaaattgagccttgcagaacctacgagtttcagcttcctaattatcactccgacttggcatcagactgggaacacatttagaagaggaggagcttgttgggctagaagccactagagttggattatttgactgaataaatttttaaatgcactagagctcgttattatcttttgtcagacatagatactgcggaatttggtctttaactcttttattgtgtttgtatataacttaatccgtatttgttttctttc

SEQ ID NO: 5062 - DNA, 254 bp, Cicer arietinum
  misc_feature (1)..(1): n is a, c, g, or t
nacaaaaactacttcccatctgtcactggagaataaccaagccctgtagtgggggaaattggaattaacgaacatagcacaattggtatttttgcttaatgtcctcctgggttcctattccatgacaaatatgaaggatctcctagttgccttggcttgacgaaatatacaatggtaaaagccaaagacaaaaagaagcataatcctccgacagtgagataagcaatgccaaggaagtcattcttcccccgcgt

SEQ ID NO: 5063 - DNA, 190 bp, Cicer arietinum
acaattagcgttaacctttattaataggtggcaagtttttgccattagttttgttgctattcaccaatcatgttgtgctttcattaaaactatattttagatacaaaaaattcagtttcttttggaatattttgaagattttagtgcctgcaatttgcggattgaattattggatataggggttcttcgc

SEQ ID NO: 5064 - DNA, 323 bp, Cicer arietinum
acttgcttgtcccgtgtcaaggaatgtgagggaaatgaccggatcaaagagtatactggtaatggaattgttgtttggagtgggaatgatgatcaatgccacgatgctagatggggttatggggcaactggagtgatatctgttgcaagcaacctgattcctggtttaatgcgagatctcatgttcgggggcaaaaatcctacattgaattccaagctcttgcctctaattgactggcttttccacatgcccaatcccattggtttgaacaccgctctcgctcaacttggagttgtcagaccagttttcaggctgccatttgt

SEQ ID NO: 5065 - DNA, 374 bp, Cicer arietinum
accaggatgcatccaccaccttaatatcaggctccttcaggttatcataaagccaatccacagacacaactggctcatttgtgggtgcagatcgtgttgaatatgcagctcttctaccaactattgaagaagccatacaaggagcccaaccagtcaatttggtgttttgggctgtagaggttggaacagtttgtatagagaacagccgtttagagaagaaagaagagagaattggtgggtggtgagtgataatcgagcgaggacctaaaagaatctttgtcaaaaaggaagaagccattatcagcaatgaccatataaaaggagtggcctcgaattactcgaagagtcgtccccgcgtacctgcccggggccgc

SEQ ID NO: 5066 - DNA, 194 bp, Cicer arietinum
acgcggtgatcctgatgcctccgaggaagacctctttcacatcatcaaacgctttggagcttacgttactttcaagatcggagatctcttctctctctccttccacaaccttgatatacgcactattggggcggttgctggtcttgctgttgcaattgttttcacttggaggctgttgagatctcctgctggtt

SEQ ID NO: 5067 - DNA, 422 bp, Cicer arietinum
accggaaaaactgggagggttgcgcaattatgacgcaatcaagaaagcgctgattaaagcagtttatgagacattaaaagtgattgaatttgaggcagcatggggatttttgattcaacgttttggagttagtgatcatgagtggcttcattccctatatgaagaccgagttcattgggcaccggtatatttgaaggacaaattttttgctggcatgtctgctacacaccatggtgagagcattagtccattttttgataaatatgtgcataaacagacttctttgaaggagtttcttgacaagtatgaattagctcttcacaagaagttaaaggaagaatcttcggcagatattgaatcaagaagctcaaaccccttgctgaaaaccaaatgttctttcgaacttcagctctctagaatgt

SEQ ID NO: 5068 - DNA, 350 bp, Cicer arietinum
accatggtctaaaaggctgcgagatgttcaacctaatgtccttaagtaattggtccaacaaggactgtgttaaggaatggtatgaaagaatcttgatctccactaaataccataactcttacacctgatttgacaagtgtccctagaagagatacggttggagtatcataaaaacttttgctatcaatcccaagaactacgcaaccttgccataaggtacttttttttttttttttttttttttctattgggaaatgaacagatggaactaagtggaactgtgcaaaagttgatgaaccaatgaacaggaatacagtaaaggtctgattttcagacaatataaagcacaa

SEQ ID NO: 5069 - DNA, 259 bp, Cicer arietinum
acgcggggggactacgaagactagtgttgagggagtttttgctgctggtgatgttcaggataagaagtataggcaagctattactgctgctggcactgggtgtatggcggctttggatgcagaacacttcctgcaagggattggtttacaacaggataagagtgattgactagatactagagggtgttcagagctcagaagatgcttaattagaagcaatgtttgatttttaaagaagattggaaacagatctttatgt

SEQ ID NO: 5070 - DNA, 354 bp, Cicer arietinum
accgtgcttcaacattggttgtgggtagtcacggttatggggctataaaaagggcggttttaggtagtgtgagtgactattgtgctcatcatgctcattgcactgtgatgattgtgaagaagcccaaaaccaaacactgatctatattggcatgtcatacaaaaataaatatataatcctttcagcaaaagtaaaataacaatgttggcagccagaaagtttgtgacttagtttatcctatgggctatggcatgttagctttgtagtttatgatagaaaatattaagtgtttggattgttgatgtatatgaaaaattcttatattactgtgcctaataattgtttttttccctg

SEQ ID NO: 5071 - DNA, 206 bp, Cicer arietinum
acacgggtttgcggagaaggctctaaaggagttaaaagctaagggcgggagaggggatcttttggaggatctgggctcaagaaaagtggaaagaaatagaggagctctttctcatgatttcatacttccagtattgagctctgtaattacgattatgactatgacaatatctcttattgtgtgacgtgttttatactgatgttagt

SEQ ID NO: 5072 - DNA, 404 bp, Cicer arietinum
  misc_feature (1)..(1): n is a, c, g, or t
  misc_feature (17)..(17): n is a, c, g, or t
  misc_feature (20)..(20): n is a, c, g, or t
nacgcgggggttatcgnagnggagtttacttaaaggattattaccctgggggaggttgctggggcttgtgtccttgtttggagtggttaaagttgtaatgttttgaggttgtgtactgatgaatcccctaatgattttggtaaaaatcattaagttaaggtggatacacatcttgtcatatgatcaaatggtttcgcgaaaaatcaataatcagactttttgatgtgcgaactcgatattttacacgactctctttagggggtcggccccgaattacacttaaaacgactcaacagcttaacgttggcttgccacgcattacttgactgtaaaactctcactcttaccgaacttggccgtaacctgccaaccaaagcgagaacaaaacataacatcaaacgaat

SEQ ID NO: 5073 - DNA, 315 bp, Cicer arietinum
acaacttttcctgcagtgggctatgatgcaaggagttgcaatgcttttgcaaaatagatatcaacgtcaaagactttatacccgcattgcattgggaaaggctaagaggatggatgttgtatggggggaaacagctggtgtggatggccaactgtggttgctatgtcccatacttttcatattgcagggatttgaagcttatgttggacaatccttgctcaggactgcatttgtcggggtggtttctgaatggtaggtgatagtttgtggtctccttttggtcgttatggccattgggaactttgaaaatacagt

SEQ ID NO: 5074 - DNA, 135 bp, Cicer arietinum
actctggtttgtcatcaaacaccaagtaattttgtgtgggaagttctctttacaatgtccatcataggattgggactcttgctttttgcgcttctcatcggaaacatacagaactttcttcaagctcttggacgg

SEQ ID NO: 5075 - DNA, 438 bp, Cicer arietinum
acgaggacagaacaaggcatgacatttgtcgaatttttgatataaagaaaattccagctttggttttcattggaccagacggcaaagtaattagtttgaatggaaagtttatggtctcgtcgtacgcggggggcatgacactcatcatggtttcacatagcatcaaacaaatccagaggatggctcacgttgtgtgcttgcttgttgatggtcaaattgtggaagttcttaaacctcatcaactatctcaagctaagcatcccatggcacggaggtttcttgaactcagtaattaattaagctcactcttgtattgtcttcacttgtgttgtgggctatattttattcttgctgcttgctttatcatcagctacgtatgttgagctgatcctcataaatatcactcaatggatcgactttcgttatttattttgtatg

SEQ ID NO: 5076 - DNA, 456 bp, Cicer arietinum
gagctcggtactcgcgaatgcatctagattggccagagaccccaagcttcggatctcatagatacatatagaattctgcggaaagccgtattcgatgaaagtcgtatgtacggcttggagggagatcttccatatctttttcgtggtttgttgaaggaacagatctttgctcacagtaaatgaactatagtatcctgagatgatttatgaattttatgctaatttacataaaggaagagttcaaaagcaagaaaatattacttatcaatgggttacttctagggtgggtggtagaaatatttcttttgatgatagaatgttaaacaccatactgggaacacctgaaaatagtattaaattttataccaaaaataaaaatgctttgatccgaagcttggggtctctggccaatcggatcccgggcccgtcgactgcagaggcctgcatgcaagcttt

SEQ ID NO: 5077 - DNA, 182 bp, Cicer arietinum
tcgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcaaaccatcta

SEQ ID NO: 5078 - DNA, 151 bp, Cicer arietinum
gccaattaaatacgtccactattcacttatccataactagattatctccctgtctgatctccaaagcctaagcaaactcttgtttattttacatgttacaataatcaacaccaaaaaataatagcaattattaaacaaaaacaaactaact

SEQ ID NO: 5079 - DNA, 253 bp, Cicer arietinum
acaaaaactacatcacatctgtcactgtagaataaccaagccctgtaatattggaaattggaattaacgaacatagcacaattggtatttttgcttaatgtcctcctgggttcctattccatgacaaatatgaaggatctcctagttgccttggcttgacgaaatatacaatggtaaaagccaaagacaaaaagaagcataatcctccgacagtgagataagcaatgccaaggaagtcattcttcccccgcgt

SEQ ID NO: 5080 - DNA, 428 bp, Cicer arietinum
accttgcaatgggagtttttattggatcagcagttattcctattgcttttatgcttttatggagaaaagcaaatgcaattggagccattcttggaacaatatttggttgtgttcttggaataatcacatggttgtctgttacaaaaatagagtatggtatgataaaccttgatacaactggaagaaatgcaccaatgcttgttggaaaccttgtttcaatactaacaggtggagctgttcatgccgcatgcagcatgttgtggcctcaaaactatgattggagtagcaccaaacaaatcacagtggttgaaaaggaaaagactgaattgccagctgaagagtttagagaagaaaagttaataagggccaaagtgtggatagtgaagtggggtgttggcttcactgttttgatagtcatattatggcct

SEQ ID NO: 5081 - DNA, 398 bp, Cicer arietinum
aaggaataaaagaacttgaactatatagaaacgtaattacataattgttcaaactccactaactttgagaaccaatgcatacaaagagtttgcaattcaaacactaacgagtatcgtatgttatatgaccttcatgtcttgattatcttcacatggtcccatcaaagaggttgcaaggggtttaaacatccttagttgtatagtcataactgtgaaggctgtgatggcattctattaattcaaaacccatttacaatgcccttttatagatgtttcaatgactgaatcattttaactccttgcatgctcagggatgaggcgtttacgcagctcttcgggcgcatttaccagttcttgaggcgtgaagttgaacaaaggaggtagtggttgcccgtttg

SEQ ID NO: 5082 - DNA, 429 bp, Cicer arietinum
acttttttgttgctgctgttgaaatgagaaattggggtatagtttagggtatcagcatgagcttcagagaaaggaagatagaaggagaagagagggaatgtgaaaaatcagtgaggacaaatgggtctttaacaaccaccacacactttaccattgatgacaatcttcttgttgaccccaaattgctctttattggctcgaaaatcggtgaaggagctcacggaaaagtttatcaaggaagatatgtagatcaaattggggctatcaaagttcttcaccgtggaagtacttttttttttttttttttttttttaaaagatgtttaatttcaatatcataatttatttcacaatttcttcctctccttgagcaagaagaaaacatattgtagatgactaagttacaatagaactagcataccataaatta

SEQ ID NO: 5083 - DNA, 406 bp, Cicer arietinum
actttttttttgctgctgttgaaatgagaaattggggtatagtttagggtatgagcatgagcttcaaagaaaggaagatagaaggagaagagagggaatgtgaaaaatcagtgaggacaaatgggtctttaacaaccaccacacactttaccattgatgacaatcttcttgttgaccccaaattgctctttattggctcgaaaatcggtgaaggatctcacggaaaagtttatcaaggaagatatgtagatcaaatggggggtatcaaagttcttcaccgtggaagtacttttttttttttttttgtgtgtttttaaagatgtttaatttcaatatcataatttatttcacaatttcttcctctccttgagcaagaagaaaacatattgtagatgactaagttaca

SEQ ID NO: 5084 - DNA, 424 bp, Cicer arietinum
gattggtcgacctcaccaccattacattgcctatgccaaaagcaactacactcatattttggcaggcctttttaaaaacaaacttattccatccatcccctctggttcttcttcctcatgattacaatcatgaaagaaagaaggggatttcataatctaatcttctaatgtaacttattagctacattacactgctttctaatctcacctttagtaccagtaagagggttattttcagacagaatagtaatggctcttgcaaattccttaaagaagtaatcttggctttttgccattttcttgacaaatggttttgttcttttgtctgtggctaattggtgatcaactagcaacaagcccttgttgtccaagatgtttctgtaataattgttgtctaatttcataggtgttcctctgtcacttc

SEQ ID NO: 5085 - DNA, 460 bp, Cicer arietinum
gattggaattcccatggcttccaaaactctcttcttccttgtcattctctccttctctgctctctcaacttttgctgaaaatgaagccgaggcagaccctggtcttgtaatgaactattacaaggattcatgtcctcaagctgaagatatcatcagggaacaagtcaaacttctttacaaacgtcacaagaacaccgctttctcttggctaaggaacattttccatgattgctttgtcgaatcttgtgatgcttcattgttgctggactcaactagaagagtcctgtctgagaaggaaacagataggagttttggaatgaggaatttcagataccttgaagacatcaaagaagcccttgaaagggagtgtcctggagttgtttcttgtgctgatattcttgttttgtctgcaagagatggcattgtttcgttaggagggccatttatccctcttaaaacc

SEQ ID NO: 5086 - DNA, 463 bp, Cicer arietinum
gattctctagagccatggcttccaaaactctcttcttccttgtcattctctccttctctgctctctcaacttttgctgaaaatgaagccgaggcagaccctggtcttgtaatgaactattacaaggattcatgtcctcaagctgaagatatcatcagggaacaagtcaaacttctttacaaacgtcacaagaacaccgctttctcttggctaaggaacattttccatgattgctttgtcgaatcttgtgatgcttcattgttgctggactcaactagaagagtcctgtctgagaaggaaacagataggagttttggaatgaggaatttcagataccttgaagacatcaaagaagcccttgaaagggagtgtcctggagttgtttcttgtgctgatattcttgttttgtctgcaagagatggcattgtttcgttaggagggccatttatccctcttaaaaccgg

SEQ ID NO: 5087 - DNA, 182 bp, Cicer arietinum
gattactatagggcacgcgtggttataaaataaggcacatcatgttacataagtaggcagacctacttatagtcaacaattttgcatgtttaacgttataatcactcttagttattaaaatatttgtccacttgtaaaaatgatcatcaatcgtcactgaaaaggccaccagcccgggccgt

SEQ ID NO: 5088 - DNA, 399 bp, Cicer arietinum
tcttaattcatcatcatgggtgttttcagttttgaggatgaggccacctcaattgtagctcctgctactctctacaaagctctagttacagatgccgacaaccttactccaaaggttattgatgccattaagagtgttgaaattgttgaaggaaatggtggccctggaaccatctagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactcct

SEQ ID NO: 5089 - DNA, 402 bp, Cicer arietinum
gattactatagggcacgcgtggtgtaatacgactcactatactcaaacaactttgcgaggtacactggactgaatctgcactatcaaacctcgatatccagatcacaccagcgtttgttgacgaagctctctagtcctattgggaggtgtttgccgcaggaaaagccggacatgtcaaagcttacccaacgctcaacaagaatgttcctggatggactgaaggagcactcattggctatttcggaagatattccggcaccaaagacatccacttcgcgccaaccaacgccgctaccggaaagccgctccagcactccgatattttcctgcgcgacaaggtgtccgggacgctccttatgtcggtagagggcgtggcaatttctaatggaagaacgggttggt

SEQ ID NO: 5090 - DNA, 198 bp, Cicer arietinum
atagggggagttatctctctcttatgatgtttggtatactttgctcctattgatgatttccttgaaacatcaccatatttttatacttgctcctttgttcttcttgcatatgtatttgtcataattaaaaagggggagattgttagccctaaatcggatcccgggcccgtcgactgcagaggcctgcatgcaagcttt

SEQ ID NO: 5091 - DNA, 400 bp, Cicer arietinum
gaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatggcatactctcttcttcttttcattttgttgtg

SEQ ID NO: 5092 - DNA, 268 bp, Cicer arietinum
gagctcggtactcgcgaatgcatctagattctttcaacccttggcatgttgtcaaatttatagggggagttatctctctcttttggtgtttgatatgcttttcactcattgatgatttctttgaagcatcaccatgtttttatacttgctcatttgttcttttggttatcctcttgcatatatatttgtcataatcaaaaagggggagattgttagccctaaatcggatcccgggcccgtcgactgcagaggcctgcatgcaagcttt

SEQ ID NO: 5093 - DNA, 460 bp, Cicer arietinum
gattctctagagccatggcttccaaaactctcttcttccttgtcattctctccttctctgctctctcaacttttgctgaaaatgaagccgaggcagaccctggtcttgtaatgaactattacaaggattcatgtcctcaagctgaagatatcatcagggaacaagtcaaacttctttacaaacgtcacaagaacaccgctttctcttggctaaggaacattttccatgattgctttgtcgaatcttgtgatgcttcattgttgctggactcaactagaagagtcctgtctgagaaggaaacagataggagttttggaatgaggaatttcagataccttgaagacatcaaagaagcccttgaaagggagtgtcctggagttgtttcttgtgctgatattcttgttttgtctgcaagagatggcattgtttcgttaggagggccatttatccctcttaaaac

SEQ ID NO: 5094 - DNA, 466 bp, Cicer arietinum
gattctctagagccatggcttccaaaactctcttcttccttgtcattctctccttctctgctctctcaacttttgctgaaaatgaagccgaggcagaccctggtcttgtaatgaactattacaaggattcatgtcctcaagctgaagatatcatcagggaacaagtcaaacttctttacaaacgtcacaagaacaccgctttctcttggctaaggaacattttccatgattgctttgtcgaatcttgtgatgcttcattgttgctggactcaactagaagagtcctgtctgagaaggaaacagataggagttttggaatgaggaatttcagataccttgaagacatcaaagaagcccttgaaagggagtgtcctggagttgtttcttgtgctgatattcttgttttgtctgcaagagatggcattgtttcgttaggagggccatttatccctcttaaaaccggaag

SEQ ID NO: 5095 - DNA, 461 bp, Cicer arietinum
gattgtctagatggcgggattaccagtgattatgtgcctaaaatcaaataacaaccagaagtacttaagatatcaaagtgataatattcaacaatatggtcttcttcaattttcagctgataagattttagatccattagctcaatttgaagtcgaaccttccaagacttatgatggtcttgttcacatcaaatctcgctacactaacaaatatttggttaggtggtctcccaatcattattggattacagcatcagccaatgaaccagatgaaaataaaagcaattgggcatgcacattattcaaaccactttacgtagaagaaggtaacatgaaaaaggttcgacttttgcacgtccaattaggtcattatacagaaaattataccgttggtgggtccttcgtatcatacttatttgccgaatgaagtcaaattgataccggatccaatcactagtgaa

SEQ ID NO: 5096 - DNA, 422 bp, Cicer arietinum
  misc_feature (277)..(277): n is a, c, g, or t
  misc_feature (338)..(338): n is a, c, g, or t
  misc_feature (391)..(391): n is a, c, g, or t
atctccagggatatttgctggggaaccccatgacaacacgaaatgaaaaaaatgatcaaatcccatatgctcacggaatgggactcatctctgatgaactctatgcgtcactacagagaaattgcaaaggagagtatattgatgtggattccaaaaatgagttgtgtttaagagatgtccagtattttcaagagtgcctttcaggaattaataaattcaacattttggatctcctatgtgaagatgatgagcatctatggagaagatatttaactcnagacatgaagacatttagttctcatctcaaagtgcctgaattaaattgccaaatttatggnttttacctcgcaactaaattgggctaatgatgagcatgttcgcaagtcactgnacattcgtgagggaaccatagggaaatggga

SEQ ID NO: 5097 - DNA, 267 bp, Cicer arietinum
  misc_feature (16)..(16): n is a, c, g, or t
gagctcggtactcgcngatgcatctagattctttcaacccttggcatgttttcaaatatatagggggagttatctctcccttctggtgtttgatatgctttgctcttattgatgatctctttgaagcatcaccatgttttatacttgctcttttgttcttttatttatcctcgtgcatatgtatttgtcataaccagaaagggggagattgttagccctaaatcggatcccgggcccgtcgactgcagaggcctgcatgcaagcttt

SEQ ID NO: 5098 - DNA, 176 bp, Cicer arietinum
ggcttctctttcctcgtcccaagatgaaaatctgcatgcttggagacgctcagcatgttgaggaggcagagaaaataggattggactggatggatgttgaagctttgaagaagctaaacaaaaataagaaattggtgaagaaacttgcaaagaagtacctcggccgcgacacgcta

SEQ ID NO: 5099 - DNA, 214 bp, Cicer arietinum
atctagatttccacagccatgttcagagaagattcaataccattcacagcagaaagaaaaaattgctctcaggagaggtctagagggagacagagagagatgaggggctttgaaacttgaaagaaaggcaaagaagaggatataaaaagaggaagagaaatgggggaaatcggatcccgggcccgtcgactgcagaggcctgcatgcaagcttt

SEQ ID NO: 5100 - DNA, 459 bp, Cicer arietinum
gattctctagagccatggcttccaaaactctcttcttccttgtcattctctccttctctgctctctcaacttttgctgaaaatgaagccgaggcagaccctggtcttgtaatgaactattacaaggattcatgtcctcaagctgaagatatcatcagggaacaagtcaaacttctttacaaacgtcacaagaacaccgctttctcttggctaaggaacattttccatgattgctttgtcgaatcttgtgatgcttcattgttgctggactcaactagaagagtcctgtctgagaaggaaacagataggagttttggaatgaggaatttcagataccttgaagacatcaaagaagcccttgaaagggagtgtcctggagttgtttcttgtgctgatattcttgttttgtctgcaagagatggcattgtttcgttaggagggccatttatccctcttaaaa

SEQ ID NO: 5101 - DNA, 459 bp, Cicer arietinum; identical to SEQ ID NO: 5100

SEQ ID NO: 5102 - DNA, 399 bp, Cicer arietinum
acataccagggccaattccagcaccatacttcactccttcacggaagactgacagaagcttttcatcagaacgggagttctcaatggtgataacatcagcatccatgtcaatgatggaatgaatgatgtcgttgaagttagagtagcacatgtgagtgtggatctgagtggaatcctgaacaccaacattggtgattctgaaggagtgaacagcccagtccaagtagtgagcatgctctgacttccttagtggtagcccctctctcaaggcagcctcatcaatttggataacaccaataccacccttctcaaggtcttctacttcatccttgatagccaaagcaatttgatagcaggtttcggatctaggctggtcaactctaacgaaggaccagttga

SEQ ID NO: 5103 - DNA, 456 bp, Cicer arietinum
gattctctagagccatggcttccaaaactctcttcttccttgtcattctctccttctctgctctctcaacttttgctgaaaatgaagccgaggcagaccctggtcttgtaatgaactattacaaggattcatgtcctcaagctgaagatatcatcagggaacaagtcaaacttctttacaaacgtcacaagaacaccgctttctcttggctaaggaacattttccatgattgctttgtcgaatcttgtgatgcttcattgttgctggactcaactagaagagtcctgtctgagaaggaaacagataggagttttggaatgaggaatttcagataccttgaagacatcaaagaagcccttgaaagggagtgtcctggagttgtttcttgtgctgatattcttgttttgtctgcaagagatggcattgtttcgttaggagggccatttatccctctta

SEQ ID NO: 5104 - DNA, 182 bp, Cicer arietinum
gattactatagggcacgcgtggttataaaataaggcacatcatgctacataagtaggcagacctacttatagtcaacaattttgcatgtttaacgttataatcactcttagttattaaaatatttgtccacttgtaaaaatgatcatcaatcgtcactgaaaaggccaccagcccgggccgt

SEQ ID NO: 5105 - DNA, 399 bp, Cicer arietinum
actgattaattcattattcacaaagaaccataaaattcataacatcgtaaacttattctactgggccaacacaggccctatcacttccacaacaagtaaaagaaacatcagacagatattaatcccacagccacagattagaaaccaccacgaagacggagcacaaggtgaagggtggactccttctgaatattgtaatcagcaagggtccttccatcctccaactgcttccctgcaaagatcaacctctgctggtccggtgggataccttctttatcctgaatttttgccttcacattatcaatggtatcagagctctccacctcaagggtaattgtcttcccagtcaaggtcttcacaaaaatctgcataccaccacgaagacgcaacacaaggtga

SEQ ID NO: 5106 - DNA, 199 bp, Cicer arietinum
atagggggagttatctctctcttatggtgtttggtatactttgttcctattgataatttctttgaagcactaccatattgatcatacttgctattttgttcttcttgcatatgtatttgtcataatcaaaaagggggagattgttagccctaaatcggatcccgggcccgtcgactgcagaggcctgcatgcaagcttt

SEQ ID NO: 5107 - DNA, 147 bp, Cicer arietinum
gagctcggtcctcgcgaatgcatctagatttagggctaacaatctcccccttcttcattatgacaaatacatatgcaagcggataaccaaaaaaacaaaagagcaagtataaaacatggtgatgtttttaagaattatcaataagag

SEQ ID NO: 5108 - DNA, 258 bp, Cicer arietinum
gagctcggtactcgcgaatgcatctagattagggctaacaatctccccctttttgattatgacaaatacatatgcaagaagaacaaaagagcaagtatgatcaatatggtaatacttcaaagaaatcatcaataggaacaaagcataccaaacactataagagagagataactccccctatgaatttgaaaacatgccaagggtttgaaagaatcggatcccgggcccgtcgactgcagaggcctgcatgcaagcttt

SEQ ID NO: 5109 - DNA, 207 bp, Cicer arietinum
  misc_feature (197)..(197): n is a, c, g, or t
tttccacagccatgttcagagaagattcaataccattcacagcagaaagaaaaaattgctctcaggagaggtctagagggagacagagagagatgaggggctttgaaacttgaaagaaaggcaaagaagaggatataaaaagaggaagagaaatgggggaaatcggatcccgggcccgtcgactgcagaggcctgcnatgcagcttt

SEQ ID NO: 5110 - DNA, 461 bp, Cicer arietinum
gattggtcgacctcaccaccattacattgcctatgccaaaagcaactacactcatattttggcaggcctttttaaaaacaaacttattccatccatcccctctggttcttcttcctcatgattacaatcatgaaagaaagaaggggatttcataatctaatcttctaatgtaacttattagctacattacactgctttctaatctcacctttagtaccagtaagagggttattttcagacagaatagtaatggctcttgcaaattccttaaagaagtaatcttggctttttgccattttcttgacaaatggttttgttcttttgtctgtggctaattggtgatcaactagcaacaagcccttgttgtccaagatgtttctgtaataattgttgtctaatttcataggtgttcctctgtcacttcttacatattgtactgcctttggatcaggaattggatc

SEQ ID NO: 5111 - DNA, 378 bp, Cicer arietinum
tgcgttgtttttatttgcagaatcgaagtatgccgctgaaggtgtccgaagccacaatttctacctttgatgccgtctttgagaagttccgatcagagagtccccaaaacaaagccaacctcattctcttcttggctgacaacgacccttctacctctctcagctggtgccctgtattgtgtgagagctgagcctgtgatctacaagaagctggaaacatcatcaaatgaaattgcacttttgaaagcttatgttggagatagaccaacatggaggaactcaaaacatccatggagggtggatcctaggttcaagctcacaggtgtgccaacgttgatccgttgggagaatgattcgatcaaaggtcgccttgaggat

SEQ ID NO: 5112 - DNA, 280 bp, Cicer arietinum
gagctcggtactcgcgaatgctctagattcattatcaaacccttggcatgttctcaaaataacagaaggagttctttctctctctctctctctctcatgtttttgacatgccttgaacttaatgttaatctttagaagcattctcttagcttaaatgtgttcttttgtttcatatagtcatcatcttgcatctttgtttgtcataataaaaaagggggagattgttagccctaaatcggatcccgggcccgtcgactgcagaggcctgcatgcaagcttt

SEQ ID NO: 5113 - DNA, 259 bp, Cicer arietinum
  misc_feature (16)..(16): n is a, c, g, or t
gagctcggtactcgcngaatgcatctagattctttcaacccttggcatgttttcaaattcatagggggagttatctctctcttatggtgtttggtatactttgttcctattgataatttctttgaagcactaccatattgatcatacttgctattttgttcttcttgcatatgtatttgtcataatcaaaaagggggagattgttagccctaaatcggatcccgggcccgtcgactgcagaggcctgcatgcaagcttt

SEQ ID NO: 5114 - DNA, 252 bp, Cicer arietinum
ggtactcgcgaatgcatctagattctttcaacccttggcatgttttcaaatttatagtgggagttatctctctcttatggtgttttgtatgcgttgttcctattgatgatttctttgaagcattaccatattgatcatacttgctcttttgttcttcttgcatgtgtatttgtcgtaatcaaaaagggggagattgttagccctaaatcggatcccgggcccgtcgactgcagaggcctgcatgcaagcttt

SEQ ID NO: 5115 - DNA, 292 bp, Cicer arietinum
acagtgtgaagcaaaacaaaagctgttttcacacacaacatttatttcattacaaaactataaattaactttgaactttcaaggaagtaatattaatgaaaaagcatttcattacctatgtagaacaatgtcaagaagttggcccaactaccaacaatagacaaaacccattttccagcaatcaccgagagaaactttttgagatcctttccagaagcaatatcccttaatacagcaaaaacccggttgatctcaattctaatagcagcggtaatctgtaaaacaggttcct

SEQ ID NO: 5116 - DNA, 458 bp, Cicer arietinum
gattctctagagccatggcttccaaaactctcttcttccttgtcattctctccttctctgctctctcaacttttgctgaaaatgaagccgaggcagaccctggtcttgtaatgaactattacaaggattcatgtcctcaagctgaagatatcatcagggaacaagtcaaacttctttacaaacgtcacaagaacaccgctttctcttggctaaggaacattttccatgattgctttgtcgaatcttgtgatgcttcattgttgctggactcaactagaagagtcctgtctgagaaggaaacagataggagttttggaatgaggaatttcagataccttgaagacatcaaagaagcccttgaaagggagtgtcctggagttgtttcttgtgctgatattcttgttttgtctgcaagagatggcattgtttcgttaggagggccatttatccctcttaaa

SEQ ID NO: 5117 - DNA, 428 bp, Cicer arietinum
ggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaactcgctgacgggtgacgggctcgagaaaatacagcgccttttgtgccttggtatgctg

SEQ ID NO: 5118 - DNA, 412 bp, Cicer arietinum
aaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagaga

SEQ ID NO: 5119 - DNA, 462 bp, Cicer arietinum
gattcaaacaactttgcgaggtacactggactgaatctgcactatcaaacctcgatatccagatcacaccagcatttgttgacgaagctctctagtcctattgggaggtgtttgccgcaggaaaagccggacatgtcaaagcttacctaacgttcaacaagaatgttcctggatggactgaaggagcactcattggctatttcggaagatattccggcaccaaagacatccacttcgcgccaaccaacgccgctaccggaaagccgctccagcactccgatattttcctgcgcgacaaggtgtccgggacgctccttatgtcggtagagggcgtggcaatttctaatggaagaacgggttggttctcgctagcatgcgtaaacctgctgttgcaaggcagagaggacatcgacgttttcttgtttggggctggaaaagttgccgaagctgtaattctctcac

SEQ ID NO: 5120 - DNA, 230 bp, Cicer arietinum
ttctttcaacccttggcatgttttcaaattcatagggggagttatctctctcttatggtgtttggtatactttgttcctattgataatttctttgaagcattaccatattgatcatacttgctcttttgttcttcttgcatatgtatttgtcataatcaaaaagggggagattgttagccctaaatcggatcccgggcccgtcgactgcagaggcctgcatgcaagcttt

SEQ ID NO: 5121 - DNA, 367 bp, Cicer arietinum
  misc_feature (341)..(341): n is a, c, g, or t
tctgacacacaatggaaatcatttatcagcaacaagggcttcaattttgtttacaatgtgagcttcatgatcctcaaggcgacctttgatcgaatcattctcccaacggatcaacgttggcacacctgtgagcttgaacctaggatccaccctccatggatgttttgagttcctccatgttggtctatctccaacataagctttcaaaagtgcaatttcatttgatgatgtttccagcttcttgtagatcacaggctcagctctcacacaatcagggcaccagctgagagaggtagaagggtcgttgtcagccaagaagagaatgaggttggctttgtttnggggactctctgatcggaacttctca

SEQ ID NO: 5122 - DNA, 284 bp, Cicer arietinum
acacaagaagactccggtgctagttcatgatggaaaacccatatgggaggcggtgatcattgttgaatacattgatgagatatggccacaaaactcattgcttccagctgatccttatgatagagctcaagcccgattttgggttaaatatatcgatgaaatgatttcgacactttcagcaatcattcgtagcaaaagtagtgaagtttgagagaaggccaaagagaatctatggcaacggttaggagttgttgaggatcaatgtttgaaagacgaaaataaat

SEQ ID NO: 5123 - DNA, 467 bp, Cicer arietinum
gattggaattcccatggcttccaaaactctcttcttccttgtcattctctccttctctgctctctcaacttttgctgaaaatgaagccgaggcagaccctggtcttgtaatgaactattacaaggattcatgtcctcaagctgaagatatcatcagggaacaagtcaaacttctttacaaacgtcacaagaacaccgctttctcttggctaaggaacattttccatgattgctttgtcgaatcttgtgatgcttcattgttgctggactcaactagaagagtcctgtctgagaaggaaacagataggagttttggaatgaggaatttcagataccttgaagacatcaaagaagcccttgaaagggagtgtcctggagttgtttcttgtgctgatattcttgttttgtctgcaagagatggcattgtttcgttaggagggccatttatccctcttaaaaccggaagaa

SEQ ID NO: 5124 - DNA, 115 bp, Cicer arietinum
  misc_feature (72)..(72): n is a, c, g, or t
cgtatgtataaacttatttaatttttattgataaagggagatacaaaaacatgaaatatcacatgtcagganagagaaaggaaaactaaacaagagaacagtttatttgattgaa

SEQ ID NO: 5125 - DNA, 428 bp, Cicer arietinum
accactcttaccaatttggacctaaccactcctgatacatttgactctgcctactattccaatcttaaaattcaaaagggattgtttcagagtgaccaagagttgttttcaaccagtggtgcagacactattgacattgtcaatagtttcaatgacaaccaaactcttttctttgcaaactttaaggcctctatgattaaaatgggtaatattaatgtgttaactggatctcaaggagaaattagacaacaatgtaactttattaatggaaactctgttgaccttgctactactgtgactagagagtcgtcagaagatggcatcgttagttcatactaagtaatttaattagcaaaagtaaggaacctaataaagattaaagagtgtggtctatcttctagaggcatatacatgccctgttcttgtgg

SEQ ID NO: 5126 - DNA, 422 bp, Cicer arietinum
acatgaaagtatagctacagaacttttgaataggatggtgaaatggatcaaaaacatcaaaatttcagatcccttggaagaaggttgcatgctaggacctgttgttagcgaaggacagtatgaaaaaatattgaagtttatctcgaatgctaagagtgagggtgcaaccattttgactggtgggtctcgaccagagcatctaaagaaaggattctttgttgaaccaaccattatcactgatgtgactacttccatgcaaatttggaaagaagaagtatttggacctgttctgtgtgtaaaaacatttagcactgaggaagaagctattgatctagcaaatgacacaatctatggcttaggggctgctgtaatatcaaatgatctagaaagatgtgagcgcattactaaggcttttaaggctg

SEQ ID NO: 5127 - DNA, 376 bp, Cicer arietinum
actccttaactttctttttcgctaattttggtccaaatgctaccacatttgttgttccggctgagattttcccagctaggctgagatcgacttgtcatgggatctcagctgctgcgggaaaggccggagcaattgttggtgcatttggattcttatatgctgcacaaagtaagcataaaaatgagactgatgaaggttatccaactggtattggtgtgaagaattctcttattatgctcggtgttgttaacttcctgggaattgtattcacctttttagtgcctgaagcaaagggaaaatcattggaagagatgagtggggagaatgaagaagatggtgatgaggctatagaaatggcggggtctgctaggacagt

SEQ ID NO: 5128 - DNA, 407 bp, Cicer arietinum
ttggccagagaccccaagcttcggatcctatcagtttccaatgtccgaaaatctatctacttcttagcttccactcggttcttaaattcttggaatctcatgccattcctttgggctcttgtaatatcttattgcaatatagatgttaaaatgagatataatattgaatacagaactaaatctaccacaacattagcttcatactttaatctaccaccatattagcttttcccatattgtagttaatttagtatcggtattcttccaacagccctatccatcgatattgccttatatttgaatcttctaggaaaacgagtattataaactttgatgatccgaagcttggggtctctggccaatcggatcccgggcccgtcgactgcagaggcctgcatgcaagcttt

SEQ ID NO: 5129 - DNA, 255 bp, Cicer arietinum
gagctcggtactcgcgaatgcctctagattctttcaacccttggcatgttttcaaattcatagggggagttatctctcttatggtgtttggtatgctttgctcctattgatgatttcctggaagcatcaccatgtttttatactttctcttttgttcttcttgcatatgtatttgtcataatcaaagagggggagattgttagccctaaatcggatcccgggcccgtcgactgcagaggcctgcatgcaagcttt

SEQ ID NO: 5130 - DNA, 426 bp, Cicer arietinum
aactattgctcgaaaattatgaggagtatgctagacatgccaggctttacactggaatacacgcaaaagcaaagcccaaattcaaaagcggggctataaccgaatcaactaccgctttaaatgttgatcagacgaacacctcggtgcttaatgctgacatcaaaaccacaccagcaagcgctgctttgccattaccattgtcattgccctcaaccactgcagctagaggagctagtcaggatcaggtggtgggtgttctgaccgagtcatctgttaatgtttctaccgctgcggcggtagtttctgctgcttctgcaccacaaaagaaagaagttggaactgctaaagctcaggcagacaagaagaagttagatgctagaaagaaaagtttgaaaagattgtgataaagttgttcaataaatcaaa

SEQ ID NO: 5131 - DNA, 336 bp, Cicer arietinum
tgactttagttttgaggattatttaaatgatcctcgcgaatcagagactttgcgaccattggacatgcataatgggatggaagttcgccttggtctatcgaaggggccagtctgcccaagttttatataaggaaatgactcaaggaacctgcatgttttttcatttaaacttcttgttgtattttcttacgttaatcagtatacagatttttagttccggatttgtgacctggacttttttttccacgcttagaatgcctttttgatttatggaattgatcaattaaaattcccagtttcaatttcttttcaatttttaaaaagaaaattgcatgg

SEQ ID NO: 5132 - DNA, 403 bp, Cicer arietinum
acaaagatatggttgaatcctgtagcctacattattacatcccattaaactcacccccatcaatttaaaaaacagcagcttttactctcctaaccaactccttcctcatcagttgcctgtcaaagcctgatgcagccaaaacccctctattttcctcagcccttctcaagaggtaaggcataacagtctctacaggtccaaatggcatgtatttgctgacctgaaaccctgcattgctcaaaccaaaagaaagtgcctctgacattccatatagttgtgcaaattcaagcttgtggttcacctttccaatccccaattcacgtgcttttgcagcagccaattttcctgattcaacattatgagttgcaagaacaaccccaccaggtccattagcaatcttctc

SEQ ID NO: 5133 - DNA, 293 bp, Cicer arietinum; identical to SEQ ID NO: 1098

SEQ ID NO: 5134 - DNA, 340 bp, Cicer arietinum
accagatgcttagttaacacatttactataacagcacaccacttccaaaacatggatcaaagcagcaccaattgtttcttgtgcctactgtgatctcaatgaaaaaggtaacaattaccaaattcttgttattaacaataacagtgtatttgaggattcactttgtaacaagtaatattgaacataagcattagatatttttcatctttttcaattaacatcttattttgttgaacatactggaaactgaatgtaatgcacaacacggcactcttttgcttacgtatagagaataaaaatcactgagatcctttgagcttctttgcaatacctgcaaagt

SEQ ID NO: 5135 - DNA, 237 bp, Cicer arietinum
atctagattctttcaacccttggcatgttttcaaattcatagggggagttatctctctcttattgtgtttggtatgctttgttcctattgattatttctttgaagaattaccatattgagcatacttgctcttttgttcttcttgcatatgtatttgtcataatcaaaaagggggagattgttagccctaaatcggatcccgggcccgtcgactgcagaggcctgcatgcaagcttt

SEQ ID NO: 5136 - DNA, 234 bp, Cicer arietinum
gactcggtcctcgcgaatgcatctagatttccacagccatgttcagagaagattcaataccattcacagcagaaagaaaaaattgctctcaggagaggtctagagggagacagagagagatgaggggctttgaaacttgaaagaaaggcaaagaagaggatataaaaagaggaagagaaatgggggaaatcggatcccgggcccgtcgactgcagaggcctgcatgcaagcttt

SEQ ID NO: 5137 - DNA, 430 bp, Cicer arietinum
accatacaaggaagagacctgaaccattaacactggaagaagagagtgatcttgaacttgctaataagagattccttgagctatgtcaaaagtgtgttcaagccaatattcctttgttggttgatgcagagcatacatcagttcaacctgcaattgattattttacttactcatctgctatattgcataacaaaggtgaaaaccctattgtgtttggaaccattcagacttatttgaaggatgctaaggagaggttgatcttggcatcaaaggctgctgataaaatgggtattccaatgggatttaaattggtgagaggtgcttatatgtctagtgaaaggaaattggctgctgaattggggtatgcttcaccaattcataaaactattaaggacactcataagtgtttcaatgattgttcttcttttat

SEQ ID NO: 5138 - DNA, 368 bp, Cicer arietinum
accagcaagcgattgcaggaatcagtcatatctcctttggcgaggaagagagcgtttcgccaaaaaagcctgcttcattgtctgaggtggccaagcaacgtgagctcagtggaactatggaaagcgaagacaataagttgaacaagcaactttctgatgcaaagtgcaaggagcttagtggtcatgacatatttgctccaccatctttaaatcaaaccccgaccaataactcctcgcatattggagttgcaagggagcataggcattggagaaagcaatgctgatggagatcagggtgctaattctggagaaccagttaagacagcaaagaagattcttaaccagaaatttgcagaactttctggaaa

SEQ ID NO: 5139 - DNA, 468 bp, Cicer arietinum
  misc_feature (39)..(39): n is a, c, g, or t
tttccgccatgggggaagcgggaattcgattagcgtggncgcggccgaggtacaatacagtcaattgcggcctcttgacccatctgtgtctgctgcacctggtcttgcccaattgtgtagccttgcatacattaagataccaaacttggaagaagattttggtcaagaagcagctgaatacttgagcgaactcactttaagcagtggaaaagaatttagagcaatggttgaggagagagatactacaggaggaaaagtgaaaggacagggaactggaacaattactgctgtaactcttgttgctgtggatgctgagatcagcgtcaatgctgccatgcttcaggaaggacttgctagaatggaaaaaagaaacaggtgggacagatcagcaagaaagcaggcccttgatagcttggaagcgttccaaggagaggctaggacaagcaggcgtggaatgtggcagtatgg

SEQ ID NO: 5140 - DNA, 182 bp, Cicer arietinum
gattactatagggcacgcgtggttataaaataaggcacatcatgttacataagtaggcagacctacttatagtcaacaattttgcgtgtttaacgttatgatcactcttagttattaaaatatttgcccacttgtaaaaatgatcatcaatcgtcactgaaaaggccaccagcccgggccgt

SEQ ID NO: 5141 - DNA, 459 bp, Cicer arietinum
gattcaaacaactttgcgaggtacactggactgaatctgcactatcaaacctcgatatccagatcacaccagcatttgttgacgaagctctctagtcctattgggaggtgtttgccgcaggaaaagccggacatgtcaaagcttacctaacgttcaacaagaatgttcctggatggactgaaggagcactcattggctatttcggaagatattccggcaccaaagacatccacttcgcgccaaccaacgccgctaccggaaagccgctccagcactccgatattttcctgcgcgacaaggtgtccgggacgctccttatgtcggtagagggcgtggcaatttctaatggaagaacgggttggttctcgctagcatgcgtaaacctgctgttgcaaggcagagaggacatcgacgttttcttgtttggggctggaaaagttgccgaagctgtaattctct

SEQ ID NO: 5142 - DNA, 421 bp, Cicer arietinum
acatggaaagtgtgaatgatgaagaaatgttccaaacaacaacaacaacaattgaaacagaacaacatgttggtttcactgttgttcctggttttaggattggtaaaactgttttacagtgtcaagtttaccttacacaaaggtgaaaaattaaaggtggggcccacaacataagaggaaggacatggttgaatgtgatgttgttttgtagggactgaaaagttttgctaggatcaatggggcatttttgtccttttgtgttttggcaattttagaaaaaagaaaaaagaaagctagtggactataatagcattgggaagaaccctttttactttagaatcttttttatttttaatttatgcagattttatcttatttatcaaagacatccccccaaattttgttgatatcagggcggtga

SEQ ID NO: 5143 - DNA, 428 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttgttttacttattccgtgaatcggaggcggggc

SEQ ID NO: 5144 - DNA, 456 bp, Cicer arietinum; identical to SEQ ID NO: 5076

SEQ ID NO: 5145 - DNA, 234 bp, Cicer arietinum
gactcggtcctcgcgaatgcctctagatttccacagccatgttcagagaagattcaataccattcacagcagaaagaaaaaattgctctcaggagaggtctagagggagacagagagagatgaggggctttgaaacttgaaagaaaggcaaagaagaggatataaaaagaggaagagaaatgggggaaatcggatcccgggcccgtcgactgcagaggcctgcatgcaagcttt

SEQ ID NO: 5146 - DNA, 434 bp, Cicer arietinum
acattagagactcttgccagcattgtgggcaaagagagaattgttgtgtccacctcctgctcacttcttcacactgctgtggatcttgtcaacgagaccaagttggatgatgaaattaagtcatggctagcttttgctgcccaaaaaattgttgaagtaaatgcattggctaatgcattctctggcaacaaggatgaggccttcttctctgctaatgctgcagctcaggcttcaagaaagtcctccccaagagtgaacaacgaggctgttcagaaggctgcttctgcattgaagggttctgatcatcgccgtgctactaatgtcagtgcgaggttggatgctcaacaaaagaagcttaatcttccaatcctcccaaccaccactattggatcattccctcagactgtagaactgaggagagtgcgccgtgaatt

SEQ ID NO: 5147 - DNA, 336 bp, Cicer arietinum
aaattgtgtgaaggcccaaatggagggtccattgggaaggtgagcgtaaaatatcaaaccaaaggagatgctaagcccaatgagaaggaggttcaagaaggaaaggcaaagggtgatgctcttttcaaggccattgagggttacgttttggccaatcctaattacaactgatccatccttcaactatacctaacatgagttgatgtcttcttatgttagctttcaatcaaataaactgttctcttgtttagttttcctttctctctcctgaaatgtgataattcatgtctttgtatctccctttatcaataaaaattaaataagtttatacatatg

SEQ ID NO: 5148 - DNA, 422 bp, Cicer arietinum
tggtcgaccaaaagcaactacactcatattttggcaggcctttttaaaaacaaacttattccatccatcccctctggttcttcttcctcatgattacaatcatgaaagaaagaaggggatttcataatctaatcttctaatgtaacttattagctacattacactgctttctaatctcacctttagtaccagtaagagggttattttcagacagaatagtaatggctcttgcaaattccttaaagaagtaatcttggctttttgccattttcttgacaaatggttttgttcttttgtctgtggctaattggtgatcaactagcaacaagcccttgttgtccaagatgtttctgtaataattgttgtctaatttcataggtgttcctctgtcacttcttacatattgtactgcctttggatca

SEQ ID NO: 5149 - DNA, 425 bp, Cicer arietinum
tggtcgaccaaaagcaactacactcatattttggcaggcctttttaaaaacaaacttattccatccatcccctctggttcttcttcctcatgattacaatcatgaaagaaagaaggggatttcataatctaatcttctaatgtaacttattagctacattacactgctttctaatctcacctttagtaccagtaagagggttattttcagacagaatagtaatggctcttgcaaattccttaaagaagtaatcttggctttttgccattttcttgacaaatggttttgttcttttgtctgtggctaattggtgatcaactagcaacaagcccttgttgtccaagatgtttctgtaataattgttgtctaatttcataggtgttcctctgtcacttcttacatattgtactgcctttggatcagga

SEQ ID NO: 5150 - DNA, 454 bp, Cicer arietinum
actcacaatcaacatggggacaattcaaatcttgtctttggaaacagtggttgacatattggaggagtccagattacaatctagtcagatttgttttcacattggcttgttccctcatgttaggatcagtattttggaaagttggcaaaaacagggggaactcaaccgacctatcgcttgttataggagcaatgtatgctgcaattatttttgttggagttaacaattgtcaaacagttcaaccaattgtagccattgaaagaacagtgttctatagagaaagggctgctggaatgtatgctcctttgccttatgccttaccacaggttttcatagaactaccatttgtgctttttcaaacaacatattactcactcatagtgtattctatggtgagctttgaatggaaagtggaaaagttcttttggatcttctttgtcagctacttctcctt

SEQ ID NO: 5151 - DNA, 193 bp, Cicer arietinum
acccccatggagaaccactacatatatgacatcaaaatggctctctctgtgtcctaaaaagcatgtccctattggtaagggatttggggtggtgaatctcaattatctaacatcaccataaatttttcactaccaaattttggttttttatagttatttctgttgagcttgatgaatattgcaattcacaagt

SEQ ID NO: 5152 - DNA, 404 bp, Cicer arietinum
tccaagcaatcctgagtagctgcgtgatggatcttctatatcaacgcccacgtttcaccccgtttgccgtcacccatccacgtagtggagtcaacctgaaccgtgcaatttctcaggcctttgtctgctatgatcagttctgcgaacggctcttgcgatgtcagcaaagctgggcgaattgggccgaaatatcggagtgctggagcggctttccggtagcggcgttggttggcgcgaagtggatgtctttggtgccggaataccttccgaaatagccaatgagtgctccttcagtccatccaggaacattcttgttgaacgttaggtaagctttgacatgtccggctttccctgcggcaaacacctcccaataggacttgagagcttcgtcaacaaatgctggt

SEQ ID NO: 5153 - DNA, 480 bp, Cicer arietinum
ccctaaatacacttgtttcccacaatcccatatatgagattcccaccggccagtcctccggtaaaaggtaacaccacggtactgtgaacttcttgaacgtggtccacgacggctttttttaattggctgttgttgcaacacgtcaattttgttccccactaatccattgacaagtggcggttccgattcacaaaatttaattccagcccattgtgcccttggaaaattggtagactcgttatctaccggaaaaaattgccgggtaactaccggcgattccaaattgtggtctttaatcgaaaatccgaatattttacctggtgtattattacttttctttttttacctttttcaccgtcttcttctgatgaattaccgtcttctacaacaagtagagcggatgaaattgaatttgattccgatctaaccgttataccttcatcggattcatactccattgtctgatcaggggaatcattt

SEQ ID NO: 5154 - DNA, 459 bp, Cicer arietinum
aagaacagaaccaacagttcagatagtagtagagaccatcgaagtgaaaccagattaccatctcaccaaaggctctatctttaagcttttacctaaacactaaatataaccaaatcaggcgcaggtatcccattcgagccgaatagaacgaaaaaacatatgacaaaaacatgaaaaggaacatagtcgcaaagaggcataacaaatactaacatgacaaccttagcaaaaggtaacaaaaataacaggaaatacaaatggaagaagcgaatactaatactaatactgattggagacttgagaaatgggtttttgatccatgtcgatccatctcctttactccattttcaggaaagagcaactccccagggaattggagctacaaaatccccccaaaattcaatttatctggattttccattgaggaataatggattttcgattgattgaggaatgggt

SEQ ID NO: 5155 - DNA, 425 bp, Cicer arietinum
tctctagagccatggcttccaaaactctcttcttccttgtcattctctccttctctgctctctcaacttttgctgaaaatgaagccgaggcagaccctggtcttgtaatgaactattacaaggattcatgtcctcaagctgaagatatcatcagggaacaagtcaaacttctttacaaacgtcacaagaacaccgctttctcttggctaaggaacattttccatgattgctttgtcgaatcttgtgatgcttcattgttgctggactcaactagaacagtcctgtctgagaaggaaacagataggagttttggaatgaggaatttcagataccttgaagacatcaaagaagcccttgaaagggagtgtcctggagttgtttcttgtgctgatattcttgttttgtctgcaagagatggcattgtt

SEQ ID NO: 5156 - DNA, 424 bp, Cicer arietinum
tggtcgaccaaaagcaactacactcatattttggcaggcctttttaaaaacaaacttattccatccatcccctctggttcttcttcctcatgattacaatcatgaaagaaagaaggggatttcataatctaatcttctaatgtaacttattagctacattacactgctttctaatctcacctttagtaccagtaagagggttattttcagacagaatagtaatggctcttgcaaattccttaaagaagtaatcttggctttttgccattttcttgacaaatggttttgttcttttgtctgtggctaattggtgatcaactagcaacaagcccttgttgtccaagatgtttctgtaataattgttgtctaatttcataggtgttcctctgtcacttcttacatattgtactgcctttggatcagg

SEQ ID NO: 5157 - DNA, 425 bp, Cicer arietinum; identical to SEQ ID NO: 5149

SEQ ID NO: 5158 - DNA, 179 bp, Cicer arietinum
acggcccgggctggtggccttttcagtgacgattgatgatcatttttacaagtgggcaaatattttaataactaagagtgatcataacgttaaacacgcaaaattgttgactataagtaggtctgcctacttatgtaacatgatgtgccttattttataaccacgcgtgccctatagta

SEQ ID NO: 5159 - DNA, 214 bp, Cicer arietinum
acccccctggagaaccactacatatatgacatcaaaatggctctctctgtgtcctaaaaagcatgtccctattggtaagggatttggggtggtgaatctcaattatctaacatcaccataaatttttcactaccaaattttggttttttatagatatttctgttgagcttgatgaatattgcaattcacaagtacctcggcttttaccacgcta

SEQ ID NO: 5160 - DNA, 429 bp, Cicer arietinum
accacgcgtttaccaacggattcgacgacagctccgctagttcgtgagcgatcacgctcaccattccgtcaactccgacgtcgccgttgggcggcgacagttttcccggtccacctcctcccatgtatgctggcatggcgaatggatacgcacaaacttccgcacactgtttccctgaattccccacccaagcgtagggaagcgtgtaacctaccttcgacggaaacgtgaaatagtggaaaccgcacaccgcgcggcagaattcgtccatcgtaacatcttccgccgttaaaacaaggtagattcctttccggtgatcgaccgggaacggtttagatctcaccgccgttgctattacgtcctggattgaaagtcgcgtgaggcgctttccgttggaatagcgtaggtcggaatattctccggcgattg

SEQ ID NO: 5161 - DNA, 479 bp, Cicer arietinum
ccctaaatacacttgtttcccacaatcccatatatgagattcccaccggccagtcctccggtaaaaggtaacaccacggtactgtgaacttcttgaacgtggtccacgacggctttttttaattggctgttgttgcaacacgtcaattttgttccccactaatccattgacaagtggcggttccgattcacaaaatttaattccagcccattgtgcccttggaaaattggtagactcgttatctaccggaaaaaattgccgggtaactaccggcgattccaaattgtggtctttaatcgaaaatccgaatattttacctggtgtattattacttttctttttttacctttttcaccgtcttcttctgatgaattaccgtcttctacaacaagtagagcggatgaaattgaatttgattccgatctaaccgttataccttcatcggattcatactccattgtctgatcaggggaatcatt

SEQ ID NO: 5162 - DNA, 249 bp, Cicer arietinum
gattggatccaataatgattgggagaccacctaaccaaatatttgttagtgtagcgagatttgatgtgaacaagaccatcataagtcttggaaggttcgacttcaaattgagctaatggatctaaaatcttatcagctgaaaattgaagaagaccatattgttgaatattatcactttgatatcttaagtacttctggttgttatttgattttaggcacataatcactggtaatcccgccatctagaca

SEQ ID NO: 5163 - DNA, 459 bp, Cicer arietinum
gattcaggatccccactcgtaaatctcttaataaaccaagttttttgcatgttcaaaagcgaaatcacattaaaatcatgcacatccgacctaaacaacgcagcagcttcattagtttcgcgaggatcattcccatcgactaatatccaattatccgtagagagtctccaaaacttgttcatataattggatttaatgcaaatagtaccattagaagtgacaaacatttgatgagccacctttggatcattaagattatcatacccaaattgtagacatggaagttgattaattgtgataacccctaaatattttccattatttcctttaaatgtgacatatgttttgggaaattgaaagattgatttccaatctatgacatggaatacgtctttagagccggtatcaatttgacttgattcggcaaataagtatgatacgaaggacccaccaacggta

SEQ ID NO: 5164 - DNA, 437 bp, Cicer arietinum
aactattgctcgaaaattatgaggagtatgctagacatgccaggctttacactggaatacacgcaaaagcaaagcccaaattcaaaagcggggctataaccgaatcaactaccgctttaaatgttgatcagacgaacacctcggtgcttaatgctgacatcaaaaccacaccagcaagcgctgctttgccattaccattgtcattgccctcaaccactgcagctagaggagctagtcaggatcaggtggtgggtgttctgaccgagtcatctgttaatgtttctaccgctgcggcggtagtttctgctgcttctgcaccacaaaagaaagaagttggaactgctaaagctcaggcagacaagaagaagttagatgctagaaagaaaagtttgaaaagattgtgataaagttgttcaataaatcaaacttttcttatt

SEQ ID NO: 5165 - DNA, 424 bp, Cicer arietinum
tggtcgacctcaccaccattacattgcctatgccaaaagcaactacactcatattttggcaggcctttttaaaaacaaacttattccatccatcccctctggttcttcttcctcatgattacaatcatgaaagaaagaaggggatttcataatctaatcttctaatgtaacttattagctacattacactgctttctaatctcacctttagtaccagtaagagggttattttcagacagaatagtaatggctcttgcaaattccttaaagaagtaatcttggctttttgccattttcttgacaaatggttttgttcttttgtctgtggctaattggtgatcaactagcaacaagcccttgttgtccaagatgtttctgtaataattgttgtctaatttcataggtgttcctctgtcacttctta

SEQ ID NO: 5166 - DNA, 425 bp, Cicer arietinum; identical to SEQ ID NO: 5149

SEQ ID NO: 5167 - DNA, 179 bp, Cicer arietinum
acggcccgggctggtggccttttcagtgacgattgatgatcatttttacaagtggacaaatattttaataactaagagtgattataacgttaaacatgcaaaattgttgactataagtaggtctgcctacttatgtaacatgatgtgccttattttataaccacgcgtgccctatagta

SEQ ID NO: 5168 - DNA, 431 bp, Cicer arietinum
attaggtttccggaactagcaatgatatatgcagcaagaggtgctcacttgctctgctatcctggggcttttaacatgacaactggaccattgcattgggagttgttgcagagggccagggctacagataatcagttatatgtggcaacctgttcacctgctcgggatgctgcatctggttatgtggcttggggtcactccactcttgttggtccatttggagaagttctggctactacagaacatgaggaggcaaccattatagcagaaattgattattcaatattggagcagagaaggacaaacctccccgtgactaagcaacggcgaggtgatctataccaattggtggatttgcagaggctgaattctcactgagtggagcatctgcataattataataccccgtaagaagcatgagcgtgtcatct

SEQ ID NO: 5169 - DNA, 420 bp, Cicer arietinum
tactataagtcacgagtggcggcatcatggatcttcgatataattaccctttcttcaacttttttgccctcaaacatcaaaatatcgatagtcatctctgacctggaactttctgatgactttggctgctaagatccaatctgctcaatcgttttgatagatcagccatctggagagattggatgttccagcacacattggtcgaaacgataaatagtagagctgaaatcgcctttccggtagcggcgttggttggcgcgaagtggatgtctttggtgccggaatatcttccgaaatagccaatgagtgctccttcagtccatccaggaacattcttgttgaacgttaggtaagctttgacatgtccggcttttcctgcggcaaacacctcccaatagggcttgagagcttcgtcaacaa

SEQ ID NO: 5170 - DNA, 336 bp, Cicer arietinum; identical to SEQ ID NO: 5131

SEQ ID NO: 5171 - DNA, 428 bp, Cicer arietinum; identical to SEQ ID NO: 5125

SEQ ID NO: 5172 - DNA, 459 bp, Cicer arietinum
accaagattgcttctgaaggactcaaacatcgtgtgtttgagatctcattggctgatcttcaaggtgatgaggataatgctttcaggaagattaggttgagggctgaagatgttcagggcaagaatgtcctcaccaacttttatggtatggatttcaccactgacaagctcaggtctttggtccgtaaatggcaaactctcattgaagctcatgtggatgttaagaccactgataattataccttgagaatgttctgcattggctttaccaagagacgcagtaaccaagtgaagagaacctgctatgctcaatccagccagatcagacagatccgcaggaagatgagggagatcatggttaaccaagcaacatcgtgtgatttgaaagagcttgttcgcaagtttatccctgagatgattggaaaggagattgagaaggctacatctagcatttaccct

SEQ ID NO: 5173 - DNA, 426 bp, Cicer arietinum
tggtcgaccaaaagcaactacactcatattttggcaggcctttttaaaaacaaacttattccatccatcccctctggttcttcttcctcatgattacaatcatgaaagaaagaaggggatttcataatctaatcttctaatgtaacttattagctacattacactgctttctaatctcacctttagtaccagtaagagggttattttcagacagaatagtaatggctcttgcaaattccttaaagaagtaatcttggctttttgccattttcttgacaaatggttttgttcttttgtctgtggctaattggtgatcaactagcaacaagcccttgttgtccaagatgtttctgtaataattgttgtctaatttcataggtgttcctctgtcacttcttacatattgtactgcctttggatcaggaa

SEQ ID NO: 5174 - DNA, 179 bp, Cicer arietinum; identical to SEQ ID NO: 5167

SEQ ID NO: 5175 - DNA, 423 bp, Cicer arietinum
tggcaccatagttaagtgagagaattacagcttcggcaacttttccagccccaaacaagaaaacgtcgatgtcctctctgccttgcaacagcaggtttacgcatgctagcgagaaccaacccgttcttccattagaaattgccacgccctctaccgacataaggagcgtcccggacaccttgtcgcgcaggaaaatatcggagtgctggagcggctttccggtagcggcgttggttggcgcgaagtggatgtctttggtgccggaatatcttccgaaatagccaatgagtgctccttcagtccatccaggaacattcttgttgaacgttaggtaagctttgacatgtccggcttttcctgcggcaaacacctcccaataggacttgagagcttcgtcaacaagtgctggtgtgatctggatat

SEQ ID NO: 5176 - DNA, 372 bp, Cicer arietinum
ggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggttagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgcacc

SEQ ID NO: 5177 - DNA, 422 bp, Cicer arietinum
acacaagaagactccggtgctagttcatgatggaaaacccatatgtgagtcaatgatcattgttgaatacattgatgagatatggccacaaaactcattgcttccagctgatccttatgatagagctcaagcccgattttgggttaaatatatcgatgaaatgatttcgacactttcagcaatcattcgtagcaaaagtagtgaataccgagagaaggccaaagagaatctatgggaacggttaggagttgttgaggatcaatgtttgaaagacgaaaataaattttatggaggagacaacattaacattgtagacatagctctcggatcttttgtcaaatttattgaggttttggaaaatacatttgaagtggaaattttgcaaactgagaggttcccccatttgcatttatggtttaata

SEQ ID NO: 5178 - DNA, 424 bp, Cicer arietinum; identical to SEQ ID NO: 5165

SEQ ID NO: 5179 - DNA, 424 bp, Cicer arietinum
tggcaccatagttaagtgagagaattacagcttcggcaacttttccagccccaaacaagaaaacgtcgatgtcctctctgccttgcaacagcaggtttacgcatgctagcgagaaccaacccgttcttccattagaaattgccacgccctctaccgacataaggagcgtcccggacaccttgtcgcgcaggaaaatatcggagtgctggagcggctttccggtagcggcgttggttggcgcgaagtggatgtctttggtgccggaatatcttccgaaatagccaatgagtgctccttcagtccatccaggaacattcttgttgaacgttaggtaagctttgacatgtccggcttttcctgcggcaaacacctcccaataggacttgagagcttcgtcaacaaatgctggtgtgatctggatatc

SEQ ID NO: 5180 - DNA, 424 bp, Cicer arietinum
tccccggggccaaaagcaactacactcatattttggcaggcctttttaaaaacaaacttattccatccatcccctctggttcttcttcctcatgattacaatcatgaaagaaagaaggggatttcataatctaatcttctaatgtaacttattagctacattacactgctttctaatctcacctttagtaccagtaagagggttattttcagacagaatagtaatggctcttgcaaattccttaaagaagtaatcttggctttttgccattttcttgacaaatggttttgttcttttgtctgtggctaattggtgatcaactagcaacaagcccttgttgtccaagatgtttctgtaataattgttgtctaatttcataggtgttcctctgtcacttcttacatattgtactgcctttggatca

SEQ ID NO: 5181 - DNA, 341 bp, Cicer arietinum
tgcgtcacttcaaagctacttctctcttccatggcgttgcccaatcagcaaactgttgattaccctagtttcaagcttgttatcgtcggtgacggtggcactgggaagactacatttgtgaagaggcatcttactggtgaatttgagaagaaatatgaaccaactattggtgtggaagttcatccattggatttcttcacaaactgtggaaaggttcgtttctactgttgggatactgctggacaagagaagtttggcggtctcagagatggatattatatccatgggcagtgtgctattataatgtttgatgttactgcccgactaacatacaagaatgt

SEQ ID NO: 5182 - DNA, 420 bp, Cicer arietinum
tcctatcagtcctgagtggctgcgtgatggatcttcgatataatcgcccatttttcaccttttttgccgttacccatcaacatattgaagtcaacctgaccctggcactttctgatgactttgtctgctatgatcagttctgctctatggttcttgatatatcagccctctggacacgattgggtgttccaccacacatttgcagaagccattgaatacgggtctggaatcgcgtttccggtagcggcgttggttggcgcgaagtggatgtctttggtgccggaatatcttccgaaatagccaatgagtgctccttcagtccatccaggaacattcttgttgaacgttaggtaagctttggcatgtccggcttttcctgcggcaaacacctcccaataggacttgagagcttcgtcaaca

SEQ ID NO: 5183 - DNA, 456 bp, Cicer arietinum
ccctaaatacacttgtttcccacaatcccatatatgagattcccaccggccagtcctccggtaaaaggtaacaccacggtactgtgaacttcttgaacgtggtccacgacggctttttttaattggctgttgttgcaacacgtcaattttgttccccactaatccattgacaagtggcggttccgattcacaaaatttaattccagcccattgtgcccttggaaaattggtagactcgttatctaccggaaaaaattgccgggtaactaccggcgattccaaattgtggtctttaatcgaaaatccgaatattttacctggtgtattattacttttctttttttacctttttcaccgtcttcttctgatgaattaccgtcttctacaacaagtagagcggatgaaattgaatttgattccgatctaaccgttataccttcatcggattcatactcc

SEQ ID NO: 5184 - DNA, 420 bp, Cicer arietinum
gcatggaagcaagaccgttggaagatgggcttgcagaggccattgatgaaggcacaattggaccaagggatgaccccaaaatccgttctaaaatcttgtcagagcagtatggttgggataaggatcttgctaagaagatttggtgttttggacctgagaccactggacccaacatggtggttgatatgtgtaagggagtccagtatttgaatgaaatcaaggattctgttgttgctggatttcagtgggcatctaaagaaggtgctttagcagaagaaaacatgagagccatttgttttgaagtgtgtgatgttgtcctccacactgatgctatccatagaggaggtggtcagatcattcctactgccaggagagtgttctatgcctcacagctgacagccaatcctaggcttcttgagc

SEQ ID NO: 5185 - DNA, 427 bp, Cicer arietinum
gttcattctaggaatatcgctgtgtgatggcaatgagatcggcgctgagtcgagggatcgtgactcgttcgatggactcaacatctcgtggagctttcagtcgtttctacagcggcaaaggtaagattcttagcgaagaggaacaagccaaagaaaacgtctacatccagaaatgggagcgggaaaggttggagaaactgaatctacagaatgataaggctaaggctgagaaggacaaagacactactgataagaaacctgatgggactcaaaagagctgactttaccagtcatgctatgctagccatgaaggtcacttgtgggaaacaatcatggggaataaaacacattgactctgagtgaactatggtctttgtatagattgtatgttttttttctctctcgtttatttgtagtttcttcaatg

SEQ ID NO: 5186 - DNA, 373 bp, Cicer arietinum
ctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgt

SEQ ID NO: 5187 - DNA, 429 bp, Cicer arietinum
actgcttgtgttgcaatcattagaaacaacctactttttgttgcaaatgccggtgattcacgctgtgtaatatctaggaagggtcaggcatacaatttgtctagagatcacaaacctgatcttgagattgagagggatagaatctataaagctggcggttttattcacgcaggacgagttaacggaagtttaaatcttgcaagagctataggtgacgtggactttaagaacaatagatttttgtctgccgaaaaacaagttgttaccgccaagccagatataaacactgttgacctttgtgacgatgatgaatttttagtgctagcttgtgatggcatatgggattgcttgtcgagccaacaattggtcgattttgtgcgtcaagaacttctcatggaaaccaaactttctgaggtttgtgaaagagtg

SEQ ID NO: 5188 - DNA, 372 bp, Cicer arietinum
aggaaaagccttactggatcataaagaattcatggggacagaattggggtgaggaaggatattacaagatctgcagaggtcgaaatatatgtggagtggattcaatggtctcaactgtagctgcagttcatgcatccaacaattaataatacggagatgctggttctggtggtctcatcctatgtgacacgactctagttcaatttgtgtaaatatataatcatgaagttgtgaatttagcttctggttctgggagaactatctccatataggatcagaaaactaccacaatcatgttatttatgtagttggcaattatgtatgcttgttactcaagtgttgtttatccatagccatggcaacatggtaggt

SEQ ID NO: 5189 - DNA, 432 bp, Cicer arietinum
agaaaatagtgataaagagaaacctcaaaaatgtctaggaacagaacattattagagagtgcaggggaatggtttgaatacaacgacaaaggtaaatggttaaatgaaatgaaaggtagcataagtttaattgctcaaataattgtaactatgacattttcactcgccactaatccgccgggcggcgtcgtccaagttggtctaagtgacaaagctttttgttccggtttagtatgcgccggcgaagccgtcatggctacggtgaaccataataaatatttaggatttatgatatgcaatacaatttgtttcattgcatcaataagtgtttgtctattgcttgttagtggaattcaaatcaacaattcattttcaatatggctcttatcaacaggaatgtgtgtctcactcacaagtcttgctcttacttac

SEQ ID NO: 5190 - DNA, 426 bp, Cicer arietinum
tggatccggtatcaatttgacttcattcggcaaataagtatgatacgaaggacccaccaacggtataattttctgtataatgacctaattggacgtgcaaaagtcgaacctttttcatgttaccttcttctacgtaaagtggtttgaataatgtgcatgcccaattgcttttattttcatctggttcattggctgatgctgtaatccaataatgattgggagaccacctaaccaaatatttgttagtgtagcgagatttgatgtgaacaagaccatcataagtcttggaaggttcgacttcaaattgagctaatggatctaaaatcttatcagctgaaaattgaagaagaccatattgttgaatattatcactttgatatcttaagtacttctggttgttatttgattttaggcacataatcactg

SEQ ID NO: 5191 - DNA, 438 bp, Cicer arietinum
actgagacattgtcacaacaacaacccacaagagcttaaggggccccagggctggtatgatcttctaccggaagggacctaagccacccaagaagggtcagcccgagaatgcagtttatgattttgaagacaaaatcaactttgctgttttcccctcccttcagggtggtcctcacgaccaccagattggtgcccttgctattgctttgaaacaggccacgacgcccggattcaaggcatatgccaagcaagttaaggccaatgcagttgcacttggaaattacttgatcagcaagggatacagccttgtcactggaggaactgaaaatcatcttgtcttgtgggatcttcgccctcttggcttgaccggcaataaggtggaaaaactttgtgatctatgtaacatcactgtgaacaagaatgctgtttttggtgata

SEQ ID NO: 5192 - DNA, 427 bp, Cicer arietinum
aggaagcgcagttgaagcgatggaaggatgcagctgttgaagctgtatcattgcgtgagaaatcacattcactaagagcaaaattgagtgggaagacaagcgaactcaagagcctcgtaaacaaatgtgctgaacaggttttggaaataaagtcttcaaaagcattgattgaaaagttacagcagtcgaatcaggagttagaatttgttctggatatgtatggtccggaggattatgcgaaaagcttgccagaagttagagaatctgaaagtaaagctcgctctcaagttgaaatgctgaaaaatgctttagatgaacatggtctagagttgagagtaagagctgctaatgaagctgaagctgcttgtgaacaaaggcttaaagccgcagaagctgaaatagaggacttaagggccaagctggatgc

SEQ ID NO: 5193 - DNA, 431 bp, Cicer arietinum
accatggtctaaaaggctgcgagatgttcaacctaatgtccttaactaattcgtccaacaaggactgtgttaaggaatggtatgaaagaatcttgatctccactaaataccataactcttacacctgatttgacaagtgtccctagaagagatacggttggagtatcataaaaacttttgctatcaatcccaagaactacgcaaccttgccataaggtacttttttttttttttttttttttttctatttggaaatgaacagatggaactaagtggaactgtgcaaaagttgatgaaccaatgaacaggaatacagtaaaggtctgattttcagacaatataaagcacaatgaacaaaacattcagctaaaatgtgctgttcagatagaagtataatcccacaagcgcaacaattcccacgacaactgcaa

SEQ ID NO: 5194 - DNA, 333 bp, Cicer arietinum
actaaggatgacctcaagcttccatctgatgaaagtctgctttcacagatcaaggatggatttggtgagggtaaagatctgattgtgagtgttatgtctgccatgggtgaggagcagatttgtggccttaaggacattggtcccaagtaatatatagagcgccataaatgctgcttggaattgagatggtatatttaatatttgtgtgtttgctgtgtaaagatataaacctaagtttgagaaattcttactagatatggtaatggttgactttattgagacgttgaccacttatatttttgtggtatgagatcaataattgaaccatcaagt

SEQ ID NO: 5195 - DNA, 173 bp, Cicer arietinum
gaggtacccactagccagtcaacaatggccatgtcatctttagttccatctgcttcaatggaacccataagtgagtggacagctgacaataatcaaatgcccaagcctaatagaagtgtttcagagccagatattggtagaagcccaagacaggaaacgacatcgtctgatgt

SEQ ID NO: 5196 - DNA, 148 bp, Cicer arietinum; identical to SEQ ID NO: 5051

SEQ ID NO: 5197 - DNA, 149 bp, Cicer arietinum
accatggtttgtgtattgctgctatttatataatgaactatatagcaagcgcgtaaaaataataattctgcatgttaattttcttgccagctggggaagtcattatcattattagttataacatattttgcttgaaaaattgacattct

SEQ ID NO: 5198 - DNA, 331 bp, Cicer arietinum
ggccaactatccaatatgagtaagcttcagagtgatgctttgagagaagccatctcaggaatcacggctgattccaaggagaaaaacaggaaatttgtggagactattgaactccagattggtcttaaaaactatgatccacaaaaggataagcgtttcagtggttctgttaaattgcctcacattcctcgtcccaagatgaaaatctgtatgcttggagacgctcagcatgttgaggaggcagagaaaataggattggactggatggatgttgaagctttgaagaagctaaacaaaaataagaaattggtgaagaaacttgcaaagaagt

SEQ ID NO: 5199 - DNA, 383 bp, Cicer arietinum
gccgcgccccaatctcgtttctcacttcttccctccgagccacccagaatgactaagagaaccaagaaggccggtattgttggcaaatacggcacacgatatggtgccagtttaaggaagcagattaagaagatggaagtcagtcagcacagtaaattcttctgcgagttctgtggaaagtatgctgttaagaggaaggctgttggtatctggggctgcaaagattgtggaaaggtgaaagctggtggtgcatacacattgaatactgccagtgctgtaactgtgcgaagcaccatccgaaggctgagggagcagaccgagagttagacaaccagtttacattattctcattttgttttctaagtcattgcagaaacttttgt

SEQ ID NO: 5200 - DNA, 337 bp, Cicer arietinum
tgtgttgttagcgattttatctttgtcttttgagaatatgtctggctgcaactgtggaagtagctgcaactgtggtgatagctgcaaatgcaacaagaggtctagtggattgaactatgccgaaggcggcgaaaccacagagacggtggttttgggcgttggtccgacgaagattcagttcgagggagctgaaatgagtgttgcagctgaagatggtggctgcaagtgtggatcaagctgcacatgtgacccttgcaactgcaagtgaggtgcatatagcaaatgaaagcttgaggcagagatattggaaccaatatgtgtaattgtgtgtatcggt

SEQ ID NO: 5201 - DNA, 428 bp, Cicer arietinum
acaattttgttcaaaattgcccttctgtatatgaaacattgatgcattgagtctgtttttattgcagtattttggaccgagttttgtccacgacggaagcaagatgtcactatcacctccacaatatgtagacccttatgcactcttagaagatgaaaggatatctcagatacagatagcacctcagctaaattgaattaaaggcaacattaggaaacctagtcacatatattgactgaattctgtcttttgcattttgcatatatgttgtgtatagtttatttaaatctaaatgaaagccctattagtagtgacattactcttaaatttttattttccacttagaagttaaatatgtctggattaagttgcagatcatatgaagtccatacaattgtctgaaaaaaatgaagttttgatagcttctg

SEQ ID NO: 5202 - DNA, 426 bp, Cicer arietinum
acgtttggtggaaatattagaggattataaactgaccagacaacagagagaagaagataagagacggcagagggaccaaaagaagatgcaagatctactcctaaatcaaaaggaagctatatatgggtctaaacctagtccaagaaaaactaacagcttccgaaagacaaatgggtatcgtgcaaatggcaatggcaatggcaatgtatcaatgccgcctacaccgcgccggaactcagtgagcggtggaacatctgaactacatacacctcgttcctactccagtcgtcataacggatacttcaacgaaaatagaaggttgtctactgcacctctgaactttgtggctatacctaaggaagatacaatgtcatatagttgcggttcggaacccgagtcccctcctcaagcttaagctcaataaaa

SEQ ID NO: 5203 - DNA, 199 bp, Cicer arietinum
gtggaagctaaactggtggagcttaaagatgctatttctggtggatcgacccaaactattaaagatgccattgctgccctcaaccaggaagttatgcagctaggtcagtctctatataaccagcctggagctgcaggaccagcaggacctacaccccctggtagcgagtctggcccctcagaatcatcaggcaagggac

SEQ ID NO: 5204 - DNA, 437 bp, Cicer arietinum
acaatgggagatgaggcgttgcagttatttgagcatatgaatgagctgggtttggagataacttcggagactttgcttgcagtgttatcggcttgtggcagtgcagaggctgtggaggatgcttacctacattttgaatccatgaaaaacaagtgtggaattgaaccaggggttgagcactacatggggcttttggaagttcttggacaatctggatacctcaaagaggctgaggagtttattgagaagttgccatttgggccaacagtgacagtattggagaccctcaagagttatgctcgaattcatggagatattgatcttgaagaccatgttgaggagttgattgttagacttgacccatcaaaggctgttgcaaataagatccctacgccgcccccgaaaaagtattctgcgattagcatgctcgaaggcag

SEQ ID NO: 5205 - DNA, 440 bp, Cicer arietinum
ctgatgcaattcagaaggttgctgctgcttatgattgtaaaattgtcgagggtgtgcttagccaccaaatgaagcagtttgtgattgatgcgaataaggttgtcctaagtgtatctaatcctgacacaagggttgacgatgccgagttcgaggagaacgaagtttatgcaattgatattgtagccagcactggtgaaggcaagcctaagctgttggatgagaagcaaacaactatttataagagagctgttgatagaagctatcacttgaagatgaaagcatctcggtttatttacagtgaaattacccaaaactttcccatcatgccattctctgccagggctttggaagaaaaaagagctcgtctcggtttagtggaatgcatgaatcacgagctcctgcagccgtatcctgttctacacgaaaaggctggtgattat

SEQ ID NO: 5206 - DNA, 316 bp, Cicer arietinum
accaaaattgcaagggattaccaaggaaaatcaaagggtttttttcaggcaaactcattcttgctcttgggttgaggcaccatttgttgcatccatgggctcagcttgagcttcaccttcagcacccttctttcctttcttcttctttccaccacctttcttctttgtctttatgcccaatgctagccaggccttaatttcgggatcatctacagttttagtaggctgcacttcctggagtgaatgagttgtgatgcgatccgatccatttggcattaacaagaccgtgaatttgatgtgtgcaacataatcacca

SEQ ID NO: 5207 - DNA, 126 bp, Cicer arietinum
actaggttgaattactattgcgacactgtcatcagtagggtaaaactaacctgtctcacgacggtctaaacccagctcacgttccctattggtgggtgaacaatccaacacttggtgaattctgct

SEQ ID NO: 5208 - DNA, 435 bp, Cicer arietinum
acaagaagattgccaaaagggctgatgcatttttgcagggacttattgaggaacatcaaagtggaaatcaaagtaatggagatactatgattgatcaccttttgaatttaaggaagtcacaacctgagtattattctgatcacatgatcaaaggtcttatccaggctatgcttcttgcgggaacagacacgtcagctgtgacaatagaatgggtgatgtctgaattattgaaccatccagatgttttgaacaaagcaaaagaagaaatagaaactcaaattggaaaagacaaattaatagaagaacatgatttatcaaaactcccatacctacaaaacataatcaatgagacacttcgattgcatccaccagctccactatcattgccacattattcttctgaagattttactcttggaggattcaatgttccaa

SEQ ID NO: 5209 - DNA, 489 bp, Cicer arietinum
atgacgtcgcatgctcccttccgccatgggggaagcgggaattcgattagcgtggtcgcggccgaggtacccttctttccctgcagacgttagctcgtgtgcaatctcagattcgttctaggagggtcagaatgttagaggagaatcaggctctgcagaaacagctcttacagaagcatgcaagggagcttgagaccatgcggattggggaggaatgggatgatagcctacgatcaagagaacaaattgaagccaaattactgagcaagtatgaggctactatgagaagagaaagggcactggcttatgcattcactcatcagcaaaacgggaagaacatgtctagatcgatgaatccaatgttcacggatccaaccaatcctgcatggggctggagctggttagaacgatggatggcagcccgaccttgggagagccgtggccttgtggataaagaactaaatgatcattcatctgttaaaagttcaa

SEQ ID NO: 5210 - DNA, 266 bp, Cicer arietinum
actttcatgtacaggcacactttcattctctcaagttcaaagaaacaagaaatttggagaacagttgagaagttactagtagacaaccaagttgaggtaagagaacatgccgcagcagttttagcaggcttaatgaagggtggagatgaagatctagctaaagatttccgtgatagagcttatgtagagggaaatattatacaaaagagaagaaaatcgagaaatgcaagctctggttcagctgtagcatcgattcatggtgcagt

SEQ ID NO: 5211 - DNA, 261 bp, Cicer arietinum
acgagcttggtcgtcagccagcaaacactaaattatcaagcaacaagacagtcaggaggatccgtgttcgagggggtaatgtgaagtggagagctcttagattggatactggtaacttctcatggggtagtgaagcagtaactcgcaagactcgtcttctggatgtggtttacaatgcctcaaataacgagcttgtccgaacacagactcttgttaagggtgctattgtccaggtggatgctgcaccattcaagcagtggt

SEQ ID NO: 5212 - DNA, 293 bp, Cicer arietinum
acgacactgttcatggtcaatggaagcattttgaccttaaggttaaggactctaaaacccttctctttggtgagaagaccgtcactgtttttggaactaggaaccctgaggagattccatggggtgaggttggagctgattatgttgttgagtcaactggtgttttcactgacaaggataaagctgctgctcacttgaagggtggtgccaagaaggttgtcatttcagccccaagcaaagatgcacccatgtttgttgttggtgttaacgaaaatgaatacaagccagagctt

SEQ ID NO: 5213 - DNA, 272 bp, Cicer arietinum
atatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgc

SEQ ID NO: 5214 - DNA, 429 bp, Cicer arietinum
agtgaaacagctgtgattgctgagacaggggactcatggtttaactgtcaaaagctgaaattgcctgagggatgtgggtatgagtttcaaatgcaatatggctcaattggatggtccgttggtgcaactcttggctatgcacaagcggtcccggagaagcgagtgattgcttgcattggtgatggaagctttcaggtaactgctcaggatgtatcaacaatgctgcgatgtggacagaagaccatcatcttcctgataaacaattgcggatacacaattgaggtagaaattcatgatggaccatacaatgttatcaagaactggaattacactggattaattgatgcaattcacaatggtgaaggaaaatgttggactaccaaggtagtgtgtgaagaggagctagttgaagcaattgccactgcaaca

SEQ ID NO: 5215 - DNA, 337 bp, Cicer arietinum
tgtgttgtgagtgattttatctttgtcttttgagaatatgtctggctgcaactgtggaagtagctgcaactgtggtgatagctgcaaatgcaacaagaggtctagtggattgaactatgccgaaggcggcgaaaccacagagacggtggttttgggcgttggtccgacgaagattcagttcgagggagctgaaatgagtgttgcagctgaagatggtggctgcaagtgtggatcaagctgcacatgtgacccttgcaactgcaagtgaggtgcatatagcaaatgaaagcttgaggcagagatattggaaccaatatgtgtaattgtgtgtatcggt

SEQ ID NO: 5216 - DNA, 440 bp, Cicer arietinum
acaggatgaagagtgttcctgtggtagacttaggtgctggtataatcgataatattattacacaagccgccgtgattcatatgttggccgaatgtgctggacttcagtggttcgaaagttgggggaccaaggagctatctgaagttggtcttcctcttgtagcatcaaagcaaatcatcaaggtatatgaggatgaaccagtccttcaagcatttaaagagatgaggaaaaagagggttggaggagtgcctgtaatcaaaagaggtggcagcacggcggttggtaatataagtttgcgagatgttcagttcttgctaactgccccagaaatctatcacgattacagaaccgttacagtgaaagactttctgaatgccgttagaagctacttagagaagaataaaaacgcattcttaatgtcaattgaattcattacatgc

SEQ ID NO: 5217 - DNA, 440 bp, Cicer arietinum
ccactagacaaaaccgctgggtcgaaatggtatagagcttacctggagaccgtggaatgaggcgactacctcgtccacagagcagcgttctagccgccttggggttttctcctgcgagggttttccccaaggatgcacggttctagggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggacgctgctggagggaagctctgcgaggatcaactgtattgatgtccaatgggacgtgcttcaccgacaactactgtagggcgagctacgagtagagaggtgcctcttgggggta

SEQ ID NO: 5218 - DNA, 435 bp, Cicer arietinum
acggacaaggttactccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccaccgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgccc

SEQ ID NO: 5219 - DNA, 251 bp, Cicer arietinum
catgatacctaggaagacacagacccgagacgacgccaagtcggcgcgcaaatgagattatttttatagctgcctcaagggcacgcgaagaggacgtgcgacatgtcgagcgaaagatgttggatttagtattgagaagttaaacggacggggcatggtgcatagaccaacgtgtctgactgagcctggtgctacgtttcgggataaagaggggaagagttacatgcatgaacgacatgatgattactcgt

SEQ ID NO: 5220 - DNA, 293 bp, Cicer arietinum
actaggtttacctactattgcgacactgtcatcagtagggtaaaactgaccgggctcacgacggtctaaacccagctcacgttccctattggtgggtgaacaatccaacacttggtgaattctgcttcacaatgataggaagagccgacatcgaaggatcaaagagcaacgtcgctatgaacgcttggctgccacaagccagttatccctgtggtaacttttctgacacctctagcttcaaattccgaaggactaagggatcgataggccacgctttcacggttcgtattcgt

SEQ ID NO: 5221 - DNA, 389 bp, Cicer arietinum
acattattgtcgttcaggtctaaccagactaaatggaaatattggccaaaaatggctaattagctaatgagccttgcagaatggtgacagcagccctaacaagccatcgccgtgccatgtcaaatttactttgatggctctcggctctcagctgtaggaagagcgttcttcttggcctcattctccttgaccttggcccaagcataaacgatacccgagacgaaaccgatgaagatggctgaaacacttccaacggtaacgggagcagcgaagaagacaagaccagagacggcgatgggcagcttgttgagagcaccgaccatggagtaggtggtggaagaggtgactcggatgcaccaggcggagcagtaagaaatgaagatagcggc

SEQ ID NO: 5222 - DNA, 414 bp, Cicer arietinum
acagatcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtacaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatg

SEQ ID NO: 5223 - DNA, 432 bp, Cicer arietinum
acaccaatggcttgggttgtggtgaataaagtgttgagcaggttaaagaagccagtgttttttctagatgtcacaacactctcacaatacagaaaagatgcacaccctgaaggttatagtggtgttatgtcaactgattgtagtcattggtgtcttccaggacttcctgatacttggaatgtgcttcttcatgcttctctttttgcttcaaattgattcaatatcttcttaattgtaaactatattatatgtttcttactccttttcatcttaaatatagcagaaaagttgatcaactaaagctgatgtatttttacatcaatttttttgacaaaattttctcttgtatttatgatgggaggaagtattaggaggaaaacacattgtttttctaccataggaatttatttaatttggcattttgagttgttg

SEQ ID NO: 5224 - DNA, 275 bp, Cicer arietinum
aaggagatcatgttactattggccaatgcaggccgctctccaagacagtgaggttcaacgtgttgaaggtgatcccagctggttcatccagcggtgttgcaaagaaggcttttaccggaatttgagatttgactttcgattgagccaagacatctgattatatctattgaatgtagttctgattttctttatgttgactagtataaagatctgaacaattttgttttgccggcgaagttctgttttattattggataatcgttgaagtttttgtc

SEQ ID NO: 5225 - DNA, 176 bp, Cicer arietinum
actgttggtggctcatctttgcgtgcttcacagtttgttttcggtgctgctgcactttctatcatggcttccactagtgatttcccttcagtcactgccttctgtttccttgttgcggctgccgacttgcagactttgtggagcatttcattagctattactgatgtatatgccat

SEQ ID NO: 5226 - DNA, 431 bp, Cicer arietinum
acttggatgagaagactatctttcaccttaacccttctggccgatttgtcattggaggtccccatggtgatgccggtctgaccggaagaaagattatcattgacacttatggtggatggggtgctcacggtggaggtgccttttcagggaaggacccaactaaggttgacagaagtggtgcctatgttgtaaggcaggcagccaagagtattgtggctaacggtcttgctcgcagatgcattgttcaagtttcttacgctatcggtgcgcctgaacctttgtcggtctttgttgacagttatggaactggaaagattcctgataaggagattcttcaaattgtgaaggagaattttgactttagacctggaatgatcaccattaacttggacctaaagaggggtggacataggtttcttaagacagctgcc

SEQ ID NO: 5227 - DNA, 429 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcg

SEQ ID NO: 5228 - DNA, 166 bp, Cicer arietinum
agagaattcgattagcgtggtcacggccgaggtaccaaggtttcactaaggaagatagagaaagattggttgttcgaaggtttaagtttgaggacccacgaattgagcaaattcaggatcttgagaatgatatgctgaggtatttcagagaggatttacataggag

SEQ ID NO: 5229 - DNA, 430 bp, Cicer arietinum
tcagaaaccagaaccggaacctgttgagaaaaagcactacagaggagttagacaaagaccgtggggaaaattcgccaccgagattcgcgatccgaacaaacgcggctcaagagtttggctcggaacgtttgatacggctattgaagccgctaaagcctacgatcgagccgctttcaggcttcgcggatccaaagcaattcttaactttccacttgaagtcaacgaagttattgcggcggtggaggagacttccggcgacggtgagaggaaacgttgccgtgaagaggaagaggtggaggagaaaccggtggttaaaaaggagaaaacgatggagtttgatgtgaactgttttaaagatatgccgttaacgccgtcaacttggactgggttttgggacggtgatattaagggaattttcagtgttccaccg

SEQ ID NO: 5230 - DNA, 196 bp, Cicer arietinum
acaagatggatatcttagctctccacatggacctaatccaacttcaatcatggagatgaagccatcctcaaaaaactgatcaaactctacccggaaacttctcatgaaatcaaaataaacctccacagcagtccgacctctcaaaacacgttccttatctattccccaagaaagacattcagggttgtgtcttccc

SEQ ID NO: 5231 - DNA, 439 bp, Cicer arietinum
acagtagggggtgggactcaacttgcatctcaatctgcttgcttgaatattcttggtgtgaagggtgcaagcaaggagtcaccgggatcaaactcgagactcttggcaaccattgttgccggatctgttttagcaggcgagctgtctctgatgtctgccattgctgcagggcaactagtcaacagccacatgaaatacaacagatcaagaaaagatataactaaaatatcatcttgagggtgaggacttggttgtagttattgtttgtggagtctaaaataaaaagcagtagggtctttctgcacagaaaccggaatttagggaaggaaaataggagacatcggatttgattgttgggccccgtgtctgactctgtgttgctatgtgtagtgtttcgttatttggacggagggaactagagttctacttgtttggttgt

SEQ ID NO: 5232 - DNA, 418 bp, Cicer arietinum
acgattttgctcatggtcaatggaagcattttgaccttaaggttaaggactctaaaacccttctctttggtgagaagaccgtcactgtttttggaactaggaaccctgaggagattccatggggtgaggttggagctgattatgttgttgagtcaactggtgttttcactgacaaggataaagctgctgctcacttgaagggtggtgccaataaggttgtcatttcagccccaagcaaagatgcacccatgtttgttgttggtgttaacgaaaatgaatacaagccagagcttaacattgtttccaatgctagctgcacaaccaattgccttgctccccttgccaaggttcttaatgaccgatttggaatcgtcgagggtcttatgaccactgtccactccatcacagctacccagaa

SEQ ID NO: 5233 - DNA, 338 bp, Cicer arietinum
acaccggatatgccaacaaggaagtcgtttgccagaggagagacacggaacggaggtagggaatgccgaagtgttacatggaaatagactgacggttgtcgtttggccactctttagttcaatgagttggcaatcatcggttcaaatgagcagacgtcacaatcatatgataaaatcaaattacacaactcaacattccggaagggagttggccgacgcaaacgatgagaagcttgcggctgactcactataacggagtggatgctgatgatgactggatgaaccgatcatgaaacttactgaggcattacttggacttggaatgtgtgaagacaagt

SEQ ID NO: 5234 - DNA, 257 bp, Cicer arietinum
cgggggtcaagacaccattcgtcccttgtggaggcactacttccagaacacccagggtcttatatttgttgtagacagcagtgacagggatagagttgttgaagccagagatgagttacataggatgttgaatgaggatgaacttagagatgcagtattgcttgtgtttgccaacaaacaagatcttcccaatgcaatgaatgctgctgagattactgacaagctgggtctccactctctcagacagcgccactggt

SEQ ID NO: 5235 - DNA, 434 bp, Cicer arietinum
actttggcgagcagttgtcaggatttgcctttactgctaatgggtgggtgcaatcctatggatctcgttgcgtcaagcccccaatcatctacggtgatgtgagccgcccaaagccaatgactgtcttctggtcatctcttgctcagagctttaccaagcgtccaatgaagggaatgcttactggccctgtcaccattctcaactggtccttcgttagagttgaccagcctagatccgaaacctgctatcaaattgctttggctatcaaggatgaagtagaagaccttgagaagggtggtattggtgttatccaaattgatgaggctgccttgagagaggggctaccactaaggaagtcagagcatgctcactacttggactgggctgttcactccttcagaatcaccaatgttggtgttcaggattccactcag

SEQ ID NO: 5236 - DNA, 379 bp, Cicer arietinum
actacacttaggtgtttgtagccctggtgtaaatctgctgacttgaatgggaagataccatcctgattaaacctctagccatcaaatctctaatagccttccttgcaagagaaccattaaccctcaaacgatcagagagaactgaaggagtgatgagcttgtatttgggtgcttcagatatgagcttgtcataggtagcctgatcaaagagcaccatgttattcaccttctccttttgctttcccttgctccacttcttcttcttctgcttgccgccaccagatttggctggcttggaggaaggtggaggagccttatccttctttggagccatgagatcggttggatgaacgaaggtcttagacagaggcgcgagtta

SEQ ID NO: 5237 - DNA, 424 bp, Cicer arietinum
acttcccaaatgtgaagacctttgttcgcgcccatgacgttgatcatggattgaatttagaaaaggctggagctactgcggttgtcccggagaccttggaacctagtcttcaactagcagctgctgtgcttgctcaggctaaacttcctgcatcagagattgcagcaactgtcaatgaattcagatgccgacatctagctgagcttacggagctgtgtgaagcaagtggaagttctcttggttatggatatactagaattatgagcaaatccaaatctcaatccccagattcattagatttagatgagacccaagtctctgaagggacgctggcgatatgaagattacctcatgtatacgaagtagaatgcagaagaaaataaaggttagagaaaagggaaaaaatttatgaaaaaacaaattg

SEQ ID NO: 5238 - DNA, 367 bp, Cicer arietinum
acacaacaaacaaaaagttccgaacagtaacggagcaacttccgcgccacatcacgcttagaacgtctcttctctccacacgcttgggtcccacgcgaatgctcgcgagtcgagtgatgtttatctaagggccccacctcacagtagccgtcgcggaacggttaccaaccacgaatactatcgcgacacgtggatttccgattcatctacaccccacgactcagaacgcctcccagacgtgaaccgcatcatcccacccaaaccggccggttcactctctgaaacgctatttctcgataccgattccacaaacgacacgtcgttcacactccccgtgctgttccgcgctttcgaattactcacgctg

SEQ ID NO: 5239 - DNA, 440 bp, Cicer arietinum
aaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagt

SEQ ID NO: 5240 - DNA, 400 bp, Cicer arietinum
atcgcctgtccgtccttcccgacggcattccttctctgtccattgaagtcatgagcaccatgggctgggagcgttacactcacgagcagttcggtatcaaccgattcggtgcttctggtgcctacaaggacgtctacaagaagttcgagttcacccctgagggcattgccaagcgcgccgtcgccaccatcgacttctggaaggacgtccccaacatccgatcccccatcaaccgtgctttccagcagatcatctagatcaaagataatagcgagtaaaaagaaacgaaggataagaataaaaactccgggaggataccagcccggacagaatgattatgcaagtgacgacgatggactttggagcaaggttttgtggatttatagcaacttagacacgt

SEQ ID NO: 5241 - DNA, 433 bp, Cicer arietinum; identical to SEQ ID NO: 5016

SEQ ID NO: 5242 - DNA, 439 bp, Cicer arietinum
acattgctggaggtgttactcagaattccatcagggttgctcagtggattcttcaagctcctggggcaactagtttcatgggttgcataggaaaggacaagtatggtgaggagatgaccaagaactctaaacttgctggtgtaaatgttcactattatgaagatgaaaatacacctacaggaacttgtgctgtttgtgtggttggtggtgaaaggtctcttattgccaacttatcagctgcaaattgctacaaggttgatcatttgaagaaacctgaaaattgggcattagttgaaaaggctaaatatttttatattgctggctttttcctcactgtatcccccgaatccatacaattagttgccgaacatgcagctgcaaataacaaggtcttctcgatgaacctttctgcaccctttatttgtgagttcttcaagga

SEQ ID NO: 5243 - DNA, 425 bp, Cicer arietinum
gctagctacttgttaataatatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacac

SEQ ID NO: 5244 - DNA, 431 bp, Cicer arietinum
gctttccgataccgaaaatcgcgtaagatgaagacgatgatgagattgggatgcttattcctccgatcactcacctcttccagatcgtattctactaccttcgccgccgctgcttccgccaataacaccctccgaaccctttcttcccctcgcttttcctctccttcctcagaatgcaggtcgcctttctcgatgggcgtagggagcttgagattttatagtgaagaagtgacccacatgcctgacattaaagacgctgagctctacagcgttttcgaggatttgctggctgaaaattggagtgatatttcagatgctgtcgtttctgatgctaagcatgcattatctaaaaataccgaggacaaaactggcaaggaggttgtgactaatgtgttccgtgctgcccaggctgttgaggagtttggtgggat

SEQ ID NO: 5245 - DNA, 405 bp, Cicer arietinum
acaagatttcccggctatctagaaacaggaggactgtgaaccgtggttatggtggagttttatctggaggtgctgtcagagaaagaatcattcgagctttcttggttgaagagcagaagattgtgaaaaaggtcttgaagatccaaaagacaaaggagaaacaagcttcaaaggcttaagtttcaagaaaagagataaagatctttttggagggattttaggtttgagtcattatagtaaaaaacaaatttattagaactgttgttcccttgttaattttgtgctcatttggtttctttgaactcattttagtgcaactgttagcctattatgatacagttttgttcggtttattgatattttcatgttttcttatgaatatatgaattttcatgttttcctccg

SEQ ID NO: 5246 - DNA, 205 bp, Cicer arietinum
acgcccttagtcgcattcgtaacaatgctaggaaccttcttactcttgatgagaagaatccacgtaggatttttgaaggtgaagctttgcttcgtagaatgtttcgttatggattacttgatgagactcagaataagcttgattatgtcttagctcttaccgttgagaatttccttgagcgtcgtcttcagacacttgtttttaa

SEQ ID NO: 5247 - DNA, 411 bp, Cicer arietinum
ctttgggtttgatttcatctagaaaaacaaatgaggctattgagatcttaaagttgatgtcttcaactttcttgattgcaccttgtcaagcaattgatttgaggcatttggaggagaatttgaagaacactgtgaagaacactgtgagtcaagttgcgaagaggacgctaacgactggcgtgaatggtgaactacatccatccagattttgtgagaaagatttgctcaaagttgttgatagggagtatgtttttgcatatgttgatgatccttgtctctctacataccctttgatgcaaaagttgagacaagtgcttgtagatcatgcattggtgaatgttgatggtgagaagaatttgaacacatcaatatttcaaaagattgcaacttttgaggatgaggtgaagaccc

SEQ ID NO: 5248 - DNA, 291 bp, Cicer arietinum
gcaaaagattctacccgccgctcaataggaattgcgtttcaaggtgtcccgcaaggctcatccgccttacgaggtccaccaacgacacgtgcctctggggggccaaggccccctactgctggtcggcaagcgaacgacgggcacacgcatcgcttctagcccggattctgacttagaggcgttcagtcataatccaacgcacggtagcttcgcgccactggcttttcaaccaagcgcgatgaccaattgtgcgaatcaacggttcctctcgtacctgcccgggcggccgct

SEQ ID NO: 5249 - DNA, 337 bp, Cicer arietinum
accggtccaaaactgggtcctccccggttcacctcgaatttcactcacgcgccaagcttctttcgccggcgacaagaaccaccacgttcaatcgccaaggctttcattgcatttccactccaactgcggcaaggacacaaatccagaaggaatcaacagagctttatcggaaagcgcggcgattaagtctccgagcgagaatttcggcttttgccggaatctaaatcgaatcggaactcactattctccgttacaggataccagattcttcggcggcggatgcgatcacggagatacgacagtcaccaccggcgggagcggcggtgaaaggattaaa

SEQ ID NO: 5250 - DNA, 437 bp, Cicer arietinum
gcttcctttcgtctcctccactcgtcgtcgccatgattatctcagagaagaaccgcaaagagatctgcaaatacctgtttcaagaaggtgtatgttacgctaagaaggatttcaatttggctaagcatcccgaaatcgatgttcctaatttgcaggtgattaagcttatgcagagtttcaaatcgagggaatatgttagagaaaccttcgcttggatgcactattactggttcctcacaaacgatggaatcgagtttcttaggacttatcttaatctaccatcggaaattgttcctgctactttgaagaaacaggctaagccacctggtagaccatttggcggcccacccggcgatcgccctaggggtccaccacgttttgaaggtgaacgtagatttggaggcgacagagatgggtatcgtggaggaccacgagga

SEQ ID NO: 5251 - DNA, 441 bp, Cicer arietinum
cggcagcgagtcaagactcggtctcgtgtgaagcgatcgaacttagccaagccgaagttaacaactgataatgaggaaaaaagtagcaataacaaaggaattgaatccggttctgttgaaccggttgaagaagtgatgaaccggtccgcgagtcatgaatcatcgctaagccaccagtctgaggcggtaaatgcggcggcggtggatggagagagtaaagagagtgatgaaagtatggcttcggttgaaacggctgagacttcgatgaacttatttagagatgaaccggagtcaaccagagatttgaaacgggtggaccgaaccggtgaaagtggagaggaaaatgttggtttagaattgactcttgggtttgaaccggtttcacgtgttcatcacgtggttcctgtgaagaaaagaagagttgaattgaaagattgtggt

SEQ ID NO: 5252 - DNA, 438 bp, Cicer arietinum
ttcggcggcaccatcttcttcaacaaggaacacaaaaagtagagtcttttttattgaaatccacaatcaaatatgtctggtgaagaaggtgttgttgcagtcgaaccagttgttgctgctgcggctgctattcctggtgagccaatggataccatgactgctgttcagcttgtgctgagaaagtcccgggcttatggtggccttgcacgaggtcttcatgaaagcgcaaaggtgattgagaagcacgctgctcaactctgtgttctagctgaagactgtgaccaacctgattatgtcaagttggtgaaagccctttgcgcagagcacaatgttagcttattgactgttccaaatgcaaagacccttggagagtgggctggtttgtgtaagattgattcagagggtaaagctaggaaggtaactggctgctcctgcgtg

SEQ ID NO: 5253 - DNA, 428 bp, Cicer arietinum
gctgaagccatccaaaagaaggcttgcaatggtttgttactcaaggttaaccagatcggcacagtgactgaatctattcgggctgcactggactctaaggctgccggttggggtgtcatggttagtcatcggagtggtgaaactgaggataacttcattgctgatctttctgttggtttggctagtggacagataaagactggtgctccttgcagaagtgagcgtttggccaagtataaccagcttcttcggattgaagaggaacttggaagtgtgcgttatgctggtgaagcttttagatcgccttagaatgaacaactttagagtgagcagaggagaattatttcagtaatagttatgcattaaaaagattgtaatcattggtttgttaaagaaaagaaaacgggattgaggaagatcctgagttt

SEQ ID NO: 5254 - DNA, 142 bp, Cicer arietinum
atgctcccttcagccatgggggaaaagggaattcgattagcgtggtcgcggccgaggtacactagtttaccctatggaaaaagacaagcactggaagaagtgcaatttcaagtcaggtcgagttcccccaactgataaatgt

SEQ ID NO: 5255 - DNA, 372 bp, Cicer arietinum
accagttactcacaaaacgcataagaagctataagcatgtacccaaagtaaaatattgcagacaccaactttgtgatttctagcttggtaaagaagtagaatgttgcataaagaaagaggtatagtgcagaagaaccagaagtaaggtatgaccgccaccaccacaagtaatcctcactgcataactggaagtagcagagcacaatggtgatttcagcacaagtgacaacgaggatgatgaagaccaaaaagaggaacccgaagatgtagtaaaactgattcaaccagattgaggtgaggatgaagaagagctcaatgaaaacagctccaaaaggaagtattcctccaatcagaactgagaaagctgggttc

SEQ ID NO: 5256 - DNA, 367 bp, Cicer arietinum
cgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactg

SEQ ID NO: 5257 - DNA, 134 bp, Cicer arietinum
acaagtagctgcaattcaagtaatgaagaaaacaaatgaaactgagttgatgaataataatattaaggttgaagagacatgtcagtctcagtctcagatatcttcttgtaatgtgaatcctgcggtgtttcagg

SEQ ID NO: 5258 - DNA, 400 bp, Cicer arietinum
accgaatgccattaatggaatgtaaaggtctggtgcatttatgtcataaatcggtggtttataagagagcctaccacccactggctcggtgattctagtccaatgacccctgtgcagaaatggaaacaaaaccaccttcaatttgttcttaacataatggtcattcacttgaaagtagtattggggatcagagaaataccgacttatattgctttggacatactcagagctggatcctaatatttttcctccataagcacccaatccacctcgaatgagtcctgaaccagcaacttgaaatgcactcccaaaaggattaggttgttgtgtgcttgctggaggctgcgccacccctggttgcggtccaacattattatacattcttactgaagagaagctt

SEQ ID NO: 5259 - DNA, 156 bp, Cicer arietinum
acaacaatcaccgccactttaattatagatcccctaattcaacttataattaagttaaataccaaattgattcgtcctttgtaaccaggaattggtattttaaagaataaatatatatcaagcagcaacaaaagtgatacaccatctatggcgagt

SEQ ID NO: 5260 - DNA, 202 bp, Cicer arietinum
gggtgggtgtaccaaatgaagaaggacattcacatgcttactttgatttgtaaattagaaaactgttgtttccttttcctcgtgtgagcattttttcaagtgcttaatgcgatggtttttatgttttttcagtttgtaacttttgttttcctcatgtatgaggtatactttgttagtgtaatttaaatttgcattgtcttcc

SEQ ID NO: 5261 - DNA, 434 bp, Cicer arietinum
acaagcaagcttctcggccgctccgccgccgtgcagcaacgccacaagaagcgcccctcaacacagggtgcttccgaggatgctcagaacattccgtccaacatcaaaggacccgaacagttcgtttttgaaggccgccgtgcttcagctaaggacggcacacccaaagatctcaaacttggtaagaagggcaagggtaagggcaggtccagcaggccccaaaaccggggcgcaaggagagctgccgagtggaagaagaagagctgagcgttttatggtgaatagcactcatatcgctagtggttggcatatgggatgtgtgctcttttcatacgtgagatgaggacgaggatggtgttaaaaaagagggccccacgccccggaaagtttgcgagtgatttttcggccttggctgccctggcaagttctggccg

SEQ ID NO: 5262 - DNA, 428 bp, Cicer arietinum
gtctagctctgacgaagactgagatcatcatcatagaacaaacgatggctaaaacgacgtcgttgcttctctctgcactgttcctctttggaactctagctcttatccaggcaaagaagtcgaaggaggatttgaaggaagtgactcacaaggtttactttgatgttgagattgatggaaaggctgcaggtcgtgttgtaataggtctttatggcaagacagttccaaaaactgcggaaaacttccgagctctttgcacaggggaaaaggggaccggtaaaaatggaaagcctcttcattacaaaggcggctcattccacaggattatccctagctttatgatccaaggaggtgactttacacacggcaatggaatgggcggagaatcaatttacggagagaagtttgcagatgagaacttcaagtta

SEQ ID NO: 5263 - DNA, 372 bp, Cicer arietinum; identical to SEQ ID NO: 3326

SEQ ID NO: 5264 - DNA, 316 bp, Cicer arietinum; identical to SEQ ID NO: 1006

SEQ ID NO: 5265 - DNA, 216 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgggcaatccatgagagacgcaattgaagggatgaacggtcaagatgttgacggacgtaacatta

SEQ ID NO: 5266 - DNA, 438 bp, Cicer arietinum
gcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttcccggccgccacgacatacgactacgagctacaacttggttactggagattgtggactgcgtcagcagatgtagcgatgcgtgagagaattctggtcggtggagaaagtcgacagtatgcccccgaacccgctgacgggtga

SEQ ID NO: 5267 - DNA, 382 bp, Cicer arietinum
actattaattaacagcagaacagactgctttacaactgtcaaaataaataaaaagctaaaatacataacagcttaaagaaattagagaaaaaaaacacaataacaatcttatcaccatataatagaaaaattaacgccttttctttcctgaagacaaaacgcggaaactttgcttcccttttttctctttcgatgtatcttccttccatcactttctttattttcatatattcttcataatctttcatagagagctatggtaataaaccactattattgtttactatctaatagtggtaaggaggaggaggtgaggaatagaggtaaggcttcttggttggagttggtggtggagagtggtaaactggatgtggaatgtatg

SEQ ID NO: 5268 - DNA, 226 bp, Cicer arietinum
acctgtgtaccaaacacccattgtcacaacattgacaagacttttgaatgagacatcggaagcacttggaggttcacgtgcaaacccagcaaagaggcgggagatagaagacaactcaaagagacttggtgggttgtttgcaaagttgaacagtggagacatctccaaaaatgctgctgataagctccttcagctttgtcaggcgttagacaatggtgattttggt

SEQ ID NO: 5269 - DNA, 338 bp, Cicer arietinum
gatttcgagcgggccgcccgggcaggtacggtcctaggttgcagctactggcgatcttaggggatcatggacttcctgcctcagggtatggaaagctacttgatttatccgtgcaagagaattctaggctggagaggaatagatcccgctgacgggatgacctcttgaaagtaaatgcgcctttgtgccgatgatatgctggatgaactagatgggagacgctgctggtttgaagctctgcgaggatcaactgtattgatgtccaatgggacgtgcttcaccgacaactactgtagggcgagctatgagtagagaggtgcctcttgggggtaatgagt

SEQ ID NO: 5270 - DNA, 258 bp, Cicer arietinum
acaaagttcccatgcaatgctatgaggatgctaaactgatgaaactattccctgagattattagatctctttatgaacaggatgtgctggctgaggataccattcttcattggttccgtaaaggaacaaaccccaaaggaaggcaaacctttgtcaaggcactcgaaccctttgttaattggctggaggaggccgaagaggaggaatgaatgtagcagaggttcagggccgaagatattaattgtctttagctcttgt

SEQ ID NO: 5271 - DNA, 375 bp, Cicer arietinum
cagatcaacgagcccaagagaccctcaaacaagcccctcagacttccattgcaagatgtttacaagatcggtggtattggaactgtgccagtcggacgtgttgagactggagtcatcaagcctggtgtgatcgtcacctttggccctactggtctgacaactgaagtgaagtctgttgatatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgcc

SEQ ID NO: 5272 - DNA, 211 bp, Cicer arietinum
gatcttcttaccctgatgtgataagggtatctgagattcagaaggtgttggacattactggggttcaaacctacattattaatagtgcaagggttgtgttcttaaatgaaaggccacaacctaggccaggaaaaggtgtcacaaacacttgtgaagtttgtgagcgtagtcttcttgattctttccggttctgttctcttggttgcaagat

SEQ ID NO: 5273 - DNA, 408 bp, Cicer arietinum
acaatgatatcgcctgcacgaacaacagtcttggatccatcagccaaaaccatctctaactccccctcaaacacaattccatagtcaagcgatgcagtcctatgattgtgccctgaggaatttggtggaaagtcgacgactcgaattagtgagccgggcgtatagattactggatcggtgccgacaggatctttgtcaacgagctctgctgggtgcttgtcgtttctccagatagtgactgcattgctgccaaagccggaggtgagtttgagctcttcatctgataggattgcagagttctggcccttgtggtgggtgacaacccttctcagaggactaccagcgttgagacccatggtgtctgaaactgaggttttgtgaatagttcttgtcaatcttccttgtaag

SEQ ID NO: 5274 - DNA, 420 bp, Cicer arietinum
ctttcttatttcttcttcaaattagtgcagcagaaaaagaagatgatgaggttgaagttgaagtatttggctatgaagatgttgttggagccatggccaaataaatgatggcacaagaattatacatatatatgccttctaggcaagtctgatgcttggcttttcatctctgtttgttggtttagtttttgtgagaatcaaatcaaataaggcatgggaatttattattttctagctagtatattatataatatatatcatattataagatatgataattaagttgtctagttcactatgtctttgaagcagcacttctcccttttccttttccttttcctgtttgactgtatgatgatgatatataaatttatgtagccttctctgtttgctatgccatagctgcatttaattacgagg

SEQ ID NO: 5275 - DNA, 417 bp, Cicer arietinum
ctttcttatttcttcttcaaattagtgcagcagaaaaagaagatgatgaggttgaagttgaagtatttggctatgaagatgttgttggagccatggccaaataaatgatggcacaagaattatacatatatatgccttctaggcaagtctgatgcttggcttttcatctctgtttgttggtttagtttttgtgagaatcaaatcaaataaggcatgggaatttattattttctagctagtatattatataatatatatcatattataagatatgataattaagttgtctagttcactatgtctttgaagcagcacttctcccttttccttttccttttcctgtttgactgtatgatgatgatatataaatttatgtagccttctctgtttgctatgccatagctgcatttaattacg

SEQ ID NO: 5276 - DNA, 253 bp, Cicer arietinum
acttttaccttttctggcagcgctggagctggagacaatcagtatgagctgaaaatggagctctttgacaaggttaatgtagaggagagcaaaatcaatgtaggagtgcgaagcatattctgtgtagtgcagaaggcagagaatggatggtggaagaggttgttgcgtggagaaggcaagcctccacattatgtgaaagtagattgggataaatgggccgatgaagatgaggaggaaggtgaagtggacttgg

SEQ ID NO: 5277 - DNA, 435 bp, Cicer arietinum
acctcttggtcgtagagatggaacaacagcaagtgagagtgaagcaaataacttgccatcaccctttgaacctcttgaaaatatcactgctaagttcatttctaagggtcttgaaaagaaagatgtagcagttctctcaggtgcccacacctttgggtttgctcaatgctttacattcaagacaaggctcttcgactttggtggatcgggtaaatccgatccaacacttgacacttcacttctacaaaatttacaaaaaacatgcccaaatcaagctgattcagataccaatttggctccattggatcctgtcactactaacacatttgataacacgtattacaaaaatcttgtgaccaatgttgggctacttcaatcagaccaagctcttttgggtgataatactacttcttcattggttacaaactatagcaa

SEQ ID NO: 5278 - DNA, 262 bp, Cicer arietinum
acatcctttccatgttctgaggattaacaagatgctttcatgtgctggagctgataggcttcagacaggtatgagaggtgcttttggaaagccacagggaacttgtgctagagttgctattgggcaggtccttctttcagtccgctgcaaggacagcaatagccatcatgcacaggaggcccttcgtcgtgccaagtttaagtttcccgggcgtcaaaagatcatcgtcagtaggaagtggggattcaccaagtttagccgt

SEQ ID NO: 5279 - DNA, 391 bp, Cicer arietinum
ccaatttgtctccaatggactactttatactgtctactttttatcctaacaaatggcagttgtcgcacacattttattcataccctatttgttttgttctaaatagcttttttgttcagatcacattcaacaatggttaaggctgtggcagttcttggtagcagtgacactgtgtctgggactattaacttcagtcaggagggagacggtccaaccactgtaactggaaatcttgctggtcttaagcctggtctccatggcttccatattcatgccttaggggacaccacaaatggctgcatatcaaccggaccacatttcaatcctaatgggaaagaacatggttcccctgaggacccgattcgacatgctggcgatttaggaaatatca

SEQ ID NO: 5280 - DNA, 435 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagactctgttgagcttgactctagtccgactttgtgaaatgacttgagaggtgtaggataagtgggagctggaaacagcgaaagtgaaataccactacttttaacgttattttacttattccgtgaatcggaggcggggcgctgccc

SEQ ID NO: 5281 - DNA, 435 bp, Cicer arietinum
gtcaaacaatggcttgaagaccgacgattcttgatgggagagatgcaacaacttcgggataagcttgctacagctgaccgcactgcaaagtatgaagcacagttaaaagaaaaatatcaattacggcttaaagtgctacaggagagtttgagagaaacttctaacagtattaaccgcggaacttcagagggaagatgtgttagcaatgggccttctcggcgtcaatctcttggaggagctgataacatatccaaactgaactctaatgggtttctacctaagagaacatcatcctttcaactaaggtcttctgtgtcctccagcacagttttgaagcatgctaaaggtgcatctaagtcttttgatggtggctctaggtcactagaaaggagtaaaattctcctaaatggaaagcctccaagttccgcggacctc

SEQ ID NO: 5282 - DNA, 436 bp, Cicer arietinum
acgaatgggatgcagatgcagctctagaagcaatgatacgagacagtttggaaagttggattatgattgtatgtaacaagccaaatgaagtaacgattactgattagcaagggtggagaagctctgctgttccagcctggcattaatcattctacaatattggtcctgttagaagtgccaaatattgtttgtgtatatgttatttgatgatattccttgagtgtttgggctcgtgttaataaaattatgtctgattgcctgtctttgatagtgtcatttagatcaaagtcttgttacctcaaatttagagataaaactttggtagtaggttgtgtcacccaaagggtagacctttaatctgaatatcatttcagtgctgtcatggtgtgctagttcccatatttgatgaagtttaggcttcagcttctggactctt

SEQ ID NO: 5283 - DNA, 361 bp, Cicer arietinum
cctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgtcgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgcctcggtatgctggatggtgaaggaagcggggtatcctgt

SEQ ID NO: 5284 - DNA, 295 bp, Cicer arietinum
cgcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttcatacttccagtattgagctctgtaattacgattatgactatgacaatatctcttattgtgtgacgtgttttattactgatgttagtaa

SEQ ID NO: 5285 - DNA, 459 bp, Cicer arietinum
gatttcgagcgggccgcccgggcaggtacaagggaccaactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcacacctccc

SEQ ID NO: 5286 - DNA, 436 bp, Cicer arietinum
acgagcttggtcgccagccagctaacaccaagctatcaagcaacaaaactgttagacgcattcgtgttagaggtggcaatgtgaagtggagagctctcagattggatactggaaatttctcatggggaagtgaagctgtcactcgtaaaacccgtttgctcgatgtggtttacaatgcttccaacaatgagcttgtgcgaactcagacccttgtgaagagtgctatcgtgcaggttgatgctgctcctttcaagcagtggtatcttcaacactacggtgttgaaattggaaggaaaaagaaaactgcttccaaaaaagatacaccagaggaggccgaagctgttacagaagaagccaaaaagagtaaccatgtccaaagaaaattagagacccgccagaaagaacgccagcttgattcccacattgaagagcagtt

SEQ ID NO: 5287 - DNA, 384 bp, Cicer arietinum
gatttcgagcgggccgcccgggcaggtactaaatcagagcatgagaaggaatttttacttaaagacttgatgacagaaggtttgcttggtggtgacagaaggttaggtgaggtttgctcaaagcgagtgtatagaattctaatggctcaaaagggatccatcagaacagatgatgtcgagaatggtgccgatttctttgagcgttaatcaaacttaagaccatgtgaattatggaacaagagtcacacttcatggttcgacttatttgatccgtagaggcttgatagcttctctggatcaagccgaaaatccaacgtagagatggacctacgaaactgaccaaaatcattgccttcactagggttgatcatatcaagtatagat

SEQ ID NO: 5288 - DNA, 436 bp, Cicer arietinum
cgcaaggaaacatcatggtaggacagttgagggcgacaaaaccaagtcgaagcgacgaggttttggacagcgaggaacaagtgaggatcacaaatcagatcaaagctcaattcgatgctttaaaacctaaacgacccattaaacccaacagaagcgaacctgaaactcaaaaccccgttgactcaacactctcctcacacaacataccagagcttcaaaaacttcaatctcttcaatctattaattctctcgctatactttcctcagagaatttggtggatccgcaagatgagtttgtggagactcactattacaaggagttgttgtccattgataaacagcatcatgcgacgggaagtgggtttataaaagcggtgagagaaggtggtgaagatggatatgagattaagttacctgcaagctatgttgatgttgg

SEQ ID NO: 5289 - DNA, 410 bp, Cicer arietinum
actaggttgaattactattgcgacactgtcatcagtagggtaaaactaacctgtctcacgacggtctaaacccagctcacgttccctattggtaggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtaccagtcatactcataatatatggaggctgcgcgtaagatgacaggacggttgaggaagatccaccaacttgaggcacaactggagctcctcttgagtccaccatgtatggaattgt

SEQ ID NO: 5290 - DNA, 434 bp, Cicer arietinum
acttgcaatgtcattagcaccaaaggatgaacatgaagctcaggttcaatttgctctcgagagggggattcctgctatatctgctgtaatgggcacaaagaggcttcccttccctgggagagtatttgatgtagtccattgtgcacgatgtagagttccatggcacatagaaggtggtaaacttctactggagttgaacagagtattgcgtcctggtggtttttttgtatggtctgctactcctgtttatcagaagctttctgaagatgttgaaatatggaatgccatgaaagcactaacaaaagcaatatgctgggaacttgtggcgatcagcaaggatcaagttaatggagttggtgtggccatatacaagaagccactatccaatgagtgttatgagaatcgattaaagaatgagcctccgctgtgtcaag

SEQ ID NO: 5291 - DNA, 438 bp, Cicer arietinum
acctcgaagagagagtccatggggaataactggagagaatcatcctgaacccaaagctcatcgatgcaatgaccgtattgaagatgttatccaggcttgctttgagggaaacccgttcaagactgttccaggacctttcaagcttttctggcggtgcatgcgttctaaacctggagaggaaccaactgagccgtttacatatttagatttggatcctccaaagagagagtcaaataccgtgaaacttgagtagtgccactttcgcaaatggttccaggacaactgtggcattgcatggtcttattgtggtttcaacttttcatccatgtcgtggatggtttatgcgacgattatatgtaattaaattgtctttgttgcttacttcgccttgcaaaatagacatccattgcctatgttctgcacgttgatgtacctgcc

SEQ ID NO: 5292 - DNA, 175 bp, Cicer arietinum
caagttcttgtcacatctgaatgctttatgaacactttgatgctcgactacctgttttttattttgtaacgttggtatgtcaaactcgctgtgtggtatatatgcaacaaagaatcagaatgtgcggcgcctgtgtaggtgtaaacttattgcaatgtctttcgttcaggatccc

SEQ ID NO: 5293 - DNA, 370 bp, Cicer arietinum
aatggcggcacctcagaaccagaacgccttagatatcggaggacaatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgcggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtgaaggaagaggggtatcctgt

SEQ ID NO: 5294 - DNA, 254 bp, Cicer arietinum; identical to SEQ ID NO: 4321

SEQ ID NO: 5295 - DNA, 438 bp, Cicer arietinum
caggtcggtctttctgacgacggatttgagaacttttctggtcttacaaccttgaagaggttaagtcttgcatttaacaagactacagacgcatgcttagttcatctaaaaggtttaacaaatttggagtatttgaatctggactcttgccagatcggtgatgaaggacttgctaatttgacaggcctcactctcttgaaaagccttgtgttgtctggcactgaagttgggaacagcggccttcgatatatatcaggtttaaacaaactggaagatttgaatctgtcatttaccgcagtaactgataatggcctgaaaaggctctcaggactgacatgtcttaaatcacttaatctggatgctcgacagataactgatgctggactggcaaatcttacaagtctaagtggattgataacattggatctctttggagcc

SEQ ID NO: 5296 - DNA, 274 bp, Cicer arietinum
acgagaggaaccgttgattcgcacaattggtcatcgcgcttggttgaaaagccagtggcgcgaagctaccgtgcgttggattatgactgaacgcctctaagtcagaatccgggctagaagcgatgcgtgtgcccgtcgttcgcttgccgaccagcagtagggggccttggccccccagaggcacgtgtcgttggtggacctcgtaaggcggatgagccttgcgggacaccttgaaacgcaattcctattgagcggcgggtagaatcttttgcag

SEQ ID NO: 5297 - DNA, 364 bp, Cicer arietinum
attgcgcgtggctgaggaagccgaggagagactctgctcacagctcggggagctggaagcagaagccgtttatcaagcgcgtgactatcacgatcgcatagtttcgctcatgtaccagctctcacgcgcacagagcctcctccacaaagcgcttccttcgtcttcctcgtgatttgtggctttgatgtaattagttttgtaactgaagctaacaatgaatattcattcattgttgtttgttatattagctatgtgtattatacgattttgatgattggttaaccgtattagcgtggattcaatctctgttctgctgtaaacgtttttgttagtgtgattgagtggattggttttagaatttcac

SEQ ID NO: 5298 - DNA, 436 bp, Cicer arietinum
gatcgctgaaagtcagctttattttcttcactataagatctagttgaatcttaacctcaaactttcgattcgaagcccaaatcactgaaatcgaaccttcttcaggtttttacaactatctggtggatttgttttcgattttcattttgtcgttcgtgaaatgtcggtttcatcgaaaggagattcggttcaaattagagaggtttggaacgataatctcgatgaagaatttgcattgatccgtgaaatcgttgaccaattcaactttatagctatggatactgagtttcctggagttgttcttcgtcctgtagggaatttcaaaaacatcaacgattataactaccagactttgaaggataacgttgatatgttgaagctgattcagttaggtctcactttctctgatgagaacggaaacctacctaactgtagt

SEQ ID NO: 5299 - DNA, 351 bp, Cicer arietinum
acattagagacttttcccagcattgtgggcaaagagagaattgttgtggcgacgtcctgctcacttcttcacactgctgtggatcttgtcaacgagaccaagttggatgatgaaattaagtcatggctagcttttgctgcccaaaaaattgttgaagtaaatgcattggctaatgcattctctggcaacaaggatgaggccttcttctctgctaatgctgcagctcaggcttcaagaaagtcctccccaagagtgaacggcggggctgttcagaaggctgcttctgcattgaagggttctgatcatcgccgtgctactaatgtcagtgcgaggttggatgctcaacaaaag

SEQ ID NO: 5300 - DNA, 288 bp, Cicer arietinum
acatagatagatatatttttgggtgttctgtttacagttacaccacacaaaggcagtgaatatcggtttaggtatgcaattacaataagacagaaaaacaatccaaaaaactgcaagaacaaattttgtttcaatgcaactggattggtgttccctaacacaatctctagagttaatatattacaaacaaaccgaccagaaatgcagaaaacttgggatgatatttctcaaacatcatccttaattatcttagctttcttgttagcagaatccttctgctcaatatat

SEQ ID NO: 5301 - DNA, 436 bp, Cicer arietinum
accaagattgcttctgaaggactcaaacatcgtgtgtttgagatctcattggctgatcttcaaggtgatgaggataatgctttcaggaagattaggttgagggctgaagatgttcagggcaagaatgtcctcaccaacttttatggtatggatttcaccactgacaagctcaggtctttggtccgtaaatggcaaactctcattgaagctcatgtggatgttaagaccactgataattataccttgagaatgttctgcattggctttaccaagagacgcagtaaccaagtgaagagaacctgttatgctcaatccagccagatcagacagatccgcaggaagatgagggagatcatggttaaccaagcaacatcgtgtgatttgaaagagcttgttcgcaagtttatccctgagatgattggaaaggagattgaga

SEQ ID NO: 5302 - DNA, 338 bp, Cicer arietinum
ccctgcgaggggtttccctaaggatgcatagttctaaggttgcagctactggcgatcttaggggttatggttctcctgcctttgggcatggaaagctacttgatttatccgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctatgagtagagaggtgcctcttgggggtaatgagt

SEQ ID NO: 5303 - DNA, 302 bp, Cicer arietinum
acgacaagaagaaattcatcaaaccacacggctaactaatggtcacccattacatagaataaatgtatcacagagacaatgacacatatactaaacatatgtatcaggaaaagaattatattacaacatgtccatgtatcagttaaggaggaggctgtgaaaccacccaaccaaaccaatggctcccctgagaggaagtatccagagaggacaaccaaacaagtagaactctagttccctccgtccaaataacgaaacactacacatagcaacacagagtaagacacggggcccaacaatca

SEQ ID NO: 5304 - DNA, 345 bp, Cicer arietinum
caaccgatctcatgcctccaaagaaggataaggctcctccaccttcctccaagtcagccaaatctggtggcggcaagcagaagaagaagaagtggagcaagggaaagcaaaaggagaaggtgaataacatggtgctctttgatcaggctacctatgacaagctcatatctgaagcacccaaatacaagctcatcactccttcagttctctctgatcgtttgagggttaatggttctcttgcaaggaaggctattagagatttgatggctagaggtttaatcaggatggtatcttcccattcaagtcagcagatttacaccagggctacaaacacctaagtgtagt

SEQ ID NO: 5305 - DNA, 435 bp, Cicer arietinum
gctgttgctttgaaacaggccacgacgcccggattcaaggcatatgccaagcaagttaaggccaatgcagttgcacttggaaattacttgatcagcaagggatacagccttgtcactggaggaactgaaaatcatcttgtcttgtgggatcttcgccctcttggcttgaccggcaataaggtggaaaaactttgtgatctatgtaacatcactgtgaacaagaatgctgtttttggtgatagcagtgccttggctcctggaggagtaaggattggtgccccagctatgacttctaggggtttggttgagaaggactttgagcagatcgcagagttccttcaccgcgcagtggttctcactttagatattcaaaaggaatatggaaaacttttgaaggatttcaacaagggattggtgaacaacaaagctatagaa

SEQ ID NO: 5306 - DNA, 405 bp, Cicer arietinum
accaattatgatgtctgaataggaaagatctaacggtgtggatgtgacatgaacaccaaagaatgttcccttgttgcgataagtgaatttcactgttgaattcactgtgatcatatcagttgccacaccagtagcatctgaaccagcttgaactctaacatggtcgaattttatactcttgattgtgatatggggtttcatgggtctactagcaccccaaaggataagagagaaaagagtaaacaaaaggaagaacccaagaacaaaagcgaggaaatagtaacgacgagtgagagaatgatgatgatcttgtgattgaagaagaccttcttcttcaatgacatcgatgtctttccaatgtttgttgttgttgttgttgttgttacggtggttgttgattttccg

SEQ ID NO: 5307 - DNA, 312 bp, Cicer arietinum
agttcgagatgccttcaaaaaaggcatgttgaagtatccacctgcttcggcgctttctcttttggatacatgttatgatcttagtgggagcaaggtggtgtccgttccaaagattagttttacgtttggcggtgatgtcacggtggatctcgccgcgtcggggatactttatgtggcgagtgtgaagcaagtttgtttagcatttgcggctaatggagatgatagtgatttgactatctttgggaatgtgcaacaaagaaccttagaggttgtttatgatgttggtggtgggaaaattgggtttggttatgg

SEQ ID NO: 5308 - DNA, 313 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtga

SEQ ID NO: 5309 - DNA, 438 bp, Cicer arietinum
acctaaatctcatttctcttcgtttcaaccatgagagagatcttgcacgttcaaggaggacaatgcggtaaccaaattggatccaaattctgggaagtgatatgcgacgaacacggcattgatcaaaccggaaaatatataagcgaaggcggttccgatactcaattggaaaggatcaatgtttattacaatgaagcttctggtggaaggtatgttcctagggctgttcttatggatcttgaaccgggtacctgcccgggcggccgcccgggcaggtacacccagaagggaaatatgttgttgatattgataaaaatattgacatcacgaagattactccatctactagagttgctcttcgcaatgacagttatgtgcttcatttagttctgccaagcaaagttgatccattggtcaatttgatgaaagttgagaaag

SEQ ID NO: 5310 - DNA, 379 bp, Cicer arietinum
accatctttccgctcattgatgttgctgctcctcttcttgcgttttctgttgcacctgctgcgtatcctcgtctagtaagagagttggagaatccgtcggcaacaagaacagagatagccttgacgttaatgaaggagcgagccattgatgattcaaattaaaattagttaaaaatttgtaggaggaggaggagaagaagggttatttttaaatttgatggaagcaaggtgggaagagcttgatttaatagaaattttttgattttgtgttactaatgaaaaggagaaaattaaagaaacaagttgtcgacagcgagaaacttatgtcacatatatgtggtgtgtgagcttccagcagacacaaaggaattgtataccg

SEQ ID NO: 5311 - DNA, 244 bp, Cicer arietinum
acaaattctactacgatctacataagttctgatattgacaaaaatattattaattatgcatatgatgaatgcttctcaacagaaatgatggaaaaatggataaaaacaacagagttcattcctaagattgaagctttatatataaaaaattatggaactgcaatttagttccatttggtggtggaacttgatgaggattgaggatagaaactgataagaagagtgatcaagtaaatttgtgtca

SEQ ID NO: 5312 - DNA, 167 bp, Cicer arietinum
agcggctcgcccgtggcaggtacaatctattgccgcaaccaagagacaatgtgagccaatagggaaactatggtaagaatattacataagcaggaccaggttcaatatggtggtagttaaaactcaatgttcaaattgcagcattttaagagcaacaaccaccatct

SEQ ID NO: 5313 - DNA, 400 bp, Cicer arietinum
  misc_feature (400)..(400): n is a, c, g, or t
accgtcgagcttctccgatcaccgttgaactgctcatccgcgagtctctgtcattcttacatcaacgcaaccgcttctatttccgcgtgtcagtccggtccactttgttgcacttaccgaaccggtggttcgagtaactcttacatgattcgtgttagggattcaggttgtagtgcttattctagttttgttaaccttgattggggtctttctgtgaaccgttggtctagacccggtttggagattcagtgggtttcgcctagagaaactgtttgtgggtcccaaaaggattgtgattctgccacgtcgacttgtgggcttgattctttttcgtctaatgggatcaaaaggtgtttttgtaatggagaccttgtgtgggaccctattcaagggctgtgtn

SEQ ID NO: 5314 - DNA, 320 bp, Cicer arietinum
ctgatgaggtgaagaagattgttactactttgaatgaagctaaggtccctggtgaagatgttgttgaagttgttgtgagccccccttatgtgttccttcccgttgtgaaaagtttactccgctccgacttccatgttgctgctcaaaactgttgggttcgcaaaggtggtgcttataccggagagattagtgctgaaatgcttgttaatttggatattccctgggttattcttggtcactctgaacgaaggcagcttctaaatgaatcaaatgagtttgtcggagataaagttgcgtatgcactttcactagggaggaaa

SEQ ID NO: 5315 - DNA, 436 bp, Cicer arietinum
acttgggaagatgggagcacctccaaagagtgatgttccaattattacaccaaatgagctcactgaagctgatggtttgttgtttggttttccaacaagatttggaatgatggctgcacaattcaaatcatttttggatgcaactggaggcctatggaacaaacagtcacttgcaggaaagcctgctggcatcttttacagcactggttctcaaggaggtggccaagagactacaccgttgacatctattactcaacttgttcaccatggaatgatatttgtgccagttggatacacatttggagctggcatgtttgagatggagaaggtgaaaggtggttcaccttatggttcaggaacatatgcaggggatggctcaagacagcctagtgagttagaattggctcaagcttttcatcaggggaagtacctcggc

SEQ ID NO: 5316 - DNA, 437 bp, Cicer arietinum
gagtgtatagaagtgttgtgtgcgtgcggcggtggcgcgcacagtgatacttccaatttagaagaatagatcgatttgttgtttggatctgtgaattcagcaaacatggttacaaaaacagaggaatctcaactgaagaatctagaaatccaggtcgataatggcggcggaggagcttgggagtttctttccctcgtcaggaagctcaaggttcgccgttctgataaagtcctcaagcacggtttgtccatcttgaacgatcccaaacaacgatccactctcggctctgaagaatggactttgtatgagcaagttgcagttgcagctatggattgtcaaagtcttgatgttgctcaggactgtacaaaggctcttcggaagaggtttcccgagagcaaaagagttggcaggctggaggcaatgttgctcgaagcaaa

SEQ ID NO: 5317 - DNA, 307 bp, Cicer arietinum
actctttgtttatctccttgtattttctttatttctttctgtttgaactgtggccatggcagtttctgcaattggtttcgaaggtttcgaaaagaggttggaaatatgcttttccgatccaggacttttttctgaccctcagggtaggggtttaagatctctcacaaaatctcaattggatgaaattcttgcaccggcggaatgcaccattgtttcttccctagccaacgacgatgttgactcctatgttctgtctgagtccagcctttttgtttatgcctacaagatcattatcaaaacctgtggt

SEQ ID NO: 5318 - DNA, 270 bp, Cicer arietinum
actacaactagtgctagtagagagcaaagctatagttattttaatactagtaaggaaagtgttttctctgaaatcatgaacccaaaagcacggtaaatttctcagaattactgttagttgcgataattttattcaagttaaaatgtatagttttttttaaaatcgcagcgcttggtcgtgatttttactaaacatgtatttaatcggatcattatgtataatggaattttagtatactatttataaggcaaagttttaggtttgaagact

SEQ ID NO: 5319 - DNA, 351 bp, Cicer arietinum; identical to SEQ ID NO: 1179

SEQ ID NO: 5320 - DNA, 422 bp, Cicer arietinum
ggtgctttcggccgcagcaagcgatcgcaaccaacggagagaggattctgcacagaaattcatcgtcacaatcatgggtaaggttcacggttcacttactcgtgccggaaaagtgagaggccaaacaccaaaagtggccaagcaggacaagaagaagaagccacgtggccgtgctcacaagcgtatgcagtactaggactctctgtgtttatgatgaagccgaacgaggtgcatagtgactctgacacagagtcatttgagttactcaacgatattgactggactaatctatgtgatccaatgtcagcagtagatattgccggggatactagtgccagtcagtttatgcagaatggaggaagtattagcttctccggaacagtttgtgaagcgggatataatgctgccaagatgatcttgct

SEQ ID NO: 5321 - DNA, 438 bp, Cicer arietinum
ctgcagatgtggatatctcagttaattcaatggaacccaataccatatctgcacaaccgctagttgcttctggctcagaggagattgtggagatgaagcccaaggatggtcctaaacggtgcagcaactgcaataagcgggttggtttgacaggatttaattgtcgatgtggtaaccttttctgcgccgcacatcgctactctgacaagcataattgtccttttgattaccgcactgctgggcgggatgcgatagctaaagcaaacccggttgtcaaggctgagaagcttgacaagatatagatttggtgtcttaaagtttcatgtttcaagatgctgttatgctcaatgtcatcatgagatgatccgagtttcctgcatattttaatggtgttcttattattttgttatgtgatgggggacttggagtattatctct

SEQ ID NO: 5322 - DNA, 211 bp, Cicer arietinum
tttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtgg

SEQ ID NO: 5323 - DNA, 206 bp, Cicer arietinum
atggtggtggtgatggtggttctcgctactcacgtggcggtgaaggtggtggaaactggagggactagatttaagttcttcttgttggggtttatgattaagaatgttctccttgtcatgtcactttagtaggtttaagaaattagtggtttggctatggtatttatcatgttatggttttgtgttactgtggttctcgtttttgt

SEQ ID NO: 5324 - DNA, 439 bp, Cicer arietinum
aaacaatggtgatggtggtattgatcctggagtgaggttgatgtattcagcaaacgaaggtgatgttgatggtatacgcgaggtgttggaatcaggtgtgagtgcgaattttagggatggtgatggacgcactgctcttcatattgctgcttgtcaaggttttactcatgttgttgctttgttgctcgaaaaaggtgctgatgttgatcctaaagatcgatggggtagcacgccccttgcagatgcgatatattataaaaacaatgacgtgatcaaacttttggagaatcatggagcaaagcctttgatgacccctatgcatgttaatcatgcacgtgaagtcccagaatatgaaatcaatcccaaagaacttgattttacccacagtgtggagataacgaaggggactttctgtagtgcattgtggcgtgggactgag

SEQ ID NO: 5325 - DNA, 405 bp, Cicer arietinum
acaagagatcaaggctatctagaaacaggaggactgtgaaccgtgcttatggtggagttttatctggaggtgctgtcagagaaagaatcattcgagctttcttggttgaagagcagaagattgtgaaaaaggtcttgaagatccaaaagacaaaggagaaacaagcttcaaaggcttaagtttcaagaaaagagataaagatctttttggagggattttaggtttgagtcattatagtaaaaaacaaatttattagaactgttgttcccttgttaattttgtgctcatttggtttctttgaactcattttagtgcaactgttagcctattatgatacagttttgttcggtttattgatattttcatgttttcttatgaatatatgaattttcatgttttcctccg

SEQ ID NO: 5326 - DNA, 434 bp, Cicer arietinum
ggtcagagcaaatcataagcgaaaacaaaaaaacaaaattaaaaggcagaggcttaattttggacggtgttgtgcagaagaggagaatggcagcagaagagggacaagtaatcggtgttcatactgtggatgcttggaaagatcagatccagaagggaaatgagtccgggaaattgattgttgttgattttactgcttcttggtgcggcccatgccgtttcattgctccaattctagcagagattgctaaaaagctgccgaatgtcaccttccttaaggttgacgtggatgaattgaagactgttgctgaggagtggggtgttgaagctatgccaacattcttgttcttgaaagaaggaaaactagtggacaaggttgtgggtgctcagaaggagaagctgcaatcgacaatagccaagcatgcttgaagggtc

SEQ ID NO: 5327 - DNA, 437 bp, Cicer arietinum
actatactgctgatgttgcggtttggatggctcatcttcatgatgatttttctgttggaaaccttcccgcgtttcaacaaatgactgctttggttatggtctttgacatgaatgatttatcttccctaactgcacttcaaggctgggtatcacacacggatatccaaaactttgagatattgctatgtattggaaacaaagtcgacctggttccagaccatccagttcatgctgaatatagaagacggttgctgaaacttgaagactctgctgtggatctctattctgaattgcccgagtatggaatatctgaatatgaaggaactagtttattgaggagtgatgaaccttcgtgggatatcagaaagtcctgcatggaatggtgtagtgagcacaatattgagttcattgaggcttgtgcttccaatgccgatttc

SEQ ID NO: 5328 - DNA, 293 bp, Cicer arietinum
actaggttgaattactattgcgacactgtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgttttcgt

SEQ ID NO: 5329 - DNA, 293 bp, Cicer arietinum
actaggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgagcgcttggctgccacaagccagttatccctgtggtaacttttctgacacccctagcttcaaattccgaaggactaaaggatcgataggccacgctttcacggttcgtattcgt

SEQ ID NO: 5330 - DNA, 431 bp, Cicer arietinum
acaacttcaactaggtcaaacactcgaatctccaaaaaggagaaatatatactcccttaagtatataatccttcaaataaggaaaaaaggaagtgaaaacaaagtgcacctaaaatccaaactaagcccaaaattagcctctgatgatgatacttaatgggacacgttaagtttcaatcatttcaattgtctctccttgtcctccgacgtggaggattggatgtttcctccttatctttgttatcttcattctctccactgtctttcttggaaggttctttgggttctgtggtggtcttcttctccacctttgcagcaggtttcttcccaccgaatatgatcctgaagaaaattgacacgaagacaatcacaatggatacgagaacaccaatggtcacattagggtgcttctcggccttttcaatgagttc

SEQ ID NO: 5331 - DNA, 186 bp, Cicer arietinum
taggcttctcccttcaagacagtttgggtatattgtcttgactacctcagctggcattatggatcatgaagaggccaggagaaagaatgttggtggtaaggtccttggattcttctactaggctagttttttattaaggatcttttctatttcagttattgatttaccgaatgtaatggaggatgt

SEQ ID NO: 5332 - DNA, 256 bp, Cicer arietinum
gattctctatgaaagattatgaagaatatatgaaaataaagaaagtgatggaaggaagatacatcgaaagagaaaaaagggaagcaaagtttccgcgttttgtcttcaggaaagaaaaggcgttaatttttctattatatggtgataagattgttattgtgttttttttctctaatttctttaagctgttatgtattttagctttttatttattttgacagttgtaaagcagtctgttctgctgttaattaatagt

SEQ ID NO: 5333 - DNA, 301 bp, Cicer arietinum
actgccgatgatctttgagttgaatcaccaaccccttccatcagatccttactagttggcgacccattcgaaaaaacagatttcccgtttggagaactagaattagggctacctatttgagccttagtagaaaggttgctaccagtctcatcattatccacaaagggattcatgcttgagccggaaacttgcatatctgaaggttcaccccatcccgcccaatcaggcaaaggtctatcaccaaaacacgcttcattgtctgatgcctcaaatctgaagaaacccatatcatgtgcagtac

SEQ ID NO: 5334 - DNA, 384 bp, Cicer arietinum
acaggatatccctcttccttcaccatccaacataccaaggcacaaaaggcgctgtttttgtcaagcccgtcacccgtcagcgggttcggaggcaatttgtcgaatttttccaccgaccagaattctctcacgcatcgctacatctgctgacgcagtccacaatctccagtaaccaagttgtagctcgtagtcgactgtcgtggcggcagggaaaaacctcgggaagggatcagaggccggcggtgcggcttgccttcaaaggagaaaaacccatcgcaatcggcgtcgttgatcggaagaatgtcgctaccgatgccacgggcaccgtcctccgatatctaaggcgttctggttctgaggtgccgccattagatccgacaaagg

SEQ ID NO: 5335 - DNA, 415 bp, Cicer arietinum
acagagcttacctggagaccgtggaacgaggcgactacctcgtccacagagcagcgttctagccgccttgggtttttccctgcgaggggtttccccaaggatgtatggtcctaggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctacgagtagagaggtgcctcttgggggtaatgagt

SEQ ID NO: 5336 - DNA, 305 bp, Cicer arietinum; identical to SEQ ID NO: 58

SEQ ID NO: 5337 - DNA, 309 bp, Cicer arietinum
acattagcaatgtcctacagcctccacaataaagttgtgacatatccatcccaggtggaggaacaggggtaattgtgttgcacaatgcacaacaaacattggttggccctctagggtaaagcagcatgctcctacaaccattacacacaatttggctctgcatagctgtggctcctgaaccctattctagaagaaacgattcagacaacggagtcaaacaagaaaaaataataataataaaattaataagaatctttttttgtttattattttaggggggagaaacggtggatggagagaaaggagaag

SEQ ID NO: 5338 - DNA, 436 bp, Cicer arietinum
gagggcttgcgcactcaactcatcaacaatggttgccgctaagaagaccaagaagactcatgagagcattaacaacaggctcgctcttgttatgaagagtggcaaatttaccctcggttataaaaccgttctcaaatccttgaggagctccaaagggaaattgattatcattgccaacaactgtcctcctttgaggaagtctgaaatcgaatactatgctatgttggcaaaggttggagttcatcattacaatgggaacaatgttgacttgggcactgcctgtggaaaatattacagagtgtgctgcctcagcattattgatcctggtgattcggacatcattaagtcaattcctggagaccagtaaaagtaggaaagattttctgtttgatgttttctattctcagatgtttagacattgatgaaagaaattcta

SEQ ID NO: 5339 - DNA, 437 bp, Cicer arietinum
gattcgcccgggcaggtgcgtcacgctgtaagacgtggatggtacgccgagctggtctcgtacgttccaccgcgccgatgcgttgatcgtcaactaggtcgatgctgcggccgttcggcgcagtcctctcgtggctgtgcagacgtaatttttcttcctcactctgttggttcttgagtgagctgggagttctcgaaagaggctgccccagaagcaaacaatgtcaacgcatgagaaccccatctgtcctgacgatgggatcccgtctcttgcagacaatatctggatgtggttcagggcctggcgattgatgaaggtctagactagccattacgaagtatgaggtggatgatgaaggacagtcatgagcaacgatttaatgaaggaaatagcttagctgtctaggatagatgacgattgaatctattcatgaaacc

SEQ ID NO: 5340 - DNA, 384 bp, Cicer arietinum
acaaggatttgacggatcaattttagtcaaataagcttgccttctcttaaatccatcaccctttccttcaaggtcttttctcttctcccaccccaaaaagacaggagttaggagaagactaatgataaaatctatgatctttgaatccaagatggtcaagttatggactataacatcataattcagaagccatctttcttaagcaacacttatgatgttatctccatttttgttgaaacatggcattgcatataaagctgaatgtgctgatgatgttttcctttgatcagatgagaaggacagtccaagggaaagtgttggagggtcagtagatgaatcactagaactagaggtaatatcagatacagtggaagcttttggatc

SEQ ID NO: 5341 - DNA, 256 bp, Cicer arietinum
accgctgacaccttgactatggattaccaccgcggggccggtgtggaggttagaattgctagaatctttaacacctacggtccccgaatgtgcttagatgatggccgtgtcgttagtaacttcgttgctcaggcattgaggaaggagcctttgacagtttatggggatgggaagcagacaaggagtttccagtatgtctctgacttggtggagggtctaatgcgtcttatggaaggggaacatgtgggacctttca

SEQ ID NO: 5342 - DNA, 294 bp, Cicer arietinum
actaggttgtttccactattgcgacgctgtcatcagtagggtaaaactaacctgtctcacgacggtctaatcccagctcacgttccctattggtgggtgaacaatccaacacttggtgaattctgcttcacaatgataggaagagccgacatcgaatgatcaaaaagcaacgtcgctatgaacgcttggctgccacaagccagttatccctgtggttacttttctgacacctctagcttctaattccgaaggactaaaggatcgataggccacgctttcacggttcgtattcgt

SEQ ID NO: 5343 - DNA, 204 bp, Cicer arietinum
actgctttttccttgtcttcaggaactaatggagcttcaccaggaaagtgaagaagaagtcacagacacagaacaagctgaaaactggttctctttgacttctgcccaacgtatatgtgatatgtttcttgctcttgataaggattcaaacgggtcattgggtaaacaagagctgcgcgaatatgcagatggaaccctgactga

SEQ ID NO: 5344 - DNA, 399 bp, Cicer arietinum
acgagttttttccccgtaacgcgagcgaagacgctgagatccaaatcaacttttcagaatgaagttcaacgttgcaaatccaaccactggatgccagaagaagccggaaatcgatgatgatctgaaactccgtgcattttgggacaagaggatctcgcaagaggttaatggcgatgctttgggcgaggaattcaaaggttatgtcttcaaaatctccggaggatgtgacaaacaaggttttccaatgaagcagggagtgttaactcctggtcgtgttcgcctcttgctccaccgaggaactccttgtttccgaggatatggaaggcgtaatgtagagcgaaggaggaagtctgttcgtggttgcatcgttagtccagacctctctgtcttgaacttggt

SEQ ID NO: 5345 - DNA, 329 bp, Cicer arietinum
aaaaagaatgtcagacaagaagctttcaagagcatcccaagaagatcttattcaaaaaaaatgggaaagaagagactacttaggtgttcatccacaaaaacaagagggtttaagctatgttggtattcacattccagttggtagaatccaagcagatgagatggacgagctagctcgtttggccgacgaatatggcacaggggaactccggctaatcttggaacaaaacataataatcacaaatgtagaaaactcaaaacttaatgtattgcttcaagagcctctcttgaaagacaaattctcaccttcaccttccatactaatgaaaa

SEQ ID NO: 5346 - DNA, 375 bp, Cicer arietinum
actggaaatcacaatcaagcgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtgg

SEQ ID NO: 5347 - DNA, 191 bp, Cicer arietinum
accaaatatctcattttgaagaccatgcatgagataacatagctatcataaaaacttggaaagctaaacaaccttatagcacaaacacgacaactaataactcatttcttttttccagccttggcagcatcagaggccttggtcttctttacaccacggatcttcttggccctattctttctctccttcat

SEQ ID NO: 5348 - DNA, 293 bp, Cicer arietinum; identical to SEQ ID NO: 4950

SEQ ID NO: 5349 - DNA, 297 bp, Cicer arietinum
actgttaatttacgatcatgcagtgcaacattttcaatagctataacagagtaaaggaaccacgactatgttctgtttcactatccaggaactaggatccaatgtagcatctactcggaatcctgcatattctgagtaggagcctctgagcccttagtgagtgatagcttggttggaggtccatcaaacagacgggaacattctgtgtatgcagatcctattccaactccagcaccaaaagcaatggatgcccagcgagtctgaggactcctgaaaaagaggagaccgccaaatgcc

SEQ ID NO: 5350 - DNA, 203 bp, Cicer arietinum
taatcagaatcaaacgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatccaaaaagaggggcagcgccccgcctccgattc

SEQ ID NO: 5351 - DNA, 414 bp, Cicer arietinum
acagagcttacccggagaccgtggaatgaggcgactacctcgtccacagagcagcgttctagccgccttggggttttctcctgcaagggttttccccaaggatgcacggtcctaggttgcagctactggcgatcttaggggatcatggacttcctgcctcagggtatggaaagctacttgatctatcagtgcaagagaattctaggctggagaggaatagttcccgctgacgggatgacctcttgaaagtaaagcgcctttgtgccgatgatatgctggatgaactagatagaagcgttgctggagggaagctctgctgagatcagctgtattgatgtccaatgggacgtgcttcaccgacaactactgtagagctggctacgagtagagaggtgcctcttggaggtaatgagt

SEQ ID NO: 5352 - DNA, 446 bp, Cicer arietinum
aggtagaaaagtctaccaagtaataactcttagaatatagtcacggggtcaagctgaaacttgttggtttttcaacaatctgaaactttcattcaagacatgcaagctttcttcaacatggagccacactttgcaatcaagaaggatgtcactgaattaattgggaacaccccattggtatatctaaacaacattacagaagggtgtgtagctcatattgctgctaagcttgaatacttgcaatcatgctgcagtgtcaaagataggatagcgttgagcatgattcgagatgctgagagtaaaggcctcattacacctggaaagactgttcttgttgagccaacaagtggtaacaccggcataggattggcgtccatagcagcgccgagaggctataaacttttagtgattatgccatcgtatgtgagtcttgagagaaaaattat

SEQ ID NO: 5353 - DNA, 420 bp, Cicer arietinum
atcatattactcacagagagagagagaaagatacgaagaaaacgaaaacacaaagcaattcgtcgtttgatctgtttccatgtcgccaacgaatctcttctaaccgtttggattccgatctccgtgctgactactcagactgccataggatagtataggatattaggatcactgttcatcaaccgccatggcagcagcaccggcaagagctcgtgtcgattacgattacctcatcaagcttcttcttatcggcgacagtggtgtggggaagagttgtcttcttttgagattttccgatggttccttcacaaccagttttatcaccaccattggaattgatttcaagataagaaccattgaacttgatggcaaacgcattaagttacaaatctgggatacagctggtcaggagagattccg

SEQ ID NO: 5354 - DNA, 403 bp, Cicer arietinum
atgaaaattgtcaccataggaactgatgctaagggaaacattaacattgaagagttgaagaaggctgctgaaaaacataaggacaacttatctgcatttatggtaacatatccttcaactcatggtgtttatgaagaaggtattgatgatatttgcaagatcatccatgataatggaggtcaagtatacatggatggtgcaaacatgaatgcacaggtaggacttacaagcccaggttggattggagcagatgtttgccatctcaatctccataagacattttgcattcctcatggaggaggaggccctggcatggggcctattggtgtaaagaaacacttggcaccatttttaccctcacatcctgtggtgccaactggaggaattcctgcccctgaaaaat

SEQ ID NO: 5355 - DNA, 200 bp, Cicer arietinum
acaaggttcccactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagtt

SEQ ID NO: 5356 - DNA, 266 bp, Cicer arietinum
acgggtctttctgttggtttgaacaagggtcacgttgtcaccaagaaggagttggctccacgcccctcagatcgcaaggggaaaacaagcaagagagttcacttcgtgagaaacctcatcagagaggttgctgggtttgcaccttatgagaagcgtataactgagttgctcaaggttggaaaagataagagggcacttaaggttgcaaagagaaagcttggaacccacaaacgtgccaagaagaagcgtgaggagatgtccaacgt

SEQ ID NO: 5357 - DNA, 339 bp, Cicer arietinum
accaaggtttcacataaggaagatagagagagattggttgttcgaaggtttaagtttgaggacccacgaattgagcaaattcaggatcttgagaatgatatgctgaggtatttcagagaggatttacataggagactcttaagtgcagattttaagaagcaagttgatggacttgaaatgctgcagaaggcacttccatccattgctaatgattttatagaaattttggacattcttttgaggtggtttgtgttgcagttctgcaaatcaaacacaacatgtctattaaaggtgctagaatttcttcctgagttacttgacattttgaaggatgatggg

SEQ ID NO: 5358 - DNA, 236 bp, Cicer arietinum
aaggaatttgcccacttcacttcccaagtcatcatcatgaaccatccaggacagattggaaacggttatgccccagtcctcgactgtcacacctcccacattgctgttaagttcgctgagcttctcaccaagattgacagacgatctggtaaggaactcgagaaggagcctaagtttttgaagaatggtgatgctggtcttgttaagatgattccaacaaagcctatggttgtgga

SEQ ID NO: 5359 - DNA, 356 bp, Cicer arietinum
actgtgacattgccccaacaacaacccacaagagcttaaggggccccagggctggtatgatcttctaccggaagggacctaagccacccaagaagggtcagcccgagaatgcagtttatgattttgaagacaaaatcaactttgctgttttcccctcccttcagggtggtcctcacaaccaccagattggtgcccttgctgttgctttgaaacatgtcacgacgcccggattcaaggcatatgccaagctagttaaggccaatgcagttgcacttggaaattacttgatcagcaagggatacagccttgtcactggaggaactgaaaatcatcttgtcttgtgggatcttcgccct

SEQ ID NO: 5360 - DNA, 243 bp, Cicer arietinum
gtgttgtttttcgggtgtctcttcggactatttgttaaccggcgaaaagaaaaagagaagagtcactcactcaacaaagcggtgaagttggtagcaacaaacagaacagaagaaagaagcttagcaatgggttttatcggtgacactatggattctatcaaatctcttcagatccgtcaggtcctcactcaggctgttagtctcggcatgattgttttgtctgcactgataatatggaaggca

SEQ ID NO: 5361 - DNA, 347 bp, Cicer arietinum
actattatttcacagcagaacagaatgctttacaactgtcaaaataaataaaaagctaaaatacataacagcttaaagaaattagagaaaaaaaacacaataacaatcttatcaccatataatagaaaaattaacgccttttctttcctgaagacaaaacgcggaaactttgcttcccttttttctctttcgatgtatcttccttccatcactttctttattttcatatattcttcataatctttcatagagagctatggtaataaaccactattattgtttactatctaatagtggtaaggaggaggaggtgaggaatagaggtaaggcttcttggttggagttgg

SEQ ID NO: 5362 - DNA, 166 bp, Cicer arietinum
actattattccacagcagaacagactgctttacaactgtcaaaataaataaaaagctaaaatacataacagcttaaagaaattagagaaaaaaaacacaataacaatcttatcaccatataatagaaaaattaacgccttttctttcctgaagacaaaacgcggaa

SEQ ID NO: 5363 - DNA, 445 bp, Cicer arietinum
  misc_feature (5)..(5): n is a, c, g, or t
gtagncgcatgctcccgtccgccatggcggaagagggaattcgatttcgagcggccgcccgggcaggtaccgaatgtccctaatggaatgtaaaggtctggtgcatttatgtcataaatcggtggtttataagagagcctaccacccactggctcggtgattctagtccaatgacccctgtgcagaaatggaaacaaaaccaccttcaatttgttcttaacataatggtcattcacttgaaagtagtattggggatcagagaaataccgacttatattgctttggacatactcagagctggatcctaatatttttcctccataagcacccaatccacctcgaatgagtcctgaaccagcaacttgaaatgcactcccaaaaggattaggttgttgtgtgcttgctggaggctgcgccacccctggttgcggtccaacattattat

SEQ ID NO: 5364 - DNA, 298 bp, Cicer arietinum
actgttaatttatcatcatgcagtgcaacattttcaatagctataacagagtaaaggaaccacgactatgttctgtttcactatccaggaactaggatccaatgtagcatctactcggaatcctgcatattctgagtaggagcctctgagcccttagtgagtgatagcttggttggaggtccatcaaacagacgggaacattctgtgtatgcagatcctattccaactccagcaccaaaagcaatggatgcccagcgagtctgaggactcctgaaaaagaggagaccgccaaatgcac

SEQ ID NO: 5365 - DNA, 360 bp, Cicer arietinum
  misc_feature (24)..(24): n is a, c, g, or t
  misc_feature (230)..(230): n is a, c, g, or t
gacggacaattgcaccccgacggnggaaaaaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgccatctaattagtgacgcgcatgaatggattaacgagattttttttgtccctgnctactatccagcgaaaccacagccaagggaacgggcttggcggaatcagcggggaaagaagactctgttgagcttgactctagtccgacgtcgggaaatgacttgagaggtgtaggataagggggagctg

SEQ ID NO: 5366 - DNA, 432 bp, Cicer arietinum
gattactacggtggaactggtggtggttacggtgttcctaccagttatggcggagggtatggtcaaggtgtgactagtgcttgggattaggttagtgtgacatcactaattcattctcatgttgagtgtatataaacttaagactttaacattgtaaagttgtatcttctctaccatggtttgcctgaatccatgcattccttactacaggaaatcttttttcataggaaagatctacaattggcttggttttgctggttaggcacataggggttggttgggaaatgctgcatatggagaaagagaaaatgtgtaaacagcccgaaaatttctgacttgattactcatctgagtttctgtagaatagagagtgtaaactgattgctttggagactaaagtggtaagggctgatataagtgggttcatattgt

SEQ ID NO: 5367 - DNA, 314 bp, Cicer arietinum
ccatgttcgctgggagaaggatgaaaccggcaagtttcaatttaaggaaattgagggcagtgaagagattattgaggcagacatagttttactagccatgggattccttggtcctgagtcgaatattgcagagaagttgggtgtggagcgagacaacaggtcaaacttcaaggctgattatggtcgcttcccgaccaatgtgaatggggtgtttgcagcaggtgattgtcgccgcggccagtcgttagttgtatgggctatttcagagggaaggcaagctgccgcacaagtcgacagctacctcaccaaagaag

SEQ ID NO: 5368 - DNA, 285 bp, Cicer arietinum
accgttgttccgttggtggtctagaatggaccaccgacagcgacgccctagccaaagccttctcttcctacggcgaagttactgattccaaggttattaacgaccgtgagactggaaggtcaaggggttttggattgtgacgttttcaactgagcaatccatgagagacgcaattgaagggatgaacggtcaagatgttgacggacgtatctttaccgtgaacgaagctcagtctcgtggtagcggtggtggaggcggccgtggtggcggtggatatggtggagg

SEQ ID NO: 5369 - DNA, 381 bp, Cicer arietinum
ctatcctcttggcctacttccagtgttgaggaagttgcttcaacaggacctggcattcgctttttccaactctacgtggttaaagatagaaatgtggttactcagcttgtgagaagagctgaatctgccggtttcaaggcaattgcccttactgtggacactccaatgcttggtcgcagggaggctgatattaaaaacagatttacaatgccacctctccttgtattgaaaaactttgaaggattggatcttgggaagctggataagactgatgactctggtctagcctcttatgtttctggccaagttgaccgatcactcaattggaaggatgtgaaatggctccaaacaatcacctcattgccaattttagtgaagggt

SEQ ID NO: 5370 - DNA, 424 bp, Cicer arietinum
acataccagattaccacatttatctggaatgcacttacaactgttccctaaacttgatcaatttgctgtcaaatgcaaaactaaactaaagggaaactttggttccccacaaccaagatagaatcatacatgttctataaacatgaacatgctaataaatctgcaaattgatgaccaagatcaaaatttcacaataactacactagatacaaaggtttgtttcctgctaagtctccactgattataaataacatggtatgtgaatgaatgtgataatgtgcattgtaaagttgagcgaccaagttctaccaaagaagaacaaccaactgaaagacgtaggacttgtcttttctcggataaaattttcaccataaccatccattctttcccaaccgagcgatgcaggattagtctttacagttac

SEQ ID NO: 5371 - DNA, 311 bp, Cicer arietinum
  misc_feature (1)..(1): n is a, c, g, or t
nacccttatgttcccacgtgagaagaaacaatctgaaagagaagcaggaacaacacgtaaaaagcagcagcaacagcattcccagcaattgccttcatctgaaattttgcttgatgacgattccttgcataatagtaatacaggcgatagtagcccaaaccagaacaaggagggtaatgatggttctgatgatgatcctcacaggataaaatcatctgtgtctccattcaaaggccagatcgacctcaatatccagccggagcgagaagaagaattatcaccaggttcagattctggtggtgtgatgaaac

SEQ ID NO: 5372 - DNA, 180 bp, Cicer arietinum
aacaaagtgtaaccagggaaagcatatttgtgcaataaagatgagaacaagtgtaatatggagacactattttatgggaatagaagaaacagagtggttcaaacacaagaagatagagggaatattcatgtgccagctaagagattagatggctggatggagattgggattggagagttt

SEQ ID NO: 5373 - DNA, 397 bp, Cicer arietinum
gaatcgattttttacccgcgccccaatctcgtttctcacttcttccctccgagccacccaaaatgactaagagaaccaagaaggccggtattgttggcaaatacggcacacgatatggtgccagtttaaggaagcagattaagaagatggaagtcagtcagcacagtaaattcttctgcgagttctgtggaaagtatgctgttaagaggaaggctgttggtatctggggctgcaaagattgtggaaaggtgaaagctggtggtgcatacacattgaatactgccagtgctgtaactgtgcgaagcaccatccgaaggctgagggagcagaccgagagttagacaaccagtttacattattctcattttgttttctaagtcattgcagaaacttttgt

SEQ ID NO: 5374 - DNA, 197 bp, Cicer arietinum
accgttgtttccctggtggtctagcctggaccaccgacagcgacgccctagccaaagccttctcttcctacggcgaagttactgattccaaggttattaacgaccgtgagactggaaggtcaaggggttttggatttgtgacggtttcaactgcagcaatccatgagagacgcaattgaagggatgaacggtcaaga

SEQ ID NO: 5375 - DNA, 417 bp, Cicer arietinum
cggccgaggtatacgagtgtgatgaaaatcaattggaaatcgatatttccaagttgctacaaggatgaaaatggttactcttcaccgaaaccagcagcaacaaaagcggttgctacaaagacaaattcatttaacagaatatctctgacggatctgagttttccaagcgcaacaacgctttcagcagaagatctttcaatttctctagtaggttctaatctctatgttttcacactcgctgagctcaagattattactcagggtttctcttcaagtaactttcttggtgaaggagggtttggacctgtgcataaaggtttcattgatgataaagttagacctggacttgaacctcaacctgttgctgttaagctcttagatttggatggttctcagggtcataaagaatggctgact

SEQ ID NO: 5376 - DNA, 432 bp, Cicer arietinum
tcttaattcttcctcatgggcgttttcagttttgaggatgaggccacctcaattgtagctcctgctactctctacaaagctctagttacagatgccgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaag

SEQ ID NO: 5377 - DNA, 276 bp, Cicer arietinum
tttcattagcgtggtcaagaacgaggtacagcgattcacacattaaggatgcacatcatatcaagcttgccagactgacaaatccatccagtattagtcacgtttaaaaatatttgaccatgccacgaccttccacactcagctttgtggactgaagctgcttcttttttggtgccctcaactgctgcaatttcttattcatcttcatacgctgctggtcctgagatgcttgttttgaccgtgctctaatttcatcaggatcaattttagattggg

SEQ ID NO: 5378 - DNA, 295 bp, Cicer arietinum
accgttttttccttggtggtctagaaaaggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaactttaccgtgaacgaagctcagtctcgtggtagcggtggtggaggcggccgtggtggcggtggatatggtggaggcggtggat

SEQ ID NO: 5379 - DNA, 398 bp, Cicer arietinum
accaactatccctcaaattcctcaaattccaactgtgcctcaaatacctcaaattcctaagccagagttacctattgtgcctaaaccataagtgcctaaaaatttcatgaattctatatatctactattcagctattttgctttatagtaatttgtattgtattatgtgtttgttaaaatttgtttgtgtcatttgagggtgtttttatttgtactattaattaacagcagaacagactgctttacaactgtcaaaataaataaaaagctaaaatacataacagcttaaagaaattagagaaaaaaaaacacaataacaatcttatcaccatataatacaaaaattaacgccttttctttcctgaagacaaaacgcggaaactttgcttccctttttt

SEQ ID NO: 5380 - DNA, 435 bp, Cicer arietinum
actatatgcctccaatgcaggcttgctttccaagctaccaagtaaagaaaaactagaagtatccttggagactcttcaatgtgaagtatatacagtatctccaatcagggtgtttggtcatgatgtgcaatttgcaccaattggattgcttgacatgtactctcgcggtagtttcatttttcctggagctcagtcctatcctcatcgccacttttcggaggaagtagctgtccttgatggttactttgggaagcttggatcaggcagtatggcttatattatgggcggttccaacgaagcacaaaattggcatgtttactctgcctctgcagattccgtgagcccaattgactctgtctacactttagagatgtgcatgactggcctagacagagagaaagctttggttttcttcaaagaacaatcaggttcagc

SEQ ID NO: 5381 - DNA, 292 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgtttgcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtgg

SEQ ID NO: 5382 - DNA, 423 bp, Cicer arietinum
acaagctttttacacacactcttgagaaagagggagtttcttattccttctagaaacaaaaacgcttctttcggaaacggagatttagggttttcatttatcggcgatcgaaaaaagcgagatttgaaattgtgagaagaaatggcagagcatcacgaacacgacgaatcaaagggtgaatctttgttagacaagatttcagggaaaatccacgaccacgattcttcgtcttcatcggattccgataacgagaaaaagaatccatccccttctactctcaagtcaaaggttttcaggcttttcggaagggaaaaaccacttcacaatgttcttggtggaggaaaacctgctgatgtttttttatggagaaataagaagatatcagcaacggtgcttggagtgggcacagcttcatggattctg

SEQ ID NO: 5383 - DNA, 417 bp, Cicer arietinum; identical to SEQ ID NO: 1860

SEQ ID NO: 5384 - DNA, 428 bp, Cicer arietinum
accggttcttgtccgggttccctattgatggaacgtctctccgttgattatggcaaaaagtccaaactcggattcaccatctatccttcccctcaggtttctactgctgttgtggaaccatacaacagtgttctctccacacattctctccttgagcacaccgatgtcgctgtgcttttggacaatgaggcgatctatgacatttgtaggagatctcttgatattgaaaggcctacttacacaaacttgaacaggttgatatctcaaatcatatcctcactcacaacctcattgaggtttgatggggcgattaatgttgatatcactgagttccagaccaaccttgtgccttatccccgtatccacttcatgctttcgtcctacgcacctgtgatctctgctgccaaggcataccatgagcagctctc

SEQ ID NO: 5385 - DNA, 293 bp, Cicer arietinum
ctatttcgttcatgagagaaagaaacttggaagcaccaagagcaccaccaatgaaggactgaaatgtgctattgatcacattttggatgctcaacagaagggtgagatcaatgatgacaatgttctttacattgttgagaacatcaatgttgctgcaattgaaacaacattatggtcaattgaatggggcattgctgagctagtgaatcacctatagatccaaaacaaagtaagggaagaaattgatagagttcttggaccaggacaccaagtaactgaaccagatctccaaa

SEQ ID NO: 5386 - DNA, 326 bp, Cicer arietinum
accgttttttccttggtggacttgcatgggccaccgatagcgatgcccttgagaaagccttctctcaatacggagagatcgtcgattcgaagattattaacgatcgtgagactggaaggtcaagagggtttggattcgtgacatttgctaatgagaagtcaatgagggatgctattgaaggaatgaacggacaggacatggacggacgtatcattactgttaacgaagctcaaaaccgttcaagtggcggtggaggaggtggttacggtggaggtcgtcgtgaaggtggatacaaccgaagcagtggtggtggtggaggctatggt

SEQ ID NO: 5387 - DNA, 391 bp, Cicer arietinum
acacgcatttcctcatcaaattataatccattaattgggtggatgcatggagctcagatggttgcatttaacatgcaggggtatgggagatctctttggttgatgcagggaatgtttaaagccaatggaaggtgtggttttgttaaaaaaccagattttctattaaagactggtcccaataatgaggtttttgatcctaaagctcctttgcctgtgaaaactactttgaaggtgactgtatatataggagaaggatggtattatgatttcaagcatacacactttgatcaattctcacctcctgatttctatgcaagggtggggattgctggagtccctttcgatactactatgaaaaaaactaagtcaatagaggataattggctacctt

SEQ ID NO: 5388 - DNA, 418 bp, Cicer arietinum
gcggtggtgttgtccgggcatcgcacatattgataaaacacgaaggttctagaaggaaagcttcgtggaaagatccagaaggttacgtcatcaagaacactagtagagatagtgccgttgctatccttaaggcaatgcaaaacgacatcgtttctggtaaggcaactttcgaagacattgcttctcgttactcagattgtagctctgctaaacggcggcgatctcggtgcttttggtcgtggccagatgcagaagccatttgaagatgcaacttttgctcttaaagttggtgagcttagtgacattgtggatactgacagtggagtccacataatcaagagaacaaattgattattacacggagtaatcttcatttagagagaacggtagcatttatagatgattctcgcgattgttg

SEQ ID NO: 5389 - DNA, 310 bp, Cicer arietinum
ggatgtcattagcgtgggcaaaaccgaggtacaaaaacgagaaccacagtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacgtgtgtagcgagaaccaccatcaccaccaccatatccacgatctctgctaccaccataaccaccaccacctcctccgccatatccacctccaccaccatatcctcca

SEQ ID NO: 5390 - DNA, 376 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtggaggtggatatggcggaggagg

SEQ ID NO: 5391 - DNA, 303 bp, Cicer arietinum
ccggacaggtactaggttgacttactattgcgacactgtcatcagtagggtaaaactaacctgtctcacgacggtctaagcccagctcacgttccctattggtgggtgaacaatccaacacttggagaattctgcttcacaatgataggaagagccgacatcgaaggatcaaaaagcaacgtcgctatgaacgcttggctgccacaagccagttatccctgtggtaacttttctgacacctctagcttcaaattccgaaggactaagggatcgataggccacgctttcacggttcgtattcat

SEQ ID NO: 5392 - DNA, 391 bp, Cicer arietinum
gaaagaaattatgttattattgagtttgtgaaactagaacaaccaagccagtcaacaaacaaaataaaaaaggaaaagaaaaatctgaaatcataagtcttgttattttttttctactcgttatgcgactcttcttttatatgtacaacgcaaacggtgtttccacttgtcatcatctacctaggctgatgaatagcccgtgggctcactctgggcttaacaatcttcggagccttttccgcatacctaggaacttcagcccatccatcacatcctctccatttcaaatctcgcaacctcaccatttctttcccgtctcctccttcatcttcgtgttgtggctcgatttgatggaaaagatcatcttcatcgatctcgaaatcagagaagt

SEQ ID NO: 5393 - DNA, 172 bp, Cicer arietinum
  misc_feature (5)..(5): n is a, c, g, or t
gacgncgcatgctcccgtccgccatggcgaaagcgggaattcgattagcgtggtcgcggccgaggtacttcctgatctccttcagctgttaattttgcatagtgttctcagtcatcctgatccaatggatcctcaatcgacacaattgggtaatctgacacaaatgacttgt

SEQ ID NO: 5394 - DNA, 346 bp, Cicer arietinum
taggtacaaggagctaacgaccaagccaggcctacaatgctatttcatgctaagaaacttcccaacaccgatccatgcaatgctaaagtcgtaaagatgagtcattactgatcttgacttgtcgtgaaatctgagagctggataataaggtcgtcaagattccgagttgtggtgtgttgtcgcgtttactcgacgttgatgcggcgagactcgtgcttcttggccttgggaacaacaatgctcaggataccgtccttaaacttggcagagacgttgtcctggtcgacacgagtggggaagttgaagctgcgagagaactcgccgaaggtgcgctcggtgagccagt

SEQ ID NO: 5395 - DNA, 405 bp, Cicer arietinum
acacacttgacttacaatctcacacttccacaacaaaatgaaaagaagaagagagtatgacatttggcaaccaaattaagcacactaaatataataaaatgtgtcacaaaacgacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccact

SEQ ID NO: 5396 - DNA, 434 bp, Cicer arietinum
acttggaggaggaggattcatcactcatgaaaacatttaagggtgcaacaactggtttggttgctggcactttctggggttctgtggttgccacctggtatgatgttcctcgtgttgagagaagtgttgctcttccggggctgattagaactttaaagatgatgggtagctatggtgccacctttgctgccataggaggagtctacataggtgtggaacagttggtgcagaactacaggaacaagagggatcttgtaaatggcgccgttggtggatttgttgctggtgcaactattcttggttacagaggaaggagcatcccaaatgcaatttctgctggatcagcgctggcattcacatctgcagtccttgattttggaggtcagacaatgaaacatgatactggaaaggagtatgctgcatacactacaaag

SEQ ID NO: 5397 - DNA, 342 bp, Cicer arietinum
accattgttcgtcctttaataaaaatagtagcacccttgattttcttccttgttggtttttatcccaatgtatcttatatttgtagataatgtgagaatgatatcaatcatactacttcatctcgatgaacgcttcagatttaaacttcttctgtaatgcttttatagctgattcgatgcgtgcttggtcctttcctttgaagcttattattagagatccatatctggctttgcggtaacacccaatacatatgtctggaaattcaagacaaagctttgatagaggttgagcaacttcaacatctgataaattagttgtcatgtgctttgatatgtatggat

SEQ ID NO: 5398 - DNA, 422 bp, Cicer arietinum
actggtgataggaatgagatggctcaattgcctgagggcataactgaattactgcatcatggcaagttgactttacccttgatcaagtgccagaatgtaataattctcagtgcaacgaatgtttcggagctggaaaagcagtgggattgtttgattgaattagcaaagtctaatgacctactaacattgcttgatccatacatatcaaagcacatgacaactaatttatcagatgttgaagttgctcaacctctatcaaagctttgtcttgaatttccagacatatgtattgggtgttaccgcaaagccagatatggatctctaataataagcttcaaaggaaaggaccaagcacgcatcgaatcagctataaaagcattacagaagaagtttaaatctgaagcgttcatcgagatgaagta

SEQ ID NO: 5399 - DNA, 427 bp, Cicer arietinum
gtcaaacaatggcttgaagaccgacgattcttgatgggagagatgcaacaacttcgggataagcttgctacagctgaccgcactgcaaagtatgaagcacagttaaaagaaaaatatcaattacggcttaaagtgctacaggagagtttgagagaaacttctaacagtattaaccgcggaacttcagagggaagatgtgttagcaatgggccttctcggcgtcaatctcttggaggagctgataacatatccaaactgaactctaatgggtttctacctaagagaacatcatcctttcaactaaggtcttctgtgtcctccagcacagttttgaagcatgctaaaggtgcatctaagtcttttgatggtggctctaggtcactagaaaggagtaaaattctcctaaatggaaagcctccaagttccg

SEQ ID NO: 5400 - DNA, 426 bp, Cicer arietinum
accaagattgcttctgaaggactcaaacatcgtgtgtttgagatctcattggctgatcttcaaggtgatgaggataatgctttcaggaagattaggttgagggctgaagatgttcagggcaagaatgtcctcaccaacttttatggtatggatttcaccactgacaagctcaggtctttggtccgtaaatggcaaactctcattgaagctcatgtggatgttaagaccactgataattataccttgagaatgttctgcattggctttaccaagagacgcagtaaccaagtgaagagaacctgttatgctcaatccagccagatcagacagatccgcaggaagatgagggagatcatggttaaccaagcaacatcgtgtgatttgaaggagcttgttcgcaagtttatccctgagatgattggaaag

SEQ ID NO: 5401 - DNA, 381 bp, Cicer arietinum
accctagctgagcatacattcctcttccttggtgctggagaagcaggaactggtatagcagagctaattgctcttgagatgtcgaagcagactaagacacctatagaagagactcgcaagaagatatggcttgtagactcaaagggtttaattgttagttcacgcgcaaattcactgcaacacttcaagaagccttgggctcatgaacatgagcctgtcggcactctcatagatgccgttaaggtaatcaagcctacagttctcattggatcatcaggagtagggaaaacatttacaaaggaagtaattgaggctatgacatcaaacaatgaaaaacctctcattttggctctttccaatccaacctcacagtctgagtgt

SEQ ID NO: 5402 - DNA, 427 bp, Cicer arietinum
accaggatcaaatcaatgagaagatgcatgtgatacatgggattattcacccacagtatcaaaagattcatagcattgttttgagcataattccaaaacgtccaaacaaggacaagaaggtgcagtagtcttgttaggagcgcacagatggatgcttaacacattgaatacttgagcttttcgttttgttgggaagttgtagctgttttaattgataattagcagtatgctaattcttcaggagccaaatcgaaaaagagctttgatgtagatgattatactcttgtgaattttctgtataccccattggaaagttctttatgtctgataaatagttctgtgcccttgttgaggttcactttggattagattgccacaggagggggaaaaagaaaggacttgagaacttgaacgtgattttgttttt

SEQ ID NO: 5403 - DNA, 429 bp, Cicer arietinum
agctacttgttaataatatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttggggctaaattgattgcaggcccaaatggaggatccattgcaaagttgagtgtgaagtatcacaccaaagga

SEQ ID NO: 5404 - DNA, 435 bp, Cicer arietinum
atttcccatcctgtgagaactcaaattgcaacccgcacagtcacaaatgttgctaaggaagtagaaacctacgtgatgacagctagaatgcaaccagcaattgccattgaagtgaaccctccagcaataaccatcaaagctggtgcatcacgtaggtttaccgtgacacttactgttcggacagtgacaggaacatatagttttggagaggttttgatgaagggaagtagaggacacaaagtgaggatccctgttctggctaatggttattcaagatagcctagtttggtcagaaatatgcttgtaatattctttgtaacttgtgggaataaggtatgttgctagatttattattcattaatatatatgtgatgtaaaggtaaataggtgaaaggagagactcctagtttattccacattttaagttttgataac

SEQ ID NO: 5405 - DNA, 223 bp, Cicer arietinum
tttccttaccgtgggcgaaaccgaggtacacacttgacttacaagctcgcacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagttttttgaaaagaccatcac

SEQ ID NO: 5406 - DNA, 426 bp, Cicer arietinum
gtcaaacaatggcttgaagaccgacgattcttgatgggagagatgcaacaacttcgggataagcttgctacagctgaccgcactgcaaagtatgaagcacagttaaaagaaaaatatcaattacggcttaaagtgctacaggagagtttgagagaaacttctaacagtattaaccgcggaacttcagagggaagatgtgttagcaatgggccttctcggcgtcaatctcttggaggagctgataacatatccaaactgaactctaatgggtttctacctaagagaacatcatcctttcaactaaggtcttctgtgtcctccagcacagttttgaagcatgctaaaggtgcatctaagtcttttgatggtggctctaggtcactagaaaggagtaaaattctcctaaatggaaagcctccaagttcc

SEQ ID NO: 5407 - DNA, 423 bp, Cicer arietinum
actgagctgaacaagaaaatttacaagcttggcaagtctggagaagagacccatgatgcccaaactgattatgataggactgagaaagacatcaccccaatgggtggattcccccactatggtgttgtgaaggaggattatctgatgatcaagggaggtgttgttggtcccaagaaaagggttattactttgcgtcagtctctactcaagcagacttctcgcaatgccttggaggatatcaaacttaagtttatcgatacctcttcaaagtttgggcatggtcgcttccagacaacacaagagaaacagaagttctatggacgcctcaaagcttagttatggctgctgctttgaaatgttggaaatcgttatttatgttatttttgttgccatccttttaaactctgttgtggtgtcttccgt

SEQ ID NO: 5408 - DNA, 270 bp, Cicer arietinum
gtggaaaatgcacaggagttttcaaccccagttggaacgttcatttcttcagtcctgaaaaagtgaaggaactcaagcaaaatcataaaaatgtgaaggttgtaataagcatcggtggtcgtggtgataaacatccattcaatcctgcttcaaaagtagaatggcctgacaatgctgtaaactcactcaaaaagatcatccagcaatacaacgaagtcaaggatccttggagctttaacataatagatggcattgatatcaactatgagt

SEQ ID NO: 5409 - DNA, 431 bp, Cicer arietinum
acaaaatgtgagattaccatgactgagtcactgaccatactagttaagttactactagtaaataacccaaccaacaataatgcttatcaaaatgtgatatgtgataagtgactcaatttatttccttaaaaagatttgtatttatttattatgtagacacactatttggaacccctctgcatgtaacaccaggttcagaactaggagcaagcaactcataaggtaaaacaccagcaccacaacggttcttcaaattcctatcagagttcctactatcaataaccttctcaatctttccaatttcagcagagaattcataaaacttctcaacaatctcagcatcacctgaccaaatagaaggctgttgcctctcacccaaatactcttcgtcgggcgaatgagtcgaaagtgtatcgacaacagccatatat

SEQ ID NO: 5410 - DNA, 430 bp, Cicer arietinum
acaagctttttacacacactcttgagaaagagggagtttcttattccttctagaaacaaaaacgcttctttcggaaacggagatttagggttttcatttatcggcgatcgaaaaaagcgagatttgaaattgtgagaagaaatggcagagcatcacgaacacgacgaatcaaagggtgaatctttgttagacaagatttcagggaaaatccacgaccacgattcttcgtcttcatcggattccgataacgagaaaaagaatccatccccttctactctcaagtcaaaggttttcaggcttttcggaagggaaaaaccacttcacaatgttcttggtggaggaaaacctgctgatgtttttttatggagaaataagaagatatcagcaacggtgcttggagtggccacagcttcatggattctgtttgaat

SEQ ID NO: 5411 - DNA, 394 bp, Cicer arietinum
aagatcaggagcgatccgagacagaactactctttcatcatgttggtttaccaggatctccttaccggtgatgagcttctctcagactctttcccatacaaagaacttgcgaatggagtcttgtgggaagttgaggggaagtgggttgtgaaaggagcagttgatgtagacattggtgcaaacccttctgctgaaggtggagaagatgagagtgttgatgaccaagctgttaaggttgttgacattgttgacacattcagacttcaggaacaacctgcttttgacaagaagcagtttcttgtctttattaagaggtatattaagttgttgacacccaaacttaatgaagaacaacaggaggtgtttaaaaagaacattgaagcagcaactaagt

SEQ ID NO: 5412 - DNA, 429 bp, Cicer arietinum
acttggtcttcggtttcttggtcctcttgcaattatcagaatttggagtttctgtttgttctatgttatggctgaattgtgggggagtgtggtggtttctgtcctgttttggggttttgctaatcagataactactatcgatgaagcaaaacgtttctacccactgtttggacttggggccaacgtagcccttatattctctggtcggaccgtgaaatacttttctaatatgaggaagaatttaggtcccggagtcgatggttgggccgtctctctaaaaggaatgatgagcatagttgttcttatgggttttgcaatctgtttcctctactggtggacgaacacttatgttcctcttcctacacgtagcaagaagaaggagaagcctaaaatgggaacaatggagagcttgaaattcttggtgtcttc

SEQ ID NO: 5413 - DNA, 434 bp, Cicer arietinum; identical to SEQ ID NO: 3886

SEQ ID NO: 5414 - DNA, 293 bp, Cicer arietinum
actgggttgaattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 5415 - DNA, 293 bp, Cicer arietinum
actaggttgaattactattgcgacactgtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggacttaaggatcgataggccacgctttcacggttcgtattcgt

SEQ ID NO: 5416 - DNA, 377 bp, Cicer arietinum
  misc_feature (271)..(271): n is a, c, g, or t
actcttgcttcacttgctgcaaacatctgaggcaagcatctatgttttgttcctcgcagaagttgcgaaaagcaatgcaggagtttttcaccctctgtgcacctatgcttgcactgctacccttaaattggtgaacatgagcatcaacttttttgaagtcgacactttgctgatccaaagaaaaggagagatctttgagaatcctctcagaatcttctaagaaaagagaaaccacttcaacaacaaactcagggttattctcatcttgtanctgctgaagttgcagaaattgaccatccaaaaactcctcggtgaacaaggatttgatgtagtccacccattgtctccgcatctgacccacctccatgtttctttgt

SEQ ID NO: 5417 - DNA, 164 bp, Cicer arietinum
ccatcacatgtgccatacccagctgctcttccaccgtatccttccccaccccacatgtatggcagcagaagtccaccctatgcttattcaccagagcaagcaccagctattgcggggtcatacccagcggcacccatgaattatcctgcgtatggtggctatgg

SEQ ID NO: 5418 - DNA, 436 bp, Cicer arietinum
gagaaatttattcgagggacaaaggtgagaaaattggaaggtcctgaatatgtaagaaaggtatcagaaaattgtattgctcatatgaaagctcaagggacatatggtgatgctgaagaaaaagccattcaagaatttagagaagcttacaaggatcaaacttttccaccaggcgctactgttttctacagacaatcaccaaatggaacattagggcttagtttctcgaaagatgagacaatacccgaacatgagtatgcggtttttaacaacaagccactttcagaggcagttttggagaccatgattggcgaaattcctgtttcacctgctttgaaagagagtttggctacaagactttatgagtttatgaagaatgacaatttcaccattggaaattgaaaattgaaaggagttgtttatgatctttaaggca

SEQ ID NO: 5419 - DNA, 366 bp, Cicer arietinum
ccgaaacctgctatcaaattgctttggctatcaaggatgaagtagaagaccttgagaagggtggtattggtgttatccaaattgatgaggctgccttgagagaggggctaccactaaggaagtcagagcatgctcactacttggactgggctgttcactccttcagaatcaccaatgttggtgttcaggattccactcagatccacactcacatgtgctactctaacttcaacgacatcattcattccatcattgacatggatgctgatgttatcaccattgagaactcccgttctgatgaaaagcttctgtcagtcttccgtgaaggagtgaagtatggtgctggaattggccctggtgtgtact

SEQ ID NO: 5420 - DNA, 391 bp, Cicer arietinum
accgcctgtttccccttcccgacggcaatccttctctgtccattgaagtcatgagcaccatgggctgggagcgttacactcacgagcagttcggtatcaaccgattcggtgcttctggtgcctacaaggacgtctacaagaagttcgagttcacccctgagggcattgccaagcgcgccgtcgccaccatcgacttctggaaggacgtcccctatatccgatcccccatcaaccgtgctttccagcagatcatctagatcgaaagataatagcgagtaaaaagaaacgaaggataagaataaaaactccgggaggataccagcccggacagaatgattatgcaagtgacgacgatggactttggagcaaggttttgtggatttatagcaac

SEQ ID NO: 5421 - DNA, 433 bp, Cicer arietinum
acctcagacgatgaaaccggcgctacccttcaaacaacacaggcagaaaccagccaccagtagttcaccagttacagaaagctcatattttccaccatagatgttaaaacagtgagtaaaatgctacataattttataataactacacaccaccactataaagtagggagataaaaaaattacaaaaatagataataaaaaaaaaagataacagaagtgaaagtcaggctttttagtcatgtatggccttgtgtaggcaaaggttaagtagtggtagtatatatatatatatatcaacaattaggatgcatggacgaaggtgtttatctcattcatgaggcaatagaaatgatcgttgttaggcaagaagtagaaaccaatagtggcttcctttaggtaaagaagtttgacatcttgtcctgaattttttaga

SEQ ID NO: 5422 - DNA, 423 bp, Cicer arietinum
agcgaccgcccgggcaggtacaggataccccgcttccttcaccatccagcataccaaggcacaaaaggcgctgtattttctcgagcccgtcacccgtcagcgggttcgggggcatactgtcgactttttccaccgaccagaattctctcacgcatcgctacatctgctgacgcagtccacaatctccagtaaccaagttgtagctcgtagtcgtatgtcgtggcggcagggaaaaaccttgggaaggaatcagaggccggcggtgcggcttgccttcaaaggggaaaaacccatcgcaatcggcgtcgttgatcggaaggatgtcgctaccgatgccacgggcaccgtcctccgatatctaaggcgttctggttctgaggtgccgccattagatccgacaaaagtgttgtcagagaaggtgaa

SEQ ID NO: 5423 - DNA, 315 bp, Cicer arietinum
acattcatgagaattgatggagaaccatggaaacaacctctcccacaagatgacgacgcagttgttgttgagatatctcaccatggtcaagtgagcatgcttgccaccccattatgccgttctaaaagtatgcatgatccttcctcaaattcgacagaccacgaagatgatagtagtgatgatgaagatgatagtagcgaagaacgtcggaagtttggtgcagccgagacattcaaatatcctgaaggagttgatctgtctcgtttaagttagtgtagctagcattgctcaatctatggcggggaaagaatgaga

SEQ ID NO: 5424 - DNA, 197 bp, Cicer arietinum
  misc_feature (137)..(137): n is a, c, g, or t
acagatgaaaggagtgtagccattccagcagtagccaaattgactccaggacacattctccctccagacccaaatggtagaagttgaaaatgttgacccctaagatcaattgaacctgcatcaccttcacctgcatnttccaagaacctctctggacggaattccaatggtttatcccagtattttggatctcttcc

SEQ ID NO: 5425 - DNA, 432 bp, Cicer arietinum
gctagctacttgttaataatatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaagga

SEQ ID NO: 5426 - DNA, 329 bp, Cicer arietinum
acttttcgttttccacatgagcagcaaaagttggggtttatcaacggtggaatcttaactcacggatagggggtcgaagtcactgtcaccttggagaataagtcgatgacttagtctctaataagctgggagcgagggaggatttatgatgggcttaccatacagaaccgaatgaccctaccgttgacacccagatgaccggtccaacgcacgcggttatcaagtatagggttgctcattgtcaatgaaggaaaagatggctgttggcttctcaggaaacaacagaactctacttagaatgtatgtcgagtaatcatgcgaaggttttt

SEQ ID NO: 5427 - DNA, 381 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtggaggtggatatggcggaggaggtggtg

SEQ ID NO: 5428 - DNA, 163 bp, Cicer arietinum
gttgatatttccactggaatgacgagacgtctcgagagaacattcaagagtttggatgtattctttcaaagtgttgtcgatgaacatcttgatccagagaggaagaagttgcctccaaatgaaatggatgtaattgattcattgattcaattgaagaatgatc

SEQ ID NO: 5429 - DNA, 196 bp, Cicer arietinum
acgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtggaggtggata

SEQ ID NO: 5430 - DNA, 449 bp, Cicer arietinum
gatttcgagcgggccgcccgggcaggtacgaattggcttacacagaagccaagggaaggatcaagaaaggagatagaacatggcaaatagcattcggttctggattcaagtgcaacagtgcagtatggaaggctctcaggacaatcaatcctgcgaaagagaagaacccttggattgatgagatccaccattttccggttgatgttccaaggatttctgccatttaaatgttgcagtttaagattgttattttgtatgtatcatcaacattaggtggtagctgttgaactggtggacgcggaccagtgttaggtcggtcatgcttgaaggttaggttttgttaattcgatttagccacaggtctcgtgcatgagctttggagtgctgagttttgcagaaatttattgtcttgtggtagtgatgtgtgttagagcatctgaaatgtaatc

SEQ ID NO: 5431 - DNA, 212 bp, Cicer arietinum
accgtggtagacacagggattatcgtcgcagaagcagaagcagaagccgtagtgccagtcctgattacaagggtcgtggaagagggcgttatgatgatgagcgtcgcagtagaagccgaagcagatcagtggacagccgctcccctgcacgacgcagtccaagtcctagaaagagcccttctcctaagaggagtatttcccctcaaaggagt

SEQ ID NO: 5432 - DNA, 432 bp, Cicer arietinum
atagaaggcacaatcagatcacaaaatttaacagcaaacacattatatgcagcttatcttgtaatgaaagtctctgatggagcgtatggacttgactcaggtccttcagatgtaacaattgagatgggaaacaaagtgaaaagagggaaagcatatttgtgcaataaagatgagaacaagtgtaatatggagacactattttatgggaatagaagaaacagagtggttcaagcacaagaagatagagggaatattcatgtgccagctaagagattagatggctggatggagattgagattggagagttttttagtggtgagagtgatgaagagattaagatgactcttacagaacttggttatcagttgaagggagggcttattgttgaaggcattgaagtgagaccaaaatgagatgcatattatataaaa

SEQ ID NO: 5433 - DNA, 424 bp, Cicer arietinum
atcaacgccgtcaccatgccgagccacaagtctttccgaaccaagcagaagcttgccaaggcccagaagcagaaccgccctgtgcctcaatggattcgcctccgaactggtaacaccatccgctacaacgctaagcgaaggcattggcgcaagacccgcatcggtatctaaaccgatggtcctcaactgttacccgcccccgagcccagcacccgacttttctctcttgggcatggtatcacgatgattgatgtgaacggaaaaggggaggaacgatattgttgtggcgtgaattgaactacggggccgtgtctgcactgcactgcgcgtgcgcacgggggcgatgggccggttgcctggtttatcgattattgcggttactgcatgtcacggacggtcatagggaaaaaggaatgcaaagact

SEQ ID NO: 5434 - DNA, 79 bp, Cicer arietinum
accgtaactaatatacatgatgcatcgcaaatcaaccttaaactcggcttgtgctaacgtcaaagatatcattcttcca

SEQ ID NO: 5435 - DNA, 327 bp, Cicer arietinum
acccattttggaggtggcaaatcaaccggttttggtttgatttacgatacagttgagaatgctaagaagtatgagcccaaatacagacttatcaggaatggtcttgacaccaaaatagagaagtcaaggaagcaaatgaaggagagaaagaatagggccaagaagatccgtggtgtaaagaagaccaaggcctctgatgctgccaaggctggaaaaaagaaatgagtttttagttgtcgtgtttgtgctttaaggttgttttgctttccaagtttttttgatagctatgttatctcatgcatggtctacaaaatgagatattttggt

SEQ ID NO: 5436 - DNA, 426 bp, Cicer arietinum
acattattgtcgttcaggtctaaccagactaaatggaaatattggccaaaaatggctaattagctaatgagccttgcagaatggtgacagcagccctaacaagccatcgccgtgccatgtcaaatttactttgatggctctcggctctcagctgtaggaagagcgttcttcttggcctcattctccttgaccttggcccaagcataaacgatacccgagacgaaaccgatgaagatggctgaaacacttccaacggtaacgggagcagcgaagaagacaagaccagagacggcgatgggcagcttgttgagagcaccgaccatggagtaggtggtggaagaggtgactcggatgcaccaggcggagcagtaagaaatgaagatagcggccagaccagagtagatgatgccgatgaagatacggttg

SEQ ID NO: 5437 - DNA, 321 bp, Cicer arietinum
ccgggcattcgtagcgacatccttccgatcaacgacgccgattgaggtgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgccttggtatgctggatggtgaaggaagcggggtatcctgt

SEQ ID NO: 5438 - DNA, 427 bp, Cicer arietinum
  misc_feature (344)..(344): n is a, c, g, or t
gctagctacttgttaataatatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaatccattttcgtcgaagagggagaaaccaagtttgtgttgcacaaagtggacgcaatagatgatgctaattgggcttaccactacagcatagttggaggtgctgggcttccagacacagntgagaagatctcatttgaggctaaattgattgcaggcccaaatggaggatccattgcaaagttgagtgtgaagtatcacacca

SEQ ID NO: 5439 - DNA, 369 bp, Cicer arietinum
gaaattgagaaggcagactctgttttgcagaaggcaatacagcagaataagatgaagccattatttactacttatatgactattatggagcagtatgcaaagaggggtgatgtccataatacagagaagattttctatagattgagacaatctggttatgcttctagaatatctcctttccatgctctaacacaggcttatttaaacgccaaactgccggcatatggaatcagggacaggatgaaagctgatgatctatttcccaacaaagctttggctgaacagttggctctattagatccatttaagaaaactccagtttcagatttgcttgattgaggaaactagcatattctatcttgtgcttgt

SEQ ID NO: 5440 - DNA, 410 bp, Cicer arietinum
accaattgtaactggagagcttatgcaagtcctgaggtgaggatatgatttatttattttacttatctctatctgaacatgatggcttttgctagtgtcaacgctaacatctgcagcagcacaggtatgagaagaatcagttttatagaccccatcacgactatttttctgatactttcaacttgaagcgtggtgggcagcgaatagctactttgcttatgtatttaggtgacaatgttgagggaggagaaacacatttcccactggctggttcaggtgaatgtagctgtggtgggcaattagagaaagggatatgcgtgaaaccagttaaaggaaacgcggtgcttttctggagtatgggactggatggacagtcagatccggatagtgtgcatgcacgatgcccagta

SEQ ID NO: 5441 - DNA, 430 bp, Cicer arietinum
cagacaagccactcacatcaagcaaagattcagaaaaagtcacgccgccaagacggctaaggacagatgaaattccacagattgtcaatgatttcagacttgctgcaagaaatgctattgaagctggttttgatggggttgaaatccatggagctcatggctacctacttgaccaattcatgaaagataaagtgaatgacagaacagatgaatatggaggatccattgagaaccgttgtcgatttgctttggaagttgttgaagcagttgtaaatgagataggagcagaaagagttggaattagattatcaccttttgcagaatatgcagaaagtcgtgactctaatccaaatgcattgggactttatattgttaatgccctcaataaatacaatattctttactgtcacatggtggaaccaagaataaa

SEQ ID NO: 5442 - DNA, 296 bp, Cicer arietinum
acgaaatcctcaagggtttggtggcgtgtccaaatgtttatgaaagaaatttgttagcggacacaactaagatcattgagaagaacaaaacattgtgtaaacgcaaagataataattgcagaaagattgttactgatggattattggctcttggttacgaggcttcaatttgcaaatctcgctgggaaaaatccactttctgtctcgccggggaatatgaatacattgatgtgataatgggaaaggagagggtgatagttgacgttgacttcagatcagaatttgagattgctaga

SEQ ID NO: 5443 - DNA, 378 bp, Cicer arietinum
gagaaaataaagaaagaaaaaaagaagaaaagatagagagactaataaagagacaaattcaaagaagaagaagaagggtttcgttgaaaaacacgatgcagagtgaaagcaacaacaataaccagttggtagttcagaattctggaagtttaagcttcagtagtcacttgtctaaggaagatgaagagatgtcaaaatctgctctttcaactttcagagctaaagaagaagaaattgaaaagaagaagatggaagtcagagaaaaggttcagcttcagttgggtcgtgttgaagaagaaaccaaacgtcttgctaccattcgtgaggagcttgaagcccttgcagatccaatgaggaaagatgtttcaattgtccgaa

SEQ ID NO: 5444 - DNA, 246 bp, Cicer arietinum
acgagctgtggtcgccagccagctaacaccaagctatcaagcaacaaaactgttagacgcattcgtgttagaggtggcaatgtgaagtggagagctctcagattggatactggaaatttctcatggggaagtgaagctgtcactcgtaaaacccgtttgctcgatgtggtttacaatgcttccaacaatgagcttgtgcgaactcagacccttgtgaagagtgctatcgtgcaggttgatgctgct

SEQ ID NO: 5445 - DNA, 258 bp, Cicer arietinum
ggcattccacgttcaggagggagcatgatgacctctatattgatcacaatctgagcttaactgaggctctatgtggcttccagtttactgtcacacatcttgatgggaggcaactattggtcaaatcaaaccctggggaagtcatcaagccaggtcaacataaagctataaatgatgaggggatgccacaacacaataggcctttcatgatgggacgtctttacataaagtttagtgttgatttcccagactcaggtt

SEQ ID NO: 5446 - DNA, 367 bp, Cicer arietinum
gatttcgagcgccgcccgggcaggtacacacgtttaccgagagtgttgaagaagttgacgaacaaaacaaaaaaatcacttacaagctattcggtggagatattgatgagcactataaggtctttaaactcatcctccaagtatttgataagagtgatggaagtggtgctgttaaatggactattgaatatgagaagatcaatgaggatatctatcctccaaatggctggatggattaccttatcaaatgcactagagacttggatggtaatcttgtcgaggcataggtccataataatttagatatgtagtataataactaattatatagatatgttcatctatataattagtgtgatgtttgtaa

SEQ ID NO: 5447 - DNA, 325 bp, Cicer arietinum
agggaattcgattcacggccgcccgggcaggtactaggttgaattaccattgcgacactgtcatcagtagggtaaaactaacctgtctcacgacggtctaagcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaatttttctggcacctctagcttcaaattccgaaggactaaaggatcgataggccacgctttcacggttcgtattcgt

SEQ ID NO: 5448 - DNA, 185 bp, Cicer arietinum
gttttacgtttggcggtgatgtcacggtggatctcgccgcgtcggggatactttatgtggcgagtgtgaagcaagtttgtttagcatttgcggctaatggagatgatagtgatttgactatctttgggaatgtgcaacaaagaaccttagaggttgtttatgatgttggtggtgggaaaattggg

SEQ ID NO: 5449 - DNA, 315 bp, Cicer arietinum
aacagttaagcagcgtgcttttttgacaatggaggagctgaagcaggttcctgacgatactaatgtttacaaatctattgggaaaacgtttgtattggagacgaaggcaacgctaatgaatgaaaaggagaacaagtttaaggatagtgaagcttcaattacctcattacaaagctcaagagaatacttggagaagcagatttcagaggtgtaaaacaatttgagagagctgttacaacaagatcctggtcttgctcgtcaaattatgtcgatgaatgtgtaaattgactggcagtggaggattttcaagtgcat

SEQ ID NO: 5450 - DNA, 166 bp, Cicer arietinum
acaaatcgagcaaaagtctttactctgctcggtcaatcgcagctgctttccttgctaaaatccaatggtcccttgccatagttcgctccaagattcattctttcagagacctcaatgcgattctggtatatacaaatttctgcgaatattttttctcatttcatga

SEQ ID NO: 5451 - DNA, 427 bp, Cicer arietinum
cacactcttgagaaagagggagtttcttattccttctagaaacaaaaacgcttctttcggaaacggagatttagggttttcatttatcggcgatcgaaaaaagcgagatttgaaattgtgagaagaaatggcagagcatcacgaacacgacgaatcaaagggtgaatctttgttagacaagatttcagggaaaatccacgaccacgattcttcgtcttcatcggattccgataacgagaaaaagaatccatccccttctactctcaagtcaaaggttttcaggcttttcggaagggaaaaaccacttcacaatgttcttggtggaggaaaacctgctgatgtttttttatggagaaataagaagatatcagcaacggtgcttggagtggccacagcttcatggattctgtttgaattacttgaatac

SEQ ID NO: 5452 - DNA, 437 bp, Cicer arietinum
cacactcttgagaaagagggagtttcttattccttctagaaacaaaaacgcttctttcggaaacggagatttagggttttcatttatcggcgatcgaaaaaagcgagatttgaaattgtgagaagaaatggcagagcatcacgaacacgacgaatcaaagggtgaatctttgttagacaagatttcagggaaaatccacgaccacgattcttcgtcttcatcggattccgataacgagaaaaagaatccatccccttctactctcaagtcaaaggttttcaggcttttcggaagggaaaaaccacttcacaatgttcttggtggaggaaaacctgctgatgtttttttatggagaaataagaagatatcagcaacggtgcttggagtggccacagcttcatggattctgtttgaattacttgaataccatctcttga

SEQ ID NO: 5453 - DNA, 236 bp, Cicer arietinum
ggccaccttacctgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggag

SEQ ID NO: 5454 - DNA, 186 bp, Cicer arietinum
actgtgttgaccatcttgaggagataagcaagcttgcaaaggtcaaagctcaggtttctgaagtcaaaggtgtcatgatggagaatattgaaaaggtcctggacaggggggaaaagatagagcttctggtcgacaaaactgagaaccttcatcaccaggcacaagacttcaggaattcggggacca

SEQ ID NO: 5455 - DNA, 413 bp, Cicer arietinum
acaacaatcctttgatttacatcaccgaaaatggtgtcgatgaattcaacgatccaacactatcattagaagaagctcttttagacacttttagaattgactattattatcgtcatcttttttatattcgatctgcaatcaggaacggcgtaaatataaaaggatattttgcatggtcattgttggacaattttgaatgggcatcaggctatacagtgcgttttggaatcaattttgtagatcacaaaaatggtctcaaaagatatccaaagttgtctgcaaaatggttcaagagttttctcaaaagagattagactttatatatatgcttgatatgtttccaataaatagtttaataaaacgtatcaagcaaatgtaacttaatggatttgtggtggttcattcttaaacaa

SEQ ID NO: 5456 - DNA, 181 bp, Cicer arietinum
gttttacgtttggccgtgatgtcacggtggatctcgccgcgtcggggatactttatgtggcgagtgtgaagcaagtttgtttagcatttgcggctaatggagatgatagtgatttgactatctttgggaatgtgcaacaaagaaccttagaggttgtttatgatgttggtggtgggaaaat

SEQ ID NO: 5457 - DNA, 352 bp, Cicer arietinum
accttccaaacatgcaaggatcagtcgtggatcgataaacatatcccccggtaatcgatgctgatccttcattcttgtttatttgagaatgggtgtatcccagtatggggggaattggatttatggatttaagagaggtattgcctccaggtgactctgtaggagtgactggatagggtccctcataaacacgccacccatagtttccaccttttgtaatgagatcaacctcttcataaagatcctgtccaacatctccacagaaaaagtaggaaggtttttctgcatcaaaactgcatctccgaggatttcttaatcccaaggcccatatttcaggctgaagatctttatc

SEQ ID NO: 5458 - DNA, 404 bp, Cicer arietinum
actgcatatgttccttcaatttaggcccaaattctttgttaaggctgttaggagcagctgtagatgccttcccaccgccatatttcacaacaaaatcatctttcacacgctccagaaaagccacaggaacctgtcttccaactgattcatccgcaacaacacaatacgtgtatccattatcgacgaggtaattgaaggtgtggccatcacagttgtaagtgaatttgttgtttgaagctggaagcttctgaaggcactgaaacgcgatcgaattaaaattaccgctgaattcggtgaattcagcaagaatcacgcttcctcgagaaacgaaagcgtagatcagagatttttggttctggttgtgtcccatcttgttctccacagatctatcgaacaacgacctg

SEQ ID NO: 5459 - DNA, 421 bp, Cicer arietinum
actctaactattggtgtgatggtgatggttcatggtgatgacaagggattggtgctgcctcctaaagtagcatcagttcaagttattgtgattcctgtgccttacaaagatgctgatactcaaggaatctttgatgcctgttctgcaacagtgagtatgttgtgtgaagcaggaatccgtgctgagtcagattcaagagataactattctcctggatggaagtattctcagtgggaaatgaaaggtgttcctctaaggattgaaattgggccaaaggatttagcaaataagcaggttcgtgctgttcgacgtgatactggagcaaagatagacattgctaatgctggcttggtctaggaaataaaaaagctgctcgatagtattcaacagaatctgtttgacgttgcaacacaaaaacgag

SEQ ID NO: 5460 - DNA, 439 bp, Cicer arietinum
gatttcgagcgggccgcccgggcaggtacttagttccaacatcaggagaagtgagatccagctccttctcctctctttcatcatccgacatagtggattggttattatgaatagcgtgaaggttgttttggattattgaagaagaatcggtggaagaagaggaaagttggaaggttgctgctgcttatgattgtaaaattgtcgagggtgtgcttagccaccaaatgaagcagtttgtgattgatgcgaataaggttgtcctaagtgtatctaatcctgacacaagggttgacgatgccgagttcgaggagaacgaagtttatgcaattgatattgtagccagcactggtgaaggcaagcctaagctgttggatgagaagcaaacaactatttataagagagccgttgatagaagctatcacttgaagatgagagcatc

SEQ ID NO: 5461 - DNA, 365 bp, Cicer arietinum
caagattctccaatcctgaaagaaagaaacgaagtttgacactcactgatcaaatgagtcgccatccggaagttctgtgggcgcagcggtctgacaaggtttacctgactgttgctctacctgatgccaaggatgttactgtgaagtgtgagcctcatggtttgtttagtttctctgcttctagggttcaacatgaatcttacagctttagtttggaactttatggatcaattgaacctgggggttgtaaaactaaaactagctcaagaaacatactatgctcaatccagagaggacaaagaggttggtggaaaaggctactgaagtctgaagagaaacctgcaccatacctgaaggttgattgg

SEQ ID NO: 5462 - DNA, 380 bp, Cicer arietinum
caagaatctaccaatcctgaaagaaagaaacgaagtttgacactcactgatcaaatgagtcgccatccggaagttctgtgggcgcagcggtctgacaaggtttacctgactgttgctctacctgatgccaaggatgttactgtgaagtgtgagcctcatggtttgtttagtttctctgcttctagggttcaacatgaatcttacagctttagtttggaactttatggatcaattgaacctgggggttgtaaaactaaaactagctcaagaaacatactatgctcaatccagaaaggacaaagaggttggtggaaaaggctactgaagtctgaagagaaacctgcaccatacctgaaggttgattggaataaatggtgtga

SEQ ID NO: 5463 - DNA, 104 bp, Cicer arietinum
actgattgatcgattgatgaattttggcttgaattttagggaatggcttttggttgcttcttggtgttagttgactgtgtaacaacccctgtttggcttgtgtc

SEQ ID NO: 5464 - DNA, 240 bp, Cicer arietinum
accttttctaaacaaccaagcaatgagaatctattccagcctgtggaatgcagatgattgggccactagaggtggattggtgaaaactgattggtccaaagcaccctttacagcttactaccgaaacttcaaagccactcaattctcatccaactcttattcaaattctaataatgctgaatgggaaataaatgaacttgatgcttatggcaggagaagattgagatgggttcaaaagta

SEQ ID NO: 5465 - DNA, 452 bp, Cicer arietinum
acaataggattaatatattgttctattataaatcccataactccagtaaatattatcagcttgacaagttgacgtaacacccaaccctttcgaataaaaggggtgcgaggatatcttggctggtaacataatgtaggagcaaccataaagtaagccaggcttttgaagctcacatcgtatggatagtccatattcacagtattgggaagcacttctcccttttcaattgaattggtaactgctctcaaatcatagtttgtatgagcataagaaaccagttttaaccatacaatgcaagcaagtagcattagtgtgacgcctgatataaaagcagaatcgcaccggaggattactaaaataggatagagaatggaagctgttgtaatgattatatgaagtagaacaacaattggttcatagatacgcttttgctgtgccaacttttccactat

SEQ ID NO: 5466 - DNA, 409 bp, Cicer arietinum
actgccaaattcgtccctctgccttccttggatttattgttccagcaaggtccggaataactaaatcataacttgagttaatgtgaagaattcgatttaccatttcattgtctgacaaatggaactgctgaatgtgatttgccccttcaacatctgacatagggaactgctcatgattttcattgtgtggttgaaccggttgaagatgaatgcgactgtcatacaaagatgcttcctctagagaaaagggggattccagaaatgtagcattggacgtccagaaaaccggcgcgtaagtagaaaagcgttcaggaggatccccaaggcgtcggcacgcaatgcccccaatgtcatcataagccacaaggtaaaatgctaaactcatgtctgcacaaattcccttccacaa

SEQ ID NO: 5467 - DNA, 295 bp, Cicer arietinum
aaccgttttttcgcacaattggtcatcgcgcttggttgaaaagccagtggcgcgaagctaccgtgcgttggattatgactgaacgcctctaagtcagaatccgggctagaagcgatgcgtgtgcccgtcgttcgcttgccgaccagcagtagggggccttggccccccagaggcacgtgtcgttggtggacctcgtaaggcggatgagccttgtttttgacaccttgaaacgcaattcctattgagcggcgggtagaatcttttgcagacgaatcgaagcgactagggctgaatc

SEQ ID NO: 5468 - DNA, 212 bp, Cicer arietinum
gtaccatgatgaacttattgccaatgctgcctacatcggcacacccggaaagggtattcttgctgctgatgagtcaactggaacaatcggtaagcgtctagccagcatcaatgtcgagaacgtcgaaaccaacaggcgtgctcttcgtgagcttcttttcactgcccccaatgtccttcagtatctcagtggagttattctctttgaggaga

SEQ ID NO: 5469 - DNA, 312 bp, Cicer arietinum; identical to SEQ ID NO: 5024

SEQ ID NO: 5470 - DNA, 171 bp, Cicer arietinum
acctaccatgttgccatggctatggataaacaacacttgagtaacaagcatacataattaccaactacataaataacatgattgtggtagttttctgatcctatatggagatagttttgccagaaccagaagctaaattcacaacttcatgattatatatttacacaaatt

SEQ ID NO: 5471 - DNA, 397 bp, Cicer arietinum
actgtaagagttactttcctctagccttttccaagtcagggagatataacattccttcatcatcactgctttcatcatcttcaccagcaaatcgtccatcgtcgtcagatatcaactcataatctgactcttcatcttcatcacaccatttattccaatcaaccttcaggtatggtgcaggtttctcttcagacttcagtagccttttccaccaacctctttgtcctttctggattgagcatagtatgtttcttgagctagttttagttttacaacccccaggttcaattgatccataaagttccaaactaaagctgtaagattcatgttgaaccctagaagcagagaaactaaacaaaccatgaggctcacacttcacagtaacatccttggcatc

SEQ ID NO: 5472 - DNA, 238 bp, Cicer arietinum
caagaatctaaaatcctgaaagaaagaaacgaagtttgacactcactgatcaaatgagtcgccatccggaagttctgtgggcgcagcggtctgacaaggtttacctgactgttgctctacctgatgccaaggatgttactgtgaagtgtgagcctcatggtttgtttagtttctctgcttctagggttcaacatgaatcttacagctttagtttggaactttatggatcaattgaacc

SEQ ID NO: 5473 - DNA, 201 bp, Cicer arietinum
acaccgaattacactggtatggtggaggattgttgttgtgattatgaaactgtggacaatcttaacaaggaagtattgtatccgtctctccaagagcttgtgaaaaccccattctttcggtattttaaggtcaagctatggtgcgactgccctttttggcctgatgatggtatgtgccggttgcgggactgtagtgtatgt

SEQ ID NO: 5474 - DNA, 336 bp, Cicer arietinum
actagagatgcccacgttggaaattccatatagtgagtgtgacaatgttgcaaaaatatacaagaaagtttcttctggtttgagacctgctgcattgaacaaagtcaaagattcagaggtaaaggctttcattgaaaagtgtcttgctcaaccaagggctagaccttctgctgatgaacttctcaaagatcctttctttgatgaggttatcgattatgatgacgacgaaaatgagtatgaatctgttggttcatactaaaacagtccttaatatgataaattatgtggatgacttagtttaatttttttaatttgatttgcttactttttttttag

SEQ ID NO: 5475 - DNA, 225 bp, Cicer arietinum
acaaaatgacaacatccccaattaatccctcccctccccaatattcagccatatccaaagggaaaaattcaaaacaaatcacataatcaatagcctcccccagattgcaaattgacataaaaactaaaaaaaaagtaagcaaatcaaattaaaaaaattaaactaagtcatccacataatttatcatattaaggactgttttagtatgaaccaacagattcatac

SEQ ID NO: 5476 - DNA, 200 bp, Cicer arietinum
aatgggccttcccaacttattagtaggctttcagaaaaggaaaatttaaatgggccatatagtttggttttggagcccaaagggttggctttgtattacaaaagtcaaaattcacctaggccaattctttattggttttcatctgattggttttcaattgaaaaggggtcattggaaaatgtcacactcaaatctgattt

SEQ ID NO: 5477 - DNA, 460 bp, Cicer arietinum
tgcttgcttcttgcccttatgatgggcgagtcattctatggaaggagggtaaccaaaacgaatgggttcaagctcatgtctttgatgatcacaagtcatctgtgaattcagttgcttgggcgcctcacgagttgggtctctgtttggcttgtgcttcgtctgatgggaatatatctatattcactgcaagagcagatggtggatgggacacctcatttattgatcaagctcacccagttggtgtcacctcagtgtcttgggctccttcaatggcaccgggcgcccttgttggttcaggtttacttgatcctgtgcagaaactttgctctggtggttgtgataatactgtgaaggtgtggaagctcaacaacggacactggaaaatggactgcttccctgcacttcagatgcatacagattgggttcgagatgttgcttgggcaccgaatttgggacttcc

SEQ ID NO: 5478 - DNA, 406 bp, Cicer arietinum
atttctctctgcgtcacttcaaagctactactctcttccatggcgttgcccaatcagcaaactgttgattaccctagtttcaagcttgttatcgtcggtgacggtggcactggaaagactacattcgtgaagaggcatcttactggtgaatttgagaagaaatatgaaccaactattggggtggaggttcatccattggatttcttcacaaactgtggaaagattcgtttctactgttgggacactgctggacaagagaagttcggcggactcagagacggatattatatccatgggcagtgtgctattataatgtttgatgttactgcccgactaacttacaagaatgtacctacctggcaccgtgatctttgccgggtttgtgaaaacatcccaattgttcttt

SEQ ID NO: 5479 - DNA, 281 bp, Cicer arietinum
accatcattacaggttaaagactcacgctcttctaaaattggcgggcaatagtaatacactggagttccacgtagatgaggttttctggcagagcaacagcaacctcccattttacaagcagttcttttcagttatttgatcaatcctgccagcaacattctcaccctcttctgttatttaggatcaaaagaggaacagaagccaccaaattttaagcatcaattctttgctgtgaaaaagtgttacagttgattagggaaggagaaagtgggaattaggt

SEQ ID NO: 5480 - DNA, 298 bp, Cicer arietinum
accatcattagaggttaaagactcacgctcttctaaaattggcgggcaatagtaatacactggagttccacgtagatgaggttttctggcagagcaacagcaacctcccattttacaagcagttcttttcagttatttgatcaatcctgccagcaacattctcaccctcttctgttatttaggatcaaaagaggaacagaagccaccaaattttaagcatcaattctttgctgtgaaaaagtgttacagttgattagggaaggagaaagtgggaattaggttttgcaaaaaggggttg

SEQ ID NO: 5481 - DNA, 368 bp, Cicer arietinum
atggaaggaccctcgctgattacaacatccagaaggagtctacccttcaccttgtgttgcgtcttcgtggtggtatgcagatttttgtgaagaccttgactgggaagacaattacccttgaggtggagagctctgataccattgataatgtgaaggcaaaaattcaggataaagaaggtatcccaccggaccagcagaggttgatctttgcaggtaagcagttggaggatggaaggacccttgctgattacaatattcagaaggagtccacccttcaccttgtgctccgtcttcgtggtggtttctaatctgtggctgtgggattaatatctgtctgatgtttcttttacttgttgtggaagtgatag

SEQ ID NO: 5482 - DNA, 198 bp, Cicer arietinum
aggaaattggctgctgaattggggtatgcttcaccaattcataaaactattaaggacactcataagtgtttcaatgattgttcttcttttatgcttgagaagattgctaatggacctggtggggttgttcttgcaactcataatgttgaatcaggaaaattggctgctgcaaaagcacatgaattggggattggaaag

SEQ ID NO: 5483 - DNA, 199 bp, Cicer arietinum
aaaaattctttcctggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttag

SEQ ID NO: 5484 - DNA, 383 bp, Cicer arietinum
accttgctgatttccagagtggcgctgagcgtaaagacgctgctgaaagcactcttactgcttataaatctgctcaggacattgcaaactctgagctgcctccaactcacccaatcaggcttggtcttgctctgaacttttctgtgttttactatgagattctcaactctcccgatagggcttgcggtcttgcaaaacaggcttttgacgaggctatctctgaattggatacattgggagaggaatcatataaggatagcactctaatcatgcaacttctccgtgataacctcaccctttggacatctgacatgcaggacgatggtgctgatgaaattaaagaagctgcacctaaaggtgatgaacagcagtgaacatattgt

SEQ ID NO: 5485 - DNA, 182 bp, Cicer arietinum
acattatttacccgtttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgac

SEQ ID NO: 5486 - DNA, 236 bp, Cicer arietinum
acgaacattgcccccaagagcaggacaagctgaatgactctagggagaaggccagatcattgagagaagagcttggtcgaaatggctcttcagctcagagtgaagagactgagcaggaagccaaaatcaatgccctgtatggtatcctcccgacgattgaaaacttgactcctatcctgccacctctactggatcgacttcgttcactgagagctattcattcggatgctgccact

SEQ ID NO: 5487 - DNA, 132 bp, Cicer arietinum
actttggcgattccctgtcaggatttgcctttactgctaatgggtgggtgcaatcctatggatctcgttgcgtcaagtccccaatcatctacggtgatgtgagccgcccaaagccaatgactgtcttctggt

SEQ ID NO: 5488 - DNA, 438 bp, Cicer arietinum
acacaagtgagctgctcgctcttcttatccactataaacaacaacaaagttacaagacaactcaaagaagctgtgataatcaccatactagtagctaacagcaacgatgcatatcccatttatctttgttttcagcaataacctcaactctatcaaggcagagtgtaaggtccacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttgtgacacacttgcattttcatcttgtgctgcacttgcacaaggagctagcttaaaagcttcattatctggtgtagtggattttccacattcaccagcactttcc

SEQ ID NO: 5489 - DNA, 247 bp, Cicer arietinum
actgagctgggccaacaagcttgctggtgctcaggttcttcttagtagattgaggttattcttgagtcctgggtatccatatgaagaaattttaaggaccttccacaatcagaccagcatagtcatgtgctccttcctacctgttttcacaagctttaacagaaccaaaggaggcttgattcaattaaaccatggtaggcctcagcctctccaatatgttgtcaatgcagcctttttggctacctta

SEQ ID NO: 5490 - DNA, 138 bp, Cicer arietinum
tcccgcttccttcaccatccagcataccaaggcacaaaaggcgctgtattttctcgagcccgtcacccgtcagcgggttcgggggcatactgtcgactttttccaccgaccagaattctctcacgcatcgctacatct

SEQ ID NO: 5491 - DNA, 130 bp, Cicer arietinum
actcgttaggaacttgcaaagcacatatccagttttctttttgactaatggaggttgtgaaatctatgaagatttgagaagaaactccttggaggaagccctgaaactctgtttggagaacgggttggaa

SEQ ID NO: 5492 - DNA, 208 bp, Cicer arietinum
gattagatcgattggcgtttctagaggccaactatcccatatgagtaagcttcagagtgatgctttgagagaagccatctcaggaatcacggctgattccaaggagaaaaacaggaaatttgtggagactattgaactccagattggtcttaaaaactatgatccacaaaaggataagcgtttcagtggttctgttaaattgcctcac

SEQ ID NO: 5493 - DNA, 285 bp, Cicer arietinum
accatacaaggaagagacctgaaccattaacactagaagaagagagtgatcttgaacttgctaataagagattccttgagctatgtcaaaagtgtgttcaagccaatattcctttgttggttgatgcagagcatacatcagttcaacctgcaattgattactttacttactcatctgctatattgcataacaaaggtgaaaaccctattgtgtttggaaccattcagacttatttgaaggatgctaaggagaggttgatcttggcatcaaaggctgctgataaaa

SEQ ID NO: 5494 - DNA, 239 bp, Cicer arietinum
accagcatttgcctgcaggaatcagtcatatctcctttggcgaggaagagagcgtttcgccaaaaaagcctgcttcattgtctgaggtggccaagcaacgtgagctcagtggaactatggaaagcgaagacaataagttgaacaagcaactttctgatgcaaagtgcaaggagcttattggtcatgacatatttgctccaccaccagaaatcgtaccccgaccaataactcctcgcata

SEQ ID NO: 5495 - DNA, 276 bp, Cicer arietinum
actgaaattggcaaagattattggattgtgaggaactcatggggttctagctggggagaagccggctacatccgcctcgaacgtaatctagcttcaagcagatcaggcgaatgtggaatcgcgatcgagccatcttatccaattaagaatggacagaatcctcctaaccctggaccatcacctccttcacctgtgaagccaccatctgtctgtgacagttactatagctgtgctgaaggaaccacttgttgctgtatttatgagtatggaaggtcc

SEQ ID NO: 5496 - DNA, 160 bp, Cicer arietinum
ccttttgcttccaccttcgattcatcaaatccgaacgcgtttcttgaaaaggtgttcgacttcgtcgctaaggaaagtgattttctcgataaggatttttctgagaaggaggtggtgtccgcttttcgcgctgcgaaggtaaagaaagctaagattgttg

SEQ ID NO: 5497 - DNA, 124 bp, Cicer arietinum
gtacaaattgaccaaaacttaaaaaaaaacatatattaatatgattttgattttattgtgtatacgtcatatgcaggattttaattaggcacattggaaatcacgtgggactttctttgagcaa

SEQ ID NO: 5498 - DNA, 241 bp, Cicer arietinum
aaatgaataacggcgttaacttactttctgtgtttttatccaaatgaggatgaattaaggtgaaggagggaaatcaaagggatatggcgagcgagaagattaagattaagaagatagacaacgcagcagcgagacaagttactttttcgaaacgaagaagaggcttgttcaaaaaaggtgaagaactctccgttttgtgtgatgctgatgttgctctcatcattttctcttccaccggaaa

SEQ ID NO: 5499 - DNA, 245 bp, Cicer arietinum
ataacaacagcgaagtcgagcagcagttcaacgactacaaccaacactcccaaaatcaggaacaccacgccaaactttcccatgaaataatcggtggtgccgctgcctatgaggcagccaaggcatacgaggatcatgttgccaagaatggcaagccagatagccatgcccaggccaaggaattcattgtcggagctgttggtgctttcgttgaacgagagtttgagaccaagggtctggacttc

SEQ ID NO: 5500 - DNA, 304 bp, Cicer arietinum
aacaccacgccaaactttcccatgaaataatcggtggtgccgctgcctatgaggcagccaaggcatacgaggatcatgttgccaagaatggcaagccagatagccatgcccaggccaaggaattcattgtcggagctgttggtgctttcgttgaacgagagtttgagaccaagggtctggacttctttgacaaggaggaggccaagcgccgaggtgaacatcgagcagaaagggagcttgagcgtcaatactagatctgtatcagggttctttgggagcaaataaatatgatgaataatgaacc

SEQ ID NO: 5501 - DNA, 415 bp, Cicer arietinum
acagagcttacccggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctatgagtagagaggtgcctcttgggggtaatga

SEQ ID NO: 5502 - DNA, 336 bp, Cicer arietinum
acattaaccaaaattattattctctaaatataaaataaaaacgggattaaaaaaaaacttgttcatttttcccccaactaagatgaaaaccaccatcttcattttttctcattcaaccctaatttcattccattccattatccgatgctatttacgaatcgatcctgctaattccaattctcttcaccgaaccattcctaaaaccatcatcattttttgataacacatcccattctgctgctccaatcccgccatgtaactcctcacctccgtccttatcatttcctgcatcactgtcaacaactccgaactgaaattaaacggcacgaccgatcc

SEQ ID NO: 5503 - DNA, 420 bp, Cicer arietinum
accgccgccgcctcaaccgccaagtgcgattccgattcctctggggccgagaatgacggcaccgacggtttctataccgatggcggttccgatgcatcagtttaacgaagctcagaggggatcggtcgtgccgtttaatttcagttcggagttgttgacagtgatgcaggaaatgataaggacggaggtgaggagttacatggcgggattggagcagcagaatgggatgtgttatcaaaaaatgatgatggttttaggaatggttcggtgaagagaattggaattagcaggatcgattcgtaaatagcatcggataatggaatggaatgaaattagggttgaatgagaaaaaatgaagatggtggttttcatcttagttgggggaaaaatgaacaagtttttttttaatcccgtttttat

SEQ ID NO: 5504 - DNA, 401 bp, Cicer arietinum
acaagttgaaccacaccatggtttcaacacacgattgccaatatccccaacaggcagacaagttttcagtttcatgctctttcatcgttgacatgatttacaacttctgcttggctgtccaagggcatatactgtgccatgattgcccttatttcagaatccatatatgaccttattctatatttgtagacaaggtatgcccctgaagctgccagaactaaaccaattacaatgacccaaaatgcagcccaagcagactttccttcttgactggcagttttacttatgcaggcatcatggtccctgatatacagaagatccccactgcaactgcagttatagctgccccaggtattcttgcagctacattcagggcactgacaagcttttttatctttaca

SEQ ID NO: 5505 - DNA, 398 bp, Cicer arietinum
  misc_feature (304)..(304): n is a, c, g, or t
acgccattcttttttgcttaatgcaccaccaactatttcacaggtgtctttattttctactgccccattaaacttttcccacttctattggatttttgcaatatacacaaaaccactagaaaacattaaaaaaataaaataaaaaagacattacttgcataagtatacatatatcaggggcattatagcaaataacctaaaaataccaactatttaattttctataactagcccccctaatggggctctatgtggtattccctttcttctcttggttgttctgtaattaactgaagttggggtnggtgtagaatggtgtgaagctttgatatttgattttcatctgacggctgtggatgttgttgttgccactgtatgattcctcagaatctgatgcc

SEQ ID NO: 5506 - DNA, 338 bp, Cicer arietinum
acgccattcttttttgcttaatgcaccaccaactatttcacaggtgtctttattttctactgccccattaaacttttcccacttctattggatttttgcaatatacacaaaaccactagaaaacattaaaaaaataaaataaaaaagacattacttgcataagtatacatatatcaggggcattatagcaaataacctaaaaataccaactatttaattttctataactagcccccctaatggggctctatgtggcattccctttcttctcttggttgttctgcaattaactgaagctgggggtggtgtagatggtgtgaagctttgatatttgattt

SEQ ID NO: 5507 - DNA, 349 bp, Cicer arietinum
cttattctctcctagaatttacaagatggttacccacgagcacgtccgaaatatcttcgcaggccccatcaagggcgacatggccagcttctggccccacgtcgagcccaacgtcgactggaccgtaaaaggcacccactgcaaggtctctggccgctacaggtccattgaggaattccaacaggggacaagggctttgtcatccacttgggcaggccccctgcatcttgtcgttcaaaacatcatcattgagggaaaccaagctgccgtggagcttaacgccgtcaacactaagactaagagcggcgatccctttccaaatgaatatacctgggtgctgggctttagc

SEQ ID NO: 5508 - DNA, 404 bp, Cicer arietinum
acacaaacataaagcaactactatatagcataaagaaatacacatgactcatgaagaaacaaatgcttatatattactcaagaagatgccaagattttttcaaaaagaggcttcaaaaaagccacgaacttctcttggtgaggggtattttctttgatgacttgaacatccttgaaattattaaaccataaatgcaaatgggggaacctctcagtttgcaaaatttccacttcaaatgtattttccaaaacctcaataaatttgacaaaagatccgagagctatgtctacaatgttaatgttgtctcctccataaaatttattttcgtctttcaaacattgatcctcaacaactcctagccgttcccatagatcctctttggccttctctcggtcttcactact

SEQ ID NO: 5509 - DNA, 252 bp, Cicer arietinum
acaaaattaccgcagatttttggccttgagaccccaattgaagtggagggtgtcccttcggaaattctggatcctgtgaatgtgcggtcagacaaagaggcctacaatgaaacactgttgaaactagctggattgttcaagaataattttgagaccttcaccaactacaggattggaaatggtgacactctcacagaagagattcttgcagctggtccaatcttttaaagcaatgactgtgtgttgtaggat

SEQ ID NO: 5510 - DNA, 404 bp, Cicer arietinum
accggttcaggtttgggttccctattgttggaacgtctctccgttgattatggcaaaaagtccaaactcggattcaccatctatccttcccctcaggtttctactgctgttgtggaaccatacaacagtgttctctccacacattctctccttgagcacaccgatgtcgctgtgcttttggacaatgaggcgatctatgacatttgtaggagatctcttgatattgaaaggcctacttacacaaacttgaacaggttgatatctcaaatcatatcctcactcacaacctcattgaggtttgatggggcgattaatgttgatatcactgagttccagaccaaccttgtgccttatccccgtatccacttcatgctttcgtcctacgcacctgtgatctctgctgc

SEQ ID NO: 5511 - DNA, 105 bp, Cicer arietinum
ataacaaatcataattgtattgaattttttaaaataaaaaaagataaaactttcaccattacatatctagcaagactttactatattttcaatctcaatatatag

SEQ ID NO: 5512 - DNA, 205 bp, Cicer arietinum
acttaaacatgtatcgtcatgtaatcagttgtgatgaaaggatcgttgattgcaacaagttcaacatcgtctctttgaagagcaactctagcaaccaaacgcccaattcttccgaatccgttgataccgatcctaatcttcttgtcagatgccattagaatgagagtgagaataatagagttgaaaaataatagagaaatgagat

SEQ ID NO: 5513 - DNA, 252 bp, Cicer arietinum
actctcaactgatttcccagtgtcagctttctcagccggcgatgtctctccagcactctgaaaacctgcccagatgttatcatcgtcagcactagcatcagctgcgtttgagcccttttcgtttggagcatccatagacaacatgtcaaaaagatccgtagcaaagtcaacttttggaggggaattatgaactgtgctagtcgtctgtgatgtttcagcttgcacttgtggcaccagaggttccactctctc

SEQ ID NO: 5514 - DNA, 192 bp, Cicer arietinum
gctacttgttaataatatcttatttctcacactaccaatattcttaattcatcatcatgggtgttttcagttttgcggatgaggccacctcaattgtagctcctgctactctctacaaagctctagttacagatgctgacaaccttactccaaaggttattgatgccattaagagtgttgaaattgttgaag

SEQ ID NO: 5515 - DNA, 407 bp, Cicer arietinum; identical to SEQ ID NO: 484

SEQ ID NO: 5516 - DNA, 404 bp, Cicer arietinum
accatcaaaatcaaaacaaccacaaaataaaggtcgaccatcgccgatcaagaacccagttttgcaagtttggctgcataaaaacggcaaaattaaaaggcaaaaataaactaagactcttaaaagataataagctactataaagcaacatccacttctgcatcaaccatcacttcttcttcactgcagctttggtgatcttggctccagttggatccttcttctcaacactcttgatgacaccgacagcaacagtttgacgcatgtccctcacggcgaaacgaccaagtggtggatactcggagaaagtttccacaaccataggcttggttggaatcatcttaacaagaccagcatcaccattcttcaaaaacttaggctccttctcgagttccttaccagat

SEQ ID NO: 5517 - DNA, 222 bp, Cicer arietinum
tttggaatcacccatcatctgagtgagccacagtcgcagctctcagctgagccatggatcgcactcagcttctgttggtaggtttacctctcttccttctctgttctgacatcttttcccttttcacacctccacctcccaacccatctcacaaccaccatcgtcaccaccaccaccaccatcaaccaccgccagtcgttgaccccgtggccataccgttcc

SEQ ID NO: 5518 - DNA, 405 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctcca

SEQ ID NO: 5519 - DNA, 249 bp, Cicer arietinum
acagattttccctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaa

SEQ ID NO: 5520 - DNA, 265 bp, Cicer arietinum
actattctccacggaggtgctaaatgccgagcaactggtagcgggtttgttgtccgtcacataaagtttgctgaaaattacagactttattctcgaagccactttgtcaaagcgcttgaagtagctctgctacttatagtttacatcgcttatggatatgcagagggaggtgctgttacatatgttttgctaactcttagcagttggttccttgtcatttcttggctttttgctccttacatttttaacccctccggttttgagt

SEQ ID NO: 5521 - DNA, 405 bp, Cicer arietinum
gctacttgttaataatatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaacggtggccctggaaccatcaagaaattcactttcgtcgaagagggagaaaccaagtttgtgttgcacaaagtgggcgcaatagatgatgctaattgggcttaccactacagcatagttggaggtgctgggcttccagacacggttgagaagatctcatttgaggctaaattgattgcaggcccaaatggaggatccattgcaaagttga

SEQ ID NO: 5522 - DNA, 362 bp, Cicer arietinum
actcgtcatatcgcaggagtgaaggcgcaagtcaacaactgcgtgactcctagggtcgacgacggttactgacggtccggctcacccattacgccagatatactactagctttggctgtgcccaggtcgaccttggttccgtttctttgtaaggattttccggttgatggatgggagttgccttgtatcacaaaaacgtctttttaaagggagaaggattttaagaacggtggaccacggatgatgaagccgcgaaggccagtggtcatggccgcccatgacgtcgggaagatatgatttgcccgttcaagagcgtgacggacgaggctggaagaaggggtcattatttgcatctaaacagt

SEQ ID NO: 5523 - DNA, 176 bp, Cicer arietinum
atgaaagatacccaagatggtggtgggaggatgccaaagcaaaggagtgtggtcttcacaaaggaaatttgaaacaggaagatggtgcccagacgaatggtaatggaagcgatgcccaagcaaatggctctgccacagttgctgacattttcaacacccagaatgtggtcagcttg

SEQ ID NO: 5524 - DNA, 404 bp, Cicer arietinum
actaacatcttctgagtagtcaccatgaacctccatcagttttccaagatcaaacttgggagatttcaagatcttaactttgcgaataaaaacgttctgcagagggtaaatgctagatgtagccttctcaatctcctttccaatcatctcagggataaacttgcgaacaagctccttcaaatcacacgatgttgcttggttaaccatgatctccctcatcttcctgcggatctgtctgatctggctggattgagcataacaggttctcttcacttggttactgcgtctcttggtaaagccaatgcagaacattctcaaggtataattatcagtggtcttaacatccacatgagcttcaatgagagtttgccatttacggaccaaagacctgagcttgtcagtgg

SEQ ID NO: 5525 - DNA, 239 bp, Cicer arietinum
tgcaaaagattctacccgccgctcaataggaattgcgtttcaaggtgtcccgcaaggctcatccgccttacgaggtccaccaacgacacgtgcctctggggggccaaggccccctactgctggtcggcaagcgaacgacgggcacacgcatcgcttctagcccggattctgacttagaggcgttcagtcataatccaacgcacggtagcttcgcgccactggcttttcaaccaagtgcg

SEQ ID NO: 5526 - DNA, 404 bp, Cicer arietinum
actaaagtttctgcaatgacttagaaaacaaaatgagaataatgtaaactggttgtctaactctcggtctgctccctcagccttcggatggtgcttcgcacagttacagcactggcagtattcaatgtgtatgcaccaccagctttcacctttccacaatctttgcagccccagataccaacagccttcctcttaacagcatactttccacagaactcgcagaagaatttactgtgctgactgacttccatcttcttaatctgcttccttaaactggcaccatatcgtgtgccgtatttgccaacaataccggccttcttggttctcttagtcattttgggtggctcggagggaagaagtgagaaacgagattggggcgcggctgcaaaatcgattccctcggc

SEQ ID NO: 5527 - DNA, 389 bp, Cicer arietinum
ggagaaaccaagtttgtgttgcacaaagtggacgcaatagatgatgctaattgggcttaccactacagcatagttggaggtgctgggcttccagacacagttgagaagatctcgtttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatgtcatactctcttcttctt

SEQ ID NO: 5528 - DNA, 302 bp, Cicer arietinum
acggacaaggggactccgactgtttaattaaaacaaagcattgcgatggtccctgcggatgttgacgcaatgtgatttctgcccagtgctctgaatgtcatagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacatccaagggaacgggcttggcggaatcagcgggctaagaagaccctgttgagc

SEQ ID NO: 5529 - DNA, 403 bp, Cicer arietinum
acaagcaaagcacaataatatatcatcaagaaaatgaagacaagcacaagaagtccttgatgatattaattaattaatgaaagaaagcaaaatacccaataaacagacacatccataaaacaacacaatccaagataagaaagacaattgagtattctcaatgagaggttgttgtgtcatccttgtgatgatctttgtcatcaagttcagtagtagtcttaggatgataaccaggaagtttctccttgatcttttccaaaatacctttcttctccttcactgcatcttcactttcatcatgacttgttgtctctgatacaacaacaacaggtggttcctctgttttcttgtgtcctggtaacttgtcctttattttctcaaggaaacccttcttttcctaccc

SEQ ID NO: 5530 - DNA, 330 bp, Cicer arietinum
cgaacgccttacatatcggaggacgatgcctatggcatcggtagcgacatcctcccgatcaacgacgccgattgcgatgggtttttctcctttgaaggcaagccgcaccgccggcctctgatcccttcccgaggtttttccctgccgccgcgacagtcgactacgagctacaacttggttactggagattgtggactgcgtcagcagatgtagcgatgcgtgagagaattctggtcggtggaaaaattcgacaaattgcctccgaacccgctgacgggtgacgggcttgacaaaaacagcgccttttgtgccttggtatgctggatggtg

SEQ ID NO: 5531 - DNA, 431 bp, Cicer arietinum
actcccattctcaaacacaaaaaagaccatcaaatcactcttaacgaaaccagcaagcgtcaacacgaggaagaattaaaactgctggaagaagagactgcgagaagactggaagaagctatcaggaagaatgttgaggagaagcttaattcagaggaagtcaaattagaaatagaaaggcgtgtagcagagggcgtaaagaatttatttgatgatgttgaagttcaacttgaaaaagaaaagcaagatgctcttaatgaagctaggaggaaagaagaacaagctcgaaaagagagagaagagttggataagatgcttgaagagaataggaggagagtggaagagtctcagagaagagaagccctagagctgcaacggaaggaggaggaacggcaaagggaattagagatgattcggcgacagaaagaaga

SEQ ID NO: 5532 - DNA, 401 bp, Cicer arietinum
acacaccagggccaattccagcaccatacttcactccttcacggaagactgacagaagcttttcatcagaacgggagttctcaatggtgataacatcagcatccatgtcaatgatggaatgaatgatgtcgttgaagttagagtagcacatgtgagtgtggatctgagtggaatcctgaacaccaacattggtgattctgaaggagtgaacagcccagtccaagtagtgagcatgctctgacttccttagtggtagcccctctctcaaggcagcctcatcaatttggataacaccaataccacccttctcaaggtcttctacttcatccttgatagccaaagcaatttgatagcaggtttcggatctaggctggtcaactctaacgaaggaccagttgaga

SEQ ID NO: 5533 - DNA, 376 bp, Cicer arietinum
  misc_feature (369)..(369): n is a, c, g, or t
  misc_feature (373)..(374): n is a, c, g, or t
acgttccaccgcgccgatgcgttgatcgtcagctaggtcgatgctgcggccgttcggcgcagtcctctcgtggctgtgcagacgtaatttttcttcctcactctgttggttcttgagtgagctgggagttctcgaaagaggctgccccagaagcaaacaatgtcaacgcatgagaaccccatctgtcctgacgatgggatcccgtctcttgcagacaatatctggatgtggttcagggcctggcgattgatgaaggtctagactagccattacgaagtatgaggtggatgatgaaggacagtcatgagcaacgatttaatgaaggaaatagcttagctgtctaggatagatgacgattgaatctattcntganncg

SEQ ID NO: 5534 - DNA, 297 bp, Cicer arietinum
actgcggttggcttcaagatttcatgcgtctcgttcttaagagccggctccggactgtatccagaccaatagggaagaggaaacgggaagaatggagaatagtatgccggatatactactgggaaagacgatgcttgtgtgctgctgctatcaggctttaatggggcagaatctccatcgtttgagtttgtggaatccatggactcacattcttcgtcaagcgggggaggggcgggcaaagggttgttgccttctgtttcagtctgtggctgattagctgataagaagtcttgtggt

SEQ ID NO: 5535 - DNA, 372 bp, Cicer arietinum
acagagcttacctggagaccgtggaacgaggcgactgcttcgtccacagagcagcgttctagccgccttgggtttttccctgcgaggggtttccccaaggatgtatggtcctaggttgcagctactggcgatcttaggggatcatggatttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggagacgctgctggagggaagctctgcgaggatcaactgtattgatgtccaatgggacatgcttcaccgacaactactgta

SEQ ID NO: 5536 - DNA, 400 bp, Cicer arietinum
actgaacctgatgcagatcttggtccggtcatcagcaaacaggcaaaggagcgggtgcacacattagttcaatccggcgtcgaaagtggtgccaaactactgcttgatggaagaaatatagtggtcccaggatatgaatctggcaattttgttggccctaccatcttatcaaatatcactgccgacatggagtgctacaaggaggaaatttttggcccagttcttcttttcatggaggctgatagtttggaagaggccataaatattatcaacaaaaacaagtatggaaatggtgcttctatatttactacttctggtgttgctgcaaggaaatttcagactgagatcgaggccggacaggttggcatcaacgttcccattccagttcccttgccatttt

SEQ ID NO: 5537 - DNA, 299 bp, Cicer arietinum
acagctccgaatacaacttccatagtatacccttaaagcaactagtccaacaattacttttcttataaaacacgtgtcatgttttaggtttattttgtgcatggtctaacacttgattttgggctttaacaatatatttcaaaatacataatatatattatccttcttaattatcatcagcctcactattactcacatgtgatccaaagtggttcttcaaatccacctttaagaacatcctcgtctccttttccagaacgcaataacgcagccccttctctagcatgccacattggtgt

SEQ ID NO: 5538 - DNA, 324 bp, Cicer arietinum
acaaagttttcggatttgatggcttttggtgggccagcacctgaaaggatcaatggaagattagctatgattggttttgttgctgcaatgggggtggaaatagcaaaagggcagggtttgtttgaacagatttctggtggaggagtcccatggttcttggggacaagtgtgttgttgacacttgcttctttgattccatttttccaaggtgttagtgtggagtctaaatccaaaggtgttatgtcctcagatgcagagctgtggaatggaagaattgctatgttgggtttgattgcgttggcttttacagagtatgttaagggt

SEQ ID NO: 5539 - DNA, 435 bp, Cicer arietinum
acgcatactgcccagagaacctctttctttctgcagcctcggctgctgcccggaacacaaccgggcctcgacgatatgtctcactggatgagactactagacacaaaccgctgggtcaaaatggtatagagcttacctggagaccgtggaatgaggcgactacctcgtccacagagcagcgttctagccgccttggggttttctcctgcgagggttttccccaaggatgcacggttctagggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgggacgctgctggaggga

SEQ ID NO: 5540 - DNA, 384 bp, Cicer arietinum
ggctgttaccaagccagccgccaaggctgctaccaagcccaaggctaaagctgttgcgaagcctaaagcagcggcaaagcccaaagctgcaacgaagccgaaaacggcggcgaagccaaaagcgaagacggttaagacaacaccggtgaagaaggctgttgctaagacaacgaagaaggttcctgtgaagggtgtgaagaagcctaagagcgttaaaacgccggtgaagaaggctaagaaatgataaattagggttttttgtgtgtgtatttctgagttaattacttattattataattattattattaattaatagagatgaatattgtgttagaagtttgtttatgtaaattcttgagtagaaatagaacaagtcttcttgt

SEQ ID NO: 5541 - DNA, 396 bp, Cicer arietinum
acggacaaggcgaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataaatgggagctggaaacatcgaaagtgaaataccactacttttaacgtt

SEQ ID NO: 5542 - DNA, 237 bp, Cicer arietinum
  misc_feature (223)..(223): n is a, c, g, or t
acggatttggcgaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgnccctgtctactatc

SEQ ID NO: 5543 - DNA, 356 bp, Cicer arietinum
gattagatcgattggcgtttctagaggccaactatcccatatgagtaagcttcagagtgatgctttgagagaagccatctcaggaatcacggctgattccaaggagaaaaacaggaaatttgtggagactattgaactccagattggtcttaaaaactatgatccacaaaaggataagcgtttcagtggttctgttaaattgcctcacattcctcgtcccaagatgaaaatctgtatgcttggagacgctcagcatgttgaggaggcagagaaaataggattggactggatggatgttgaagctttgaagaagctaaacaaaaataagaaattggtgaagaaacttgcaaagaagt

SEQ ID NO: 5544 - DNA, 365 bp, Cicer arietinum
ttcacatttatcctaagtcatggagtgaggccacaagcttcaagccggaggggtttgacaaaaaaggggagattgaaaaggtgattgcatttgggatgggaagaagagtgtgtcctggagaagctttggctcttcgaacaattagcatgactttggcattattggttcaatgctttgattggaaacgtacaagtgatgacaagattgatatggtttatcgagatggattcgttttaacaaaattgattccattaaaggccatgtgtaaaactcgtccggtggtcaacaaggttttcaagtaattaacttatatcgcaattggttgatagtccgatgctatattattcatattaattatttcattt

SEQ ID NO: 5545 - DNA, 308 bp, Cicer arietinum
actttgtttacccgttgtcaggatttgcctttactgctaatgggtgggtgcaatcctatggatctcgttgcgtcaagcccccaatcatctacggtgatgtgagccgcccaaagccaatgactgtcttctggtcatctcttgctcagagctttaccaagcgtccaatgaagggaatgcttactggccctgtcaccattctcaactggtccttcgttagagttgaccagcctagatccgaaacctgctatcaaattgctttggctatcaaggatgaagtagaagaccttgagaagggtggtattggtgtt

SEQ ID NO: 5546 - DNA, 219 bp, Cicer arietinum
ctgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtggaggtggatatggcg

SEQ ID NO: 5547 - DNA, 402 bp, Cicer arietinum
acctcctaaacaaggattcaacaattccatgaaccgcgccaagtaaaattcctctctccccaaatatgtcactcttgtattcttgctctaatgtagtggcaaatgtgaaaggagaaccaagggcaatggaccatcccaaagcaacatcagtagccctgccatccacatcccggtggactccaaaacttgaattgattccagcaccatttattgctttgccttgtacatacagcctcctgacagatggacccatccccttggggcacacagcaattacactgaagtgtttaggaaaatcaagtccaattgactgtaaatgcccaagaagaaaaccatgggacaacccaagtatgctgtttggcttcatgtgagaaaatattttttcataattatctgcctgtg

SEQ ID NO: 5548 - DNA, 401 bp, Cicer arietinum
acatggaaactggaaagaaataacaagctttacctaggcgcagagaatctccaatgtaaaatgtatcgctgtcatcgccaatgattccatgaatcacatttacagtagcacacagcaaaacccccagccactgtcttttattaattaatccgaaaacggcgtcatacattaaattacattgcacagcaataattgacaataaagttcacacctcacagactaaccaacttaagagaattagccttttcctgcagggtatccaggaggctttcaaagctcttcttaaatgaatcaactccttcaagttcaagctgggaaccaacagatctccaatcaatgcccaacttctggagagcattgtaaattcctccagcttcagatgcgtttgagtctatcgttct

SEQ ID NO: 5549 - DNA, 110 bp, Cicer arietinum
cgctcttcctgttgtggaggcagagaatataggattggactggatggatgttgaagctttgaagaagctaaacaaaaataagaaattggtgaagaaacttgcaaagaagt

SEQ ID NO: 5550 - DNA, 417 bp, Cicer arietinum; identical to SEQ ID NO: 5275

SEQ ID NO: 5551 - DNA, 279 bp, Cicer arietinum
actcgtcacgacccaatgggtatcagcagacgatcaggcaacaacggtcataacagagtggtggtgtgacacataaggaacatttggcgtgggagttgactgtcagagtaatccagatccaaaaggcgaaagacatattaagccgccaccaaaaggcgctttttagaaaagttctgccctatattggttaagaggggggttctggataccacctactttttgacaggtctggaagccccccacctttttcgtcggccaaaataccttgttctgggttga

SEQ ID NO: 5552 - DNA, 346 bp, Cicer arietinum
atggatggatgtatatttttcgtccggggggccaaaggccccgaaaagtctcctactggagcacaggacgtgctgagctaaactatctacaattgctgtcgcgctggactcctcctagaatacccgccatgtccactcgcatcaacggagagcctctcgagctccttcccccgagggcaccttcctactcgtagccagccctacggtaggttcaagcacatcatcttggatgtcaaagcaggtgattcaggacatatccccatgcaactgcgattccgtctagttcatccagcatatcatcggcacgaaggcgcattactttcaagaggtcatcccgtcagcggga

SEQ ID NO: 5553 - DNA, 303 bp, Cicer arietinum
accatggcaaatgtgcgaagatcactcctgcccgggcggagcacatcaagcactacaagtgtcctgcatgcaccaataagagagctcggccttgatatcatagggaggtatgtgagttacatctcgccgctgtaactctatgcttggacagctaactagttatctgcttagactagcttagacatttctatgttgtgccattttcgtgcgtttcggtccaatcaacttcttatgtggatataattattaaaacatttgatagtgttgattgggatatttatatgttcttagtacctgcccggg

SEQ ID NO: 5554 - DNA, 288 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcg

SEQ ID NO: 5555 - DNA, 400 bp, Cicer arietinum
gagagagagagagaaatcgtggaaattgaattctagggtttgttattgtatcgggaatcaaacaatcagcaatggcgttgaggagattctacaatgagatcaaggggaagaaggtaacagaacttcctcaacacgtgaaaccgatgctttcattcgattacctcaagaaatcaattcagagaggtttagataattacagcgaaaagtatatcgaaacaagttcgattcaacctcttctccatgtctgttatggtggaatgatcttctcttaccttgttgctcttcctaatgagcgtcgtcatctcgctcacaaagagcacgccgaatctcatcactgattcaggatcctgattgttgaattggagatggttggcttgcttgatctttttgttttaaaatt

SEQ ID NO: 5556 - DNA, 420 bp, Cicer arietinum
actacaaacttgacgacctcacgaaagaggttctgattgatggatggttccatacaggggatattggagagtggcaacctaatggaagcatgaagattattgaccggaagaaaaacatattcaagctttcacaaggagaatatgttgccgttgaaaacctggagaatattttcggccaagttccttctattgaatctatatgggtttacggaaacagttttgaggccttccttgttgctgttgttaaccccagaaagcaggcacttgaacattgggcagagcaaaatggtatatcaatggacttcaattctctgtgtgaagattctagggcaaaaggttacatacttgaagagctctcgaagattggaaaggaaaagaaggttttattctatctaatttaagtttcttgttattgtacct

SEQ ID NO: 5557 - DNA, 204 bp, Cicer arietinum
  misc_feature (154)..(154): n is a, c, g, or t
tggcggctacctcagaaccagaacgccttagatatcggaggacgatgcctatggcatcggtagcgacatcctcccgatcaacgacgccgattgcgatgggtttttctcctttgaaggcaagccgcaccgccggcctctgatcccttcccgaggnttttccctgccgccacgacagtcgactacgagctacaacttggttactgg

SEQ ID NO: 5558 - DNA, 428 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgctaagatcagctgtattgatgtccaatgggacgtgcttcaccgacaactactgtagggcgagctacgagtagagaggtgcctcttgggggtaatgagtacctcggccgc

SEQ ID NO: 5559 - DNA, 338 bp, Cicer arietinum
accgttgcttcgttggtggacttgcatgggccaccgatagcgatgcccttgagaaagccttccctcaatacggagagatcgtcgattcgaagattattaacgatcgtgagactggaaggtcaagagggtttggattcgtgacatttgctaatgagaagtcaatgagggatgctattgaaggaatgaacggacaggacatggacggacgtaacattactgttaacgaagctcaaaaccgttcaagtggcggtggaggaggtggttacggtggaggtcgtcgtgaaggtggatacaaccgaagcagtggtggtggtggaggctatggtggtggaggtggt

SEQ ID NO: 5560 - DNA, 386 bp, Cicer arietinum
aggtctttcttcctgccgtgtcgtttgctgttattttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttcatacttccagtattgagctctgtaattacgattatgactatgacaatatctcttattgtgtgacgtgttttattactgatgttagt

SEQ ID NO: 5561 - DNA, 373 bp, Cicer arietinum
acattcatgacaattgatggagaaccatggaaacaacctctcccacaagatgacgacgcagttgttgttgagatatctcaccatggtcaagtgagcatgcttgccaccccattatgccgttctaaaagtatgcatgatccttcctcaaattcgacagaccacgaagatgatagtagtgatgatgaagatgatagtagcgaagaacgtcggaagtttggtgcagccgagacattcaaatatcctgaaggagttgatctgtctcgtttaagttagtgtagctagcattgctcaatctatggcggggaaagaatgagagggtaggaatggtagggagtgaactcttttttgtgcatatcatttttatttttattga

SEQ ID NO: 5562 - DNA, 253 bp, Cicer arietinum
actggagatgtactgacggttgagctcgaggagaatcgattgatcaatcacacaaccggaaaggagtataagttgaagcctattggagatgccggtcctgtcattgaagccggtggtatctttgcctatgctaggaaaaccggcgtgattcctactcgatgagagaaagtcatgttggcagcagcagatgttttgggaggctgactagaattgtttgttcgcctgcattcaaggattctattcagattctcta

SEQ ID NO: 5563 - DNA, 427 bp, Cicer arietinum
acattagtgatggctttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagttaataattaatgtaataaatgtgtgctgtaatatatatgtggtcgcggtttgcttgggttcttaatgaaat

SEQ ID NO: 5564 - DNA, 407 bp, Cicer arietinum
aaaaccaaacttcttcaaatttaacagcaacaaaacaaaatgatattacagtagcaattacgaaaagagaggacacagtcacaaaacctagagtttcaatatttttcaaagaagtaaacagttggcgtttgttctacagatcttgaacagtcaaaccaggaggaagagattgcttcaacttatcagctttgtcggtgtcgaaaacacagagtgggtactgattgttctgggctttaattgaacaccaagtcgcaaacagtgcatgttatacggaggaaacatgtaaacaaaggaatttgcaaggagtgactagattctttttggggttaataaatttgtttgccaataaattaagagtggtttgctttggaagttcaaacaaggaatttaaggggagagaaaaagtt

SEQ ID NO: 5565 - DNA, 203 bp, Cicer arietinum
actctatgcagttgaatgcttcacggttaaaagttcttcaagctcaagatgacgtggtcaataaaatgaaagaggctgcacataaagagctcttgaatgtgagccgtgaccatcatgtgtacaaaaaccttataaaagatctcgttgttcagagtttggtgaggctgaaagagccttctattatattgaggtgtcgggaagag

SEQ ID NO: 5566 - DNA, 394 bp, Cicer arietinum
  misc_feature (393)..(394): n is a, c, g, or t
acttaagggcaaataattctgccttgcctcatgcacttattttgaatatggtgagctatgctggaaaggcagacatgcaagtgcaggtggctaaagatatcattcccgatcctgagtttcttgccaagtgctttgaagatgcattacttgaaatgaaggagcaggttacagccaaaatctgacatttggagaaattgtatttgttggatgtgaaacaaataaaattgcaatcagtattatttgagatacatatgattacatacaatgaatcatctagtttaggtaggatagcgttttgtttcttaaacatcacaaatagactgatttgtgatccattcatctctttcctaccagttgccattgatactttcaagattacagttacatgacatnn

SEQ ID NO: 5567 - DNA, 414 bp, Cicer arietinum
aaaatgcagaaggaacaacaagagagagaaaaaaaaatccgaaatttgtgtctaggagagtttcagtggctctgacttcatctatgatatgtgttgtaagaagagagttagaagagatagatagatagataataagttgaaaatgtcgaagatgaaaggttccacgtttgaaaaggacgtgccatggagagctacatcttcatctgttaagccaatacctaaaattcatcactctccaattcttcgcgtttcccatacacctttttccgactatgcaatttccatcatgaagcatccagaccctataggtgatggtttgggtgatgaggctattgtggaggcagctggtcctgaatgcatcatacctggtcagattactcccgtcagactacttggcctcaaggtctggcctat

SEQ ID NO: 5568 - DNA, 303 bp, Cicer arietinum
acgacgacactcgcgaaggacggcgggagtaagataaacttccttgcgaatgatggtgtcgtttttgtaattggaattgttagcatatcgaagcttaccatcgggtctgaattcgaactccaaaaattcgtgaccgaatttgcccttgtgtccaacgtagtatctcaagtagaactctgcactctcttcttcgcttcccatttctcccccgcgtacatttacccaaacattgagaaaccagcagctgttttttctatgtaaaaaaaagttgttatcttcaagatttggctaaccacttcatgt

SEQ ID NO: 5569 - DNA, 354 bp, Cicer arietinum
accgatcaaccctgcaatggttactgcggtagcttcaattattaagtctttgggagaagatccactgaggaaggagattagagggactccaaatagatttgtgaggtggttgatgaactttcagaacagcaactttgacatgaagttgaatggttttctcaatgctggaatagattctttgaacgagaataacgaggttgacttgaacgataagaaaacatttactgagctgaatttaacattttggtcgcaatgcgagcaccatttacttccatttcacggtgttgtccacataggttacctcatatcagatggatataagcctattggaaaatctcttttacaatccatagt

SEQ ID NO: 5570 - DNA, 354 bp, Cicer arietinum
accgatcatccctgcaatggttactgcggtagcttcaattattaagtctttgggagaagatccactgaggaaggagattagagggactccaaatagatttgtgaggtggttgatgaactttcagaacagcaactttgacatgaagttgaatggttttctcaatgctggaatagattctttgaacgagaataacgaggttgacttgaacgataagaaaacatttactgagctgaatttaacattttggtcgcaatgcgagcaccatttacttccatttcacggtgttgtccacataggttacctcatatcagatggatataagcctattggaaaatctcttttacaatccatagt

SEQ ID NO: 5571 - DNA, 376 bp, Cicer arietinum
acatgtgtgttctctatcttttgagtgaaacggatcaaaggttcagaatcaggaacctgtcaagatgtgtatagtgtgtatcttgacagttaaaatatcccattctgtttctctcattcctgttcttgaatattttattgatggctttgcttgatcagccatttgctcactcgatatctttggaatattcaaatagccaatggcagctcaagaggaacgcctgtattattttttcagttccttgaggggtgtgttaacatttttcaattagttgtaattcgaatgaagttggatatgttctactaccaatgaaacaataaaccttgttctacgtataaatcacatgttgcaaatattgtgaagggaaagacagagt

SEQ ID NO: 5572 - DNA, 159 bp, Cicer arietinum
actcggatcagcatcagagggagtgcaacagaaaaacagctccaatgattagcaatgctacagaggatattaaagcagcaattgcagaggctcccaatcctgcacgttccctaggatccttcatatagtagttcccaaaatagagaattgctgcatagt

SEQ ID NO: 5573 - DNA, 360 bp, Cicer arietinum
actttcaagggtaaagtgcggaattttaaccggttgagattttaacaatttgatagcttgttattcatgtgcttgtattttattgcagtctaaactgttgatctttcaatcaatggttttaatccacactttactcttccaagtgcacactccactttagaggatctaaattctactcttttatatgtatatatattaaaggccctctttccccgagggaaaatgtcgtcaaagagcctttgtcttgaatgtgtcccacttgtatctttctttcgtttgaccagtaagcacgctttgcatgcaagattgtgatcttttgtataagtaattgctacgctgtaatttcaatttatgagatct

SEQ ID NO: 5574 - DNA, 268 bp, Cicer arietinum
  misc_feature (268)..(268): n is a, c, g, or t
actggggttgctgaaggtaatccaggttttcaaactattggcaattggtataagattgagaaagctggtaaagattatgtgctttctttctgtccttcagtttgtaactgtcatactttgtgtagggaacttgggttatatactgatgataaagggattaagcacttagctcttagtgatcaagttccatcatttagggttgtgtttcaaagggcttaatttctaagtgaaacaatactaaaaatgaataaaactagtcaaagttgcn

SEQ ID NO: 5575 - DNA, 187 bp, Cicer arietinum
acgcggggggaagcaaagtttccgcgttttgtcttcaggaaagaaaaggcgttaatttttctattatatggtgataagattgttattgtgtttttttttctctaatttctttaagctgttgtgtattttagctttttatttattttgacagttgtaaagcagtctgttctgctgttaattaatagta

SEQ ID NO: 5576 - DNA, 343 bp, Cicer arietinum
acttctttgcaagtttcttcaccaatttcttatttttgtttagcttcttcaaagcttcaacatccatccagtccaatcctattttctctgcctcctcaacatgctgagcgtctccaagcatacagattttcatcttgggacgaggaatgtgaggcaatttaacagaaccactgaaacgcttatccttttgtggatcatagtttttaagaccaatctggagttcaatagtctccacaaatttcctgtttttctccttggaatcagccgtgattcctgagatggcttctctcaaagcatcactctgaagcttactcatattggatagttggccacctgcccgggc

SEQ ID NO: 5577 - DNA, 232 bp, Cicer arietinum
acatcggagaaagtgccagattaataagagaaatgtttggatatacacgtgatcaccagccctgcatcatttttatggatgagatcgatgctattggtggtcgtcgttttagcgagggagcaagtgctgatcgtgagattcagagaacactaatggagctgcttaatcaacttgatggctttgatcaacttggaaaggttaaaatgataatggcaacaaatcgacctgatgt

SEQ ID NO: 5578 - DNA, 258 bp, Cicer arietinum
acaattcttaccaacccttcttctaaactcagcaaaatcaacaagatcatcaccaacaccaccttcatcactcattatcctagctaacagaccaatcacaggaagagcaccaatgactttgtttgcaatgcttgaaaatgaatttggtgtttccatgtaagctttgatggtaaagtttgaagcttttgaggtttgttttgttgggtgatgaacatggtgatggcttaggaaaagaagtgaagatgaagatgatgtgga

SEQ ID NO: 5579 - DNA, 186 bp, Cicer arietinum
actattaattaacagcagaacagactgctttacaactgtcaaaataaataaaaagctaaaatacacaacagcttaaagaaattagagaaaaaaaaacacaataacaatcttatcaccatataatagaaaaattaacgccttttctttcctgaagacaaaacgcggaaactttgcttccccccgcgt

SEQ ID NO: 5580 - DNA, 438 bp, Cicer arietinum
acgcggggacacaaacaagctagctacttgttaataatatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtat

SEQ ID NO: 5581 - DNA, 224 bp, Cicer arietinum
gattagcgtggcccggccgaagtactttcaagggtaaagtgcggaattttaaccggttgagattttaacaatttgatagcttgttattcatgtgcttgtattttattgcagtctaaactgttgatctttcaatcaatggatttaatccacactttactcttccaagtgcacactccactttagaggatctaaattctactcttttatatgtatatatattaaag

SEQ ID NO: 5582 - DNA, 210 bp, Cicer arietinum
acggtggttttgaagatcagattacactgtgacggttgcatttccaaaattaaaagaatcattatgaagttcaaaggggtagaaacggtgatccttgacggtgacaaggatttggcaacagtgaaaggaacaatggatccgaaggagttggtagaatatttgaaggagaagctgaagcgaaacgttgatgtaattgcccctaagaaagat

SEQ ID NO: 5583 - DNA, 204 bp, Cicer arietinum
gattagcgtggtccggccgaggtactgtttgatgagattgagaaagcccatcctgatgttttcaacatgatgctacagatccttgaagacggaagactaacagacagtaagggaagaactgtggatttcaaaaacacacttcttataatgacatcaaatgttggaagcagtgtgattgagaaaggtggccgcaaaattggattc

SEQ ID NO: 5584 - DNA, 436 bp, Cicer arietinum
acgcggggaagttaaaaatgcagaaggaacaacaagagagagaaaaaaaaatccgaaatttgtgtctaggagagtttcagtggctctgacttcatctatgatatgtgttgtaagaagagagttagaagagatagatagatagataataagttgaaaatgtcgaagatgaaaggttccacgtttgaaaaggacgtgccatggagagctacatcttcatctgttaagccaatacctaaaattcatcactctccaattcttcgcgtttcccatacacctttttccgactatgcaatttccatcatgaagcatccagaccctataggtgatggtttgggtgatgaggctattgtggaggcagctggtcctgaatgcatcatacctggtcagattactcccgtcagactacttggcctcaaggtctggcctatcgacattg

SEQ ID NO: 5585 - DNA, 435 bp, Cicer arietinum
actgcattttcactgcattaaaaataaagccagtttactcttcttcggtggcgatttccccatttttgttgttgtgcttccttgcatacctctggttcctgagaaacttaggatccatccctttggtggaagtgtgacggtgcctctttggctttttgatgccgttcttgtgagccttgtaagattggttgtgagctgtgtgattctttgacttcgccatctcttgaagtcgagcggctagggttttctgtgttctgtgtagttccccgcgtacgcgggggaagcaagtgaagtagagagagaaagagaaaagagagtaattgggtttttggaatggcgagttcaaaaaattcagatgagtcagagaagccacaaccagtgatgttggttgcaatcgatgagagtgagcacagtgcatacgctctgatatggacc

SEQ ID NO: 5586 - DNA, 366 bp, Cicer arietinum
accaaagacgggtgtgcctttcacctcaggactctaaattttaatacgatcaattcggtaaaccttttgatcagttcttaaacatatcaattactctccgtttttttataaaagacaaatgagatataaatgtgtcaacaaaagttgatatatttagtatataatctatttgtatcttattcatcttttataaaaagatggaaaggagtatttatgttacattattgattgggtaaaaatgtgttacttaataattatttttaatgaaataaggcaaaaaaaattcattagttgggccaagaaattgtattgctacttgtattgataatttagttttaaggaattgtcactgtgttgatttgtatt

SEQ ID NO: 5587 - DNA, 101 bp, Cicer arietinum
acatatacagcacggtgtttgcagcgacgttgtaaagcatcaagatcgtgagcacggtggaagtcaacacaatctgaaccacaaaagcccaatccctccac

SEQ ID NO: 5588 - DNA, 243 bp, Cicer arietinum
accttcagcactatggtgttgaaattggtagaaaaaagaaatcagctgcagccaagaaggattctgtagaggaggttgaagccgccactgaagaagccaagaaaagtaatcatgtgcagaggaaacttgagaaccgtcaaaaagatcgtcagctagattcccacattgaagagcagtttggtggtggtcgtttgctggcctgtatttcatctcgtcctggtcaatgtggcagggctgatgggt

SEQ ID NO: 5589 - DNA, 349 bp, Cicer arietinum
acaaattgttggtgatgatctcttagttaccaaccccgagagggttcagaaggcaattgattcaaaagcatgcaatgctcttctgctcaaggtcaaccaaattggatctgtgactgagagtatcgaagccgtgaggatgtccaaaaaggctggatggggtgtcatgaccagccaccgaagtggagagactgaggataccttcattgctgatcttgctgttggtttggcaacgggccaaattaagacaggagctccatgcaggtcagagcgtctcgctaagtataaccagctcttgagaattgaggaggagcttggtgctgaagcagtgtatgctggaacaaacttccgt

SEQ ID NO: 5590 - DNA, 276 bp, Cicer arietinum
acttcagtgctttgaattacaggtagcaggaccaaatggacaaatattgaaaggtgctgatgctaaggttagcatggatgaaagacctggtctcactgttccaagagcacataatctcgtttgtgttccacttgcaagacctggtgctgctgctaaactcctttcctcctaaaacatacattcaaacacttaattcgtccatgtccgtttataaactaaataatcattttcaataaggtatcattgagagagtccacaatgtgtgctagtgatagt

SEQ ID NO: 5591 - DNA, 123 bp, Cicer arietinum
gccgaggtacatatacagcacggtgtttgcagcgacgttgtaaagcatcaagatcgtgagcacggtggaagtcaacacaatctgaaccacaaaagcccaatccctccacgaacctccccgcgt

SEQ ID NO: 5592 - DNA, 222 bp, Cicer arietinum
accaggtcgtcgggagagctcttcctacggaatccgatgaacacccgaagatttatcgtatgaagctttgggctaccaacgaagttcgtgccaagtccaagttctggtatttcttgaggaagctgaagaaggtgaagaagagcaacggccaagtccttgctatcaatgagatttttgagaagaacccaaccaagattaagaattatggtatatggttgaggc

SEQ ID NO: 5593 - DNA, 151 bp, Cicer arietinum
accctctctcagtgaggatcttcatcaatgaatcagttagatcacggccagcaagatctaaacgaaggatggcatgagggagtgcatatccttcgtagattggcacggtgtgactcacaccatcaccagagtccaagacaataccagttgt

SEQ ID NO: 5594 - DNA, 438 bp, Cicer arietinum
acgcgggggagttgatctggtaaacaagaaagtgtatgcagagtgcaattgagatcccagaagaagaagaggaagaaaatggggattcgattcgtgttaatggtgaacaagcaaggtcagactcgtcttgctcagtacaaggaaggagaacagccattggtgcatgatggacctataaacaacaaatatgccatagaaggacaattcattgacgaaatggacacaagtaacaagagcccattcaaggctaaccaccctgaagaggcccatgtgttctttcttcctttcagtgtttataaggtcattcggtatgtttacaagcctagaaggtcagttttagattatgatgctcaccgcttacagcttttggtggaagattatattaacattattgcaaacaggtatccttattggaatagaagccaaggtgctgaccat

SEQ ID NO: 5595 - DNA, 404 bp, Cicer arietinum
actgcttgcgggtttttccagcttcagtttctggaatgcttaaatgaggatgctcagcagcagttacaattcggcggaatagactgttaaagtcacctaatttcacactaattggtataggagcctctactcccatgtcctgactaacccttgttgaatcttgtatagccaatgtgaatgaatccaggtcatctttagctgcaactataaggcagggcacctcatagccagtattttctccatgaccagcaatttctaccaagagttcagacgatgccttccatgaagactcatcagacctgtcatgaaggaaaactgcaatgtcacatgaagccaaagactccttatttgccagcagccttttaactccaccttcaggaatctctctcagcacaagatatttt

SEQ ID NO: 5596 - DNA, 144 bp, Cicer arietinum
accagaaggaatccaagtgtttcaagttaggtgtaaagagaacaaaaccacaattcactttccactctctcaacttcacactctagtgcctaaatttggctgcataaataccaatacaactctgttgttattcagttatttagt

SEQ ID NO: 5597 - DNA, 440 bp, Cicer arietinum
acgcggggaatcctaatgcagtgctggcagcatttgaagctagggctgctaggaagtcggttgcctgtgctaaaaatcttagcaagtttacgaattctgaagagggtttccaagaactctcagctgatctagctgaggcagctgttgctcattgccagttgatcgttgtttccaaatttattgagaagttgcagcaagatatacctggaaagggagtgaaacagcaattagaaattctttgtagtatttatgctttgtttcatcttcataagcatttgggtgattttctttcaactggctgcatcactcccaaacagggttcacttgccaatgaccagctcaggtccttgtattcacaggttcgtcctaatgcaattgcacttgttgattcgtttaactacacggatcattacctcagttcagttcttggccgttatgat

SEQ ID NO: 5598 - DNA, 366 bp, Cicer arietinum
acacatggaagatctattctgaaaggcttatgaccttagcaggagtttatagtttctggaaatatgtttccaaactagagaggcgtgaaactcgacgatatcttgagatgttctacattcttaagttccgtgatttggcaaattctgttccactagcaaaggatgatgcaaattaactaacaagtagctggtgttggcagctctatgtttttatcacagcagagaataagagtcttgtatgtatataaaaatctgcttcttgtgttgtaaattaatatgtttatctgcagtcttaagaggagtttcatggaagcttgtccatgttatagctttgattatataagaaatgctgagtacctgcccggg

SEQ ID NO: 5599 - DNA, 428 bp, Cicer arietinum
acgcgggggaccagggttcgtgtggttcgtgttgggcgtttagcacaacgggagcgttggaaggagcaaattatttggctactgggaaattagtgagccttagtgagcaacagcttgtggattgtgatcatgtgtgtgatccagatgaatataattcgtgtgactcgggctgtaatggtggattgatgaacaatgcatttgaatacctactccagtctgggggagtagtgcgagaacaggactattcttacacaggaagagatggctcctgcaaatttgacaaaagcaagattgctgcttccgtatctaatttcagtgttgtttccgttgacgaagaccaaattgctgcaaatttagtaaagaatggccctcttgcagttgctattaacgcagcctggatgcaaacatatatgagtggtgtctcatgc

SEQ ID NO: 5600 - DNA, 221 bp, Cicer arietinum
acttccagttggaacttccttgactgttgttggtgaggctgctagagatgatgttggaactgttcgagttcagcgaccctcgaaagggccattttatgtctctcccaaaaccattgatgaactcattgcaaatcttgggaaatgggcgaggtggtataagtgtgcttctctgggcttgacagtgttaggtgcttatctgataactaatcatgctattcggt

SEQ ID NO: 5601 - DNA, 100 bp, Cicer arietinum
actcttatgtggttcaaaataatgtattgtggaagacttgctgaaaccaaatacaaatcgaagcgtcgaatttggttcaaaaaaaaaaaaaaaaaaaagt

SEQ ID NO: 5602 - DNA, 196 bp, Cicer arietinum
accttataaggttttgataccaattgggaagataaaagaagtcaatgaagggcagaatgtgaatgagaaaaaacaaaagtatatagaaattgtcactaaggatgattctgaattttggtttatgggattcttacgatatgagaaagcttttaggaatcttgagaaagctatttctatgtctatttagtctcaccgt

SEQ ID NO: 5603 - DNA, 221 bp, Cicer arietinum
actctggctggccatcaaacaccaagttattttgtgtgggaagttctctttacaatgtccatcataggattgggactcttgctttttgcgcttctcatcggaaacatacagaactttcttcaagctcttggacggaggagactagaaatgcaacttagaggccgtgatgtcgagcaatggatgagccatcgtcgtttaccagaagctctcaaaaggagagt

SEQ ID NO: 5604 - DNA, 305 bp, Cicer arietinum
cacttaaaatgtcgtccttagtacaaaagattatctcatcgtttaaatctttagataatataaacttagaggccgtcacttaattacatccataagttttaggcggaaaaattttattttttcttttagctactcatgtcaccattatcacttgagttaaattattataatttcatttaaaaaataaaaatcttaatttagctcaacgttctgctaccccatttaattataattaagctttaattataaaataatatggacaaggtttcggtatattgtttagatccgataaattttcgatgctt

SEQ ID NO: 5605 - DNA, 433 bp, Cicer arietinum
acgcgggattcaaagctacaccaattatatatccaactgtttacagaaaagacttctttcattcatagcttctgttcaattcaattcaatctttgaagatggccaatagaaatgttgctgctaattctcctcttgaaagggctagcttggcttctctagatcaaaggttggccgtggccaagcgctgttctcatgagggtgtgatggcaggagctaaggcagctgttgttgctaccattgccactgccattccaacttttgctagtgttaggatgctaccttgggcaaaagcaaacctcaatcacactgctcaagctctcataatttccacagtggctggagcggcatatttcatagtagctgacaagactgtcttggcaactgcaagaaagaactccttcaaccgaccctccaatgcatgaaggaactccaa

SEQ ID NO: 5606 - DNA, 419 bp, Cicer arietinum
acgcatactgcccagagaacctctttctttctgcagcctcgggtgctgcgcggaacacaaccgggcctcgacgatatgtctcactggatgagactactagacacaaaccgctgggtcaaaatggtatagagcttacctggagaccgtggaatgaggcgactacctcgtccacagagcagcgttctagccgccttggggttttctcctgcgagggttttccccaaggatgcacggttctagggttgcagctactggcgatcttaggggatcatggacttcctgcctcagggtatggaaagctacttgatctatctgtgcaagagaattctaggctggagaggaatagatcccgctgacgggatgacctcttgaaagtaaatgcgcctttgtgccgatgatatgctggatgaactagatgg

SEQ ID NO: 5607 - DNA, 150 bp, Cicer arietinum
acataaggaaatgcaaaacagcataaacctcgcttcaattttttcaccctttcaagactcttgctttcacaggatccacaccaaagccgcccacctcaatcctaatcccgcttgattctcttgttccattcaacccaaactgaatatgcc

SEQ ID NO: 5608 - DNA, 360 bp, Cicer arietinum
actagtataccaacgtaagcaaaatgtaaaataaacctactttttaatggatttcttctttgtagttacattcacagatggttgtggtttcggatgcttttccgcctcacttgggtccaaccacttaagaggatggcggttgaagaagggccaattcggaagagtaactaatgtggtgagaaccacaccaccagcatatgtgagaatcattgcttggaatgaagctgtgaaatatccagctgaagatgctatcacagcaaatgcaagcagcattatctgcatcagttgctctgccagcttttgtccttcccaatccatcttttgacagagaaacgaagaacctcttctgagtccccgcgt

SEQ ID NO: 5609 - DNA, 217 bp, Cicer arietinum; identical to SEQ ID NO: 913

SEQ ID NO: 5610 - DNA, 119 bp, Cicer arietinum
actgttctatccatagagaaatcatcccgctctccaaatggaccacaagaagaactcataccgatctgtttttcttcagctgatttaacttgaaccagaacatacgggaactgctcagt

SEQ ID NO: 5611 - DNA, 349 bp, Cicer arietinum
acgttggggattaacataacgagctctacatgtgttgttactggagcggatataccgaagcaacaggggattacgcagcttagcaaatggaactgcttgtttattactattgcttggggattcttctttcgattcctcttacttggctttgctatttggaagcaagaacaagaggaagtaaacgaggattttatatataaacttttattaatttatttataattctacctcctatataaattcttgtgtaataataatcaaatccagagtgtagaaatagtgcagcaccacaaaaactctaccaatagcttcttgtgcttttcttttctttttagaatgttgtaagtgt

SEQ ID NO: 5612 - DNA, 195 bp, Cicer arietinum
acttgccccattgacacttggaggaaattggcagcaggctaccaccaaagggcagtggtagtgaaactgtgcgtatggctcgaacactcattgctgctcgtcacgcgggtgaaaggcttttgagatgctggggtgggggaactggatgggctgtggaggatgctaaggacaagatcatgaagctcttggaggggt

SEQ ID NO: 5613 - DNA, 221 bp, Cicer arietinum; identical to SEQ ID NO: 5600

SEQ ID NO: 5614 - DNA, 439 bp, Cicer arietinum
acgcggggggtttctagagtttgttcacactatggattttctgctttgaccactgttcttgctgtgaactactttgatagattcatcactagtttgaagtttcaaaaggataagccatggatgacacagcttactgctgttgcttgtttgtcacttgctgctaaaatggaagagacccacgtgccacttcttttagaccttcaagttgaggattctagatttgtgtttgaagctaagactatacagagaatggagcttttggttttgtcaactctgaagtggaggatgcatcctgtgacaccgatttctttctttgaacacattgttagaaggcttggtttgaagagccgtttgcattgggagtttatgtggcgttgtgagagggttcttcttcatgtcattgtggattcaaaggctatgatgagttatcttccttcta

SEQ ID NO: 5615 - DNA, 424 bp, Cicer arietinum
acctaaagctgtcgtgattagtgaatggttggaaaaattaacatttaatataattacaaagatgattagtgggaaaaggtattttgagtatttgcaagatgtggatgatgtagaagcacatggtattgtgaaacttataaaagagtttatgcatatttctggtgagtttgttccttcggatttgattccaattattggttggtttggttttgaaggacaagtgcttaaatctatgaaaagggttggtagagatttggataaagttgttggaagatgggttgatgaacatgttgagaagattgatgatggtgtcaatgaaaaacatgatttcattgatgttatgttgtctgtgattgaagatgatccttcttctggtcatgatcgtgatactatcatcaaggcaaatattatgaatcttatgtta

SEQ ID NO: 5616 - DNA, 349 bp, Cicer arietinum
acaaattgtcggtgatgatctcttagttaccaaccccgagagggttcagaaggcaattgattcaaaagcatgcaatgctcttctgctcaaggtcaaccaaattggatctgtgactgagagtatcgaagccgtgaggatgtccaaaaaggctggatggggtgtcatgaccagccaccgaagtggagagactgaggataccttcattgctgatcttgctgttggtttggcaacgggccaaattaagacaggagctccatgcaggtcagagcgtctcgctaagtataaccagctcttgagaattgaggaggagcttggtgctgaagcagtgtatgctggaacaaacttccgt

SEQ ID NO: 5617 - DNA, 439 bp, Cicer arietinum; identical to SEQ ID NO: 5009
  misc_feature (218)..(218): n is a, c, g, or t

SEQ ID NO: 5618 - DNA, 423 bp, Cicer arietinum
  misc_feature (1)..(1): n is a, c, g, or t
nacattagcgttttccttccttgcttacgtggaacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagttaataattaatgtaataaatgtgtgctgtaatatatatgtggtcgcggtttgcttgggttcttaat

SEQ ID NO: 5619 - DNA, 405 bp, Cicer arietinum
acgcggggatactaataaagttacaaaaagtgcgacgaagctttcaagtcatggctttgtgtttaaaccaacacatgctatccccaattatctttgtcgttagtgttttatgcttattggcaaatcattccattgctgaggaacttccaaggttcaaacatcatctaaaaccacaacaacaatctcttaattttttggtcgttggagattggggaagaaaaggaaactacaatcaatcttttgttgcccatcagatgggaatagtgggagaaaatctgaatattgattttgtgatttcaactggagataatttttacgatgatggcctagtaggagttgatgatccagcattctacgagtcctttgtcgacatctacactgccccaagcttgcaaaagacttggt

SEQ ID NO: 5620 - DNA, 164 bp, Cicer arietinum
actaggatattagatagtatgctgcttggtaagagggggtctgtttttggaggacaatgaagggcatattttaaaatggctcttcatttttaatttgttggtgtgttcttagatgggacctatctttagggttcttttggttgttgcggtgttttggtttttgt

SEQ ID NO: 5621 - DNA, 213 bp, Cicer arietinum
ctgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtggaggtggat

SEQ ID NO: 5622 - DNA, 435 bp, Cicer arietinum
aaaattctttcttggcacgcactgttagtgcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttctcctttgaaggcaagccgcaccgtcggcctctgattccttcccgaggtttttccctgccgccgcgacagtcgactacgagctacaacttggttactggagattgtggactgcgtcagcacatgtagtgatgcgcgagagaattctggtcggtggaaaaagtt

SEQ ID NO: 5623 - DNA, 331 bp, Cicer arietinum
acttctttacaggatggtcttaagtcatcaaagacagggttcttggctctctttgtaacactgatatgctgctttgtgtatttatagtatttatttatgcatcgtgagatatagatctaatattctttttcctatgtatattctatttccactactgtatatttgtgataatttgaaaaaccacatgttattttcaatattgcttgtgttgtgcttcttttctgcacaataggtttttcaggtttagcttagatgattctgttggacactctcagtcttatagaatctaatcattactccatttgttattcttttggcagttttgtaaagt

SEQ ID NO: 5624 - DNA, 173 bp, Cicer arietinum
actcgagcatcacatacaaaatgagggtttccctttgataaaatcaacttcactgtctctggataaacaaaagtaacaaagccaaacatacgcttctgctgatatggaatcctcacatcttgaacaggaccataaatgctgaagtaattggaaacatcttcctctctaaaagt

SEQ ID NO: 5625 - DNA, 168 bp, Cicer arietinum
gggcaggtacagggaaaccctgcttccttcaccatccagcataccaatggcacaaaaggtgctgtatttctcaagcccgtcacccgtcagcgggttcgggggcaatctattgtcgaactttttccaccgaccagaattctctcgcgcatcactacatctgctgacgca

SEQ ID NO: 5626 - DNA, 229 bp, Cicer arietinum
acagctggaccattattacctagagaaaaagaaatgcacagatgaaagggtaaaaaagtaaatgaagagatgttaattgttaactgcaaggctagctgattcaagagggaagatggaatgtataattgttaattttagctgagttaaagttaatgttattaatatgttgcagtttttatgctttgtatttaataattgttataaacagttatcaacctcaacccttatg

SEQ ID NO: 5627 - DNA, 437 bp, Cicer arietinum
acttacatcctgccgggaggggcaaatcaaaatctgggcgagacctggcactgccgagagccagacaagcaactccgaaaccttgttagctacgagtctcaaggagaagcctccactttcaagcaagatcagcaatattagttacaaacaataactaaaccttaatctaagggagttttaagcattttttttcatggtttgtttatcttttttatccagttggtttagttttaacatcttgatttaagtggaagatgaaccagctggtcttattgtatattcagttattaacggatgagcatgccattgatagaactatgaggaagggggggagagttctcttcaaccgcctcctgtaattacaaaacggctgttactaattagtgattacaggaataatgtgaaattggtccttggtgatcagtacctcggccgcg

SEQ ID NO: 5628 - DNA, 429 bp, Cicer arietinum
acgcgggctggatatataaattataaatgtaatttagaaatttgttattcctaattaggaatcagcaagctcttctaaattatataagtatggaaagaaattattgtagaatttaagctatatattaaagagatttatttatataaataggtttgctagctgattgtgtatatacgcaggccaatgcttctaatttcatagcaagttcgcttgctatgaaataggcaaccagtaatataagcaagtgtgtgctatttatagcgctagcctacaaacctataattatattaactctaagagaaatttaataataaacgaagtgaattgaaatatcttagtaactttaggaaaagaaatcaaaagagattctatgattagcgtgagctaaaatagactagcctaaaaagtcaaatggtggataaactgttt

SEQ ID NO: 5629 - DNA, 323 bp, Cicer arietinum
actagcgatttcgaggcggccgcccgggcaggtacaataaaacttatcatacttttatttcattaagaacccaagcaaaccgcgaccacatatatattacagcacacatttattacattaattattaactagcgaaaagcaaacatcaacaacaaccttctttatttattctcttaattatgatattattattttaaaaggttttatttaatcttgtgcagcttttccagcacgatgatcataaccatgaaccccaagattaattattttgaggtattatgccacgaagagatggccaatagtcaagagttttcttcacacca

SEQ ID NO: 5630 - DNA, 247 bp, Cicer arietinum
accatttattggactctgttactctagttagttgccttgattactgaacctgatagcttgtatctatcaactggtcgcactcgtagtttcagtttaactttgaactggcatgtctatttgaaagtttggtatcttgcagcttaaataactgactgttgaaatgggaatttaataatttatgtgggcattcagagaatcagaactatgttcaggcaattttgttgttttaaatataagtatcagtttg

SEQ ID NO: 5631 - DNA, 247 bp, Cicer arietinum; identical to SEQ ID NO: 901

SEQ ID NO: 5632 - DNA, 144 bp, Cicer arietinum
acaacaaaggttttcctttcactgagaaagagagagatgcacactatttgcgtgggctcttacctccctcttgtagcacccagcaacttcaggagaagaaacttatgaacaatatccgccaatatgaagttcccttacaaaagt

SEQ ID NO: 5633 - DNA, 294 bp, Cicer arietinum
  misc_feature (290)..(290): n is a, c, g, or t
acagctggagcattattacctagagaaaaagaaatgcacagatgaaagggtaaaaaagtaaatgaagagatgttaattgttaactgcaaggctagctgattcaagagggaagatggaatgtataattgttaattttagctgagttaaagttaatgttattaatatgttgcagtttttatgctttgtatttaataattgttataaacagttatcaacctcaacccttatgttaccagaaagaaaagtgagaagatttagaaaagaagaatcaaaagtgagttttttttatngacc

SEQ ID NO: 5634 - DNA, 277 bp, Cicer arietinum
acgcggggccgattttgaagtgtgaggtagacattgtggtgttgaatgttgataacgtgactgatctctctctctctctctctcttcaaagactgttggcagtgtcaactgtgcaatccaatccaacgcgcttcttttccatttccattctattttgcagatctctttcctcatccgttagttgaaataaatggccttggtcaccactgctgaagtgtgtgatgcaaatccacagttaattttgagtggggagcttcgtgcccttcagccaattttt

SEQ ID NO: 5635 - DNA, 434 bp, Cicer arietinum
actactttatgtcaattattcagtaacagattatacaacttcactgcaaatggtggtgctgatccttccattgactcttcatttcttccacaattacaaacattatgtcctcaaaacagtggtgcttcaaacagagttgcattggataatggaagtcaaaacaaatttgataattcttactatgctaatctaaggaacgggcgtggaattcttcaatctgatcaagcactttggaatgatccttctacaaagatatttgtgcagagatatttgggtttaagagggttacttggattaacatttaatgttgaatttggaagatcaatggtgaaaatgagcaatattggagtgaagactggttcagatggtgaaatccgcaagatatgttcagcttttaattaagtgtagaataacacaaaaatgcataactgatt

SEQ ID NO: 5636 - DNA, 383 bp, Cicer arietinum
acgcggggacagattggtgggttaactgattctgtttttcttttttccattatcaaaagaaaccatattttcacagaactcttatatatgcatcgagcacaatagacaataaattcatttgatcacaagacatgtccttattcagtgcatttttatttgtagccctcttcaacctcttcactacactaccatttgcatttgcagaggttgttgtttcacccattgttgatgtttcaacactcaatcgaacaagttttccaacaggtttcatttttgggacagcatccgcagcataccaatatgaaggtgctgcaaaagaaggtgggagaggtgcaagtatgtgggacaacttcactcatcagtatccagataagataaaagat

SEQ ID NO: 5637 - DNA, 238 bp, Cicer arietinum
gcagagagaaaagtttaattaactaaatacaattttacaagcgaatatttggacatctagtctagctacacagcatttctagaagatgaaaaggcatctaatcatctatactgggaattaagtcttatttacaataataattataaaaaagagccaacttgtaatttaaacacgagattgacaagatggctgataacgagagagtatataaattcggacaccattaaacaaaaaataa

SEQ ID NO: 5638 - DNA, 172 bp, Cicer arietinum
actttgaaattcatgcaagttttgtgtctggtgtgttgttcctgaatcaaatcgaagaaaagaatttgattaatttttcttcttttgtgtgtttgggaaaaatggatttggggatttctgatgagatgttagggacttttgttccaattctagtttattggatttattctgg

SEQ ID NO: 5639 - DNA, 310 bp, Cicer arietinum
acttgatttgaattacaccgtgaaagtgcaacaggaggcctttggttccttaagtattgaccaaaagtgttccaatctctcctcttttgagattcatatctactcaaaggcggcggctgctgctgtgagtgctgaggaggatgatctgctgatgatccttcagctatatcttttcctttggaggacatatcttttgttactgattattcatttggtgtgtttttttgaagaaaaaaagaaaggaaaggtttttctttgagggggtgaatgaataaggtaattgaatagaagtggaagaatatccccgcgt

SEQ ID NO: 5640 - DNA, 431 bp, Cicer arietinum
acctatcctgatttctactttaaaatcactaacagtgaacacaaagttgaactcaaagagaaattccaacgcatgtgtgataaatctatgatcaaaagtagatacatgtatctaacggaggagattttgaaagagaatcctagtgtttgtgaatacatggcaccttcattggatgctaggcaagacatggtggttgttgaggttccaagattagggaaagaggctgcagttaaagctatcaaagaatggggtcaaccaaagtcaaagattactcatttgatcttttgtacgcggggggatgaatatggcataaaatttgggatgccaaccaaacaactagtaatcagaaggctaacatgcatttcaccatacagtgcaaccatagccttgggaagtgaaatgtcaggagggatacaagatgttagagctga

SEQ ID NO: 5641 - DNA, 427 bp, Cicer arietinum
acccttctgttaacagctgcttcaaagaggatgcattggagctcatccttaaaggttcgcacaacatcggaattgccatggcgacaccacacggtctagttgtgccgaacataaaaaatgttcagtctctttccatattggagataaccaaagagctagcaaggttgcaacaattggcttcagataacaagttaacttctgaggatatatgtggtgggacaatcactttgagcaacattggagcaattggtggaaagtttggttccccgcttctgaatcttcctgaagtctccattattgccatcggtcgaattcagaaagttccgcagtttaccgatgatggaaatgtttatcctgcatcgctcatgactgttaatattggtgctgatcacagagtgttggacggagcaaccgttgcaagattttg

SEQ ID NO: 5642 - DNA, 399 bp, Cicer arietinum
actagttgagtgcttggatgatgttgatgcggagtcacttaaaagtgctgcagaatatttaatggaaacactagcagatccagcagctattgtcctggggtcatgtccaggtgaagggaaggttagtctagtggctgcttttactccaggggtggtggatcaagggattcaggcaggtaaatttattggacagatagcaaaattatgtggtggcggaggtggtggaaggcctaatttcgctcaagctggtgggagaaagcctgaaaatttggctggtgccctcgagaaggctaagtcagagcttatagctaatctttgtgaaaaagggaactgagtccacagatacttggcaaatattttaatgttaattaacgcaatagataatattgattctttgtt

SEQ ID NO: 5643 - DNA, 322 bp, Cicer arietinum
actctatgcagttgaatgcttcacggttaaaagttcttcaagctcaagatgacgtggtcaataaaatgaaagaggctgcacataaagagctcttgaatgtgagccgtgaccatcatgtgtacaaaaaccttataaaagatctcgttgttcagagtttggtgaggctgaaagagccttctattatattgaggtgtcgggaagaggacctacacttggtagaggatgtgttggaatcagctgctgaggagtatgctgagaaggcaaaagttcatctaccagagattgttgttgataaggatgtctatcttccacctgcacccaa

SEQ ID NO: 5644 - DNA, 424 bp, Cicer arietinum
actcgggataccaggtgggctatgttgggagcattgggatgtgtgttcccagagcttttgtcccgaaatggtgttaaattcggtgaagctgtatggttcaaggctggatcacaaatctttagtgagggtggacttgactacttgggtaacccaagtttggtccatgctcaaagtatccttgctatatgggctacccaagttgttttgatgggtgctgttgaaggttaccgtattgctggtgggcctcttggtgaggtcactgacccactctaccctggtggtagctttgacccattgggcttagctgacgaccctgaagcttttgcagaattgaaggtcaaagaacttaagaacggtagattagccatgttctctatgtttggattctttgttcaagctattgtcactggaaagggtcctttgg

SEQ ID NO: 5645 - DNA, 431 bp, Cicer arietinum
acagttccaatttcagtaaaaacatggaagaatacacagtgtatggagggcttggattggacaaagataaaaacattttgttcgactggagaaacttcaaatgttgatgatgacctttggctttcttcaaaatcttattacaaacccataattgaatgttgtgggggcactgagctgggatctagttacatcatagggagtctactacagcctcaagcttttggagcatttagcactgcatcaatgacaactggtttggtcatccttgatgaaaatggagttccttatccagatgatgttccttgtgttggtgaagtgggcttatttcctgtatatatgggagcaactgatagattgcttaacgccgataatgaggaggtctattttaaagggatgcccctttacaaaggaaaggttcttaggagacatgg

SEQ ID NO: 5646 - DNA, 150 bp, Cicer arietinum
ttggtttcatgggattatcaaaatgactacttgtaaggatggcttacgtctgcttaatacacactggttagtagctggatccgagaactgtatgaggagacctttagacttcgctcactaaatacttccttaatgctatcttgaaagtac

SEQ ID NO: 5647 - DNA, 157 bp, Cicer arietinum
acaaggagcattatgagagcattgagatccccaagtttgttgacacagtaactcctcagtataagcccaaatttgaggcactgttgatcgagcttaaagaagcagaagagaaatctctgaaggagtctgagcgtttggaaaaggaaattgctgatgt

SEQ ID NO: 5648 - DNA, 436 bp, Cicer arietinum
actttactgcaacatggtgtggcccttgtcgctatatttcgccactttatacaagcttggctgagaagtatcaaaaagtggtttttttaaaagttgacatagatgaggcagtcgatgttgccgcacgctggaaagttaacagtattccaacatttttctttgtaaaaaatggcaaagagatagacagtgtggtgggggcagacaaaaatacacttgaaaggaagattgctcaatactccagccctttttaagtttttagtattaccttatttaaacttcgatacaataatttttccatgctgtttcttctgtttacatgcccatagtgtcatacaaaacccagagtttcaatgtatcggtttgatgtttcttctacctgcttgtgtataaaatgttcaacttttcaatccgattttgggtttataactgtaacgag

SEQ ID NO: 5649 - DNA, 118 bp, Cicer arietinum
acttggatgagaagactatctttcaccttaacccttctggccgatttgtcattggaggtccccatggtgatgccgggctgaccggaagaaagattatcattgacacttatggtggatg

SEQ ID NO: 5650 - DNA, 431 bp, Cicer arietinum
acacgtgctcctatggagagttggatcaattgcttctactacttgaggaactaaatgatacagtctattggaatgatgcttgctgcagaatcatcttgtgttgtatttggaatgagcatttaagttctgctattgacttgtgtaagctcctcaaggataagttacaagatgatgaactggttatgaaagttctatttgataaggtattttctctaattgaggagtcagagtccaatcatttgcatacttgcatggtgttgctttcagaaatcaaggataagcacggccttttgccttcacaaaaatgttatgattctctgctggttgcttgtgaaaacgccaacaataattcacatgctgaatgaggctccttaataagaggagtatatgtagtgttcttcattacttttctacaaacaacaataggtgct

SEQ ID NO: 5651 - DNA, 443 bp, Cicer arietinum
accttgcaatgggagtttttattggatcagcagttattcctattgcttttatgcttttatggagaaaagcaaatgcaattggagccattcttggaacaatatttggttgtgttcttggaataatcacatggttgtctgttacaaaaatagagtatggtatgataaaccttgatacaactggaagaaatgcaccaatgcttgttggaaaccttgtttcaatactaacaggtggagctgttcatgccgcatgcagcatgttgtggcctcaaaactatgattggagtatcaccaaacaaatcacagtggttgaaaaggaaaagactgaattgccagctgaagagtttagagaagaaaagttaataagggccaaagtgtggatagtgaagtggggtgttggcttcactgttttgatagtcatattatggcctattctttctctccct

SEQ ID NO: 5652 - DNA, 390 bp, Cicer arietinum
acaacgttttcaaaaacaccccatagaccgtgcgtgtcttccgtttccctaaacaaaatctcctcgtagctgaaatgagctagcaacacacaaagtaacatctttcgaagtgaaacgtttgatttgggttagtgggtcagtttcaagttttgattttgttgacgtttttctctgatcgattgagaaggtatagaaaatatacttttggagctgattggtgggaaggttatggcttttgcccaatcttttgttgtggaaatggttcggatcgcaaaggacgtgggaagaaacaacctccgtggcgagtgttttctttgaaggaattacactcagctacaaataatttcaactatgataacaaacttggcgaaggtggatttggaagtgtgt

SEQ ID NO: 5653 - DNA, 427 bp, Cicer arietinum
acgcgggcgacaatgccaatgaagcaaaggtatcattacaatgtagcggatggaagattagcgcaacatgtagagcgagggattgcagacggccttcttattagttgtgtggcttcttgttcgaatctctgggcacttatcatggatgctggaactggttttacgaatcaagtttacaagttgtcaccttttttcttacacaaggaatggatcgtggagcagtgggagaagaactattacattacttcgatagccggggttactaatgggagctctcttgtggtgatgtccaaaggcacacagtatacacaacaatcatacaaagtaagcgattctttcccattcaaatggataaacaagaagtggagagaaggatttcatgtgacttcaatggccactgctggaagtcgttggggtgttgttatgt

SEQ ID NO: 5654 - DNA, 318 bp, Cicer arietinum
acttagagcatatactcttgattggttatcccacagtcctactgatatcgagagctacatacggcccggttgtattgttttgactatttatctgcgtcagactgaggctgtgtgggaggaactttgctgtgatctgagttccagtttgagtaagctgctggatgtctcagatgatgtgttttggagaactggatgggttcacatcagggtgcagcatcaaatggcattcattttcaatggtaaagttgtcatagatacatcactaccttttagaagtaacaattatagcaagatttggactgtaagtccaattgttgt

SEQ ID NO: 5655 - DNA, 427 bp, Cicer arietinum
aagcagtggtatcaacgcagagtacgcggggacacaaacaagctagctacttgttaataatatcttatttctcacactagcaatattcttaattcatcatcatgggtgttttcagttttgaggatgaggccacctcaatcgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaa

SEQ ID NO: 5656 - DNA, 436 bp, Cicer arietinum
actatgccaatggaatttgataagccattggctctagtgaaggaatttctgaaaccaccagatgctcgaatatgttcttgtagcaaataacatgcaatcacaaggcacacaatcacccccacgatgtcgtctctaaaggtgcttgcaattacattaggagctacaacgatcagaagcaccaaagcacctggcaaatccagccattcagggaaatgttttggaataaaaagccttaatacaacagcaactaaagcaacccattttccaatctctcccctgaagacaccgaaaactattgaaggcaagctgaagaaaatgtatggaatgagtagtgatgtaagaatgttagtcttccagtttgtgcgatccaaaaccagcatatagatagcagcaatggcggcaaagaatccgaagaaagaagctccaaagccaaagc

SEQ ID NO: 5657 - DNA, 459 bp, Cicer arietinum
acgcgggggagccaaagcaaatcgatctacgagattgcttgaactgagctcctaaatcatatcatagtttgcaggctctgtaaaagaagataaaatgaacgccctccgctcgttttggaacagtcctctgggcccgaaaactactcatttctggggtcctaccttaaactggagccttcctcttgcggcagcgatggacacaaagaaacccccggaaacggtatcagtcaatatgactgcagttatgtgtgtctattcggcactgttcatgagatttgcttgggtggtgaacccgcgtaacgtgcatcttatggtatgccatgtatccaatgagacagtgcaattgtatcaactctcaaggtggattagagctcataggggcactcagcagaagaaagatgacaaagatgaatgaaatataaagacttttatcttgtgaatttttttttaataaaactt

SEQ ID NO: 5658 - DNA, 166 bp, Cicer arietinum
ggcagcaggctaccaccaaagggcagtggtagtgaaactgtgcgtatggctcgaacactcattgctgctcgtcacgcgggtgaaaggcttttgagatgctggggtgggggaactggatgggctgtggaggatgctaaggacaagatcatgaagctcttggaggggt

SEQ ID NO: 5659 - DNA, 360 bp, Cicer arietinum
actagtgctagcttagagccttcttatgttttgagggcattgggagtggaagaggatatggctcatacttctattaggtttggtattgggaggttcactaccgaggctgaaattgatagggcggttcatctcacggttcaacaggtcgagaagctgagggaaatgagtccactttatgaaatggtgaaggaaggcatcaacatcaaggatattcaatggtcacagcactgattattgagtgcagcaagcatggaagctaattgggaatgccttggctattattgatgtcatgggacattatggtatcttggagaatgttattccttcatcaagtctccaactaatgttataccttgaagt

SEQ ID NO: 5660 - DNA, 318 bp, Cicer arietinum
acaagattttccccagagagacaacttgacgtctacggcttctgttgagaaagtagtcacggccgaaccaaaaaagatcgacagacaggtgaaagtcttctttgctgtcactgaaagtgttgcagctaaaattgagctaccagattccttctacaaactttcagttgacgaggcgagaagagacgctgaactaaggagaaaaaggattgaagagtctcagcttttaatccccaagtcacttaaagaaaagcaagctaaagctgcaaggaggagatacacaagaactattattaggattcagtttccagatggagttgt

SEQ ID NO: 5661 - DNA, 400 bp, Cicer arietinum
acaaaaaaaccacttcttcatctttcttcaattcaccaaagttattcacacaaaaaggttttcatgaaacagaaaccatgatgatgagtcctacttcaatactcgacagtaagaacttttctggtttaaagaaccccttttggtctgaaacaaacagtcccagaacaccaaactgtggtgaacacaaacgttgttgggataaattggattcaaaaccggttggccttggccttgttgatgttcttgtagacgaaaaaaatggtgaagttaattcaaaactagaaaacagaactgttctgtttggatctcagttgaagattcagattccacctttttcaccaacaacaatattttcttcttcatctgaatcagaatcaactttttcaagaggtgaattcag

SEQ ID NO: 5662 - DNA, 435 bp, Cicer arietinum
acaagagttaggaccagttttcatctaagttagcaaaatctaaaaaagagtatcatagtgtgtggaagaatggagagggaagaagatgtgaaaattggagcaaacaaattctcagaaaagagtgcattaggcataggagctaaaagtgacagcaaagactacaaagaagcaccagcagcaccattgtttgagccaggggagttgaagtcatggtctttctatagagctggaattgctgagtttgttgccacattcttgtttctttacatcagtgttttaactgtgatgggtgttaacaggtcaacttctaagtgtgcctctgttggtattcaaggtattgcttgggcttttggtggtatgatctttgcccttgtttactgcactgctggaatttcaggtgggcacataaatccagctgtgacctttggtctattt

SEQ ID NO: 5663 - DNA, 432 bp, Cicer arietinum
acacgtgctctgacggagagttggatcaattgcttctactacttgaggaactaaatgatacagtctattggaatgatgcttgctgcagaatcatcttgtgttgtatttggaatgagcatttaagttctgctattgacttgtgtaagctcctcaaggataagttacaagatgatgaactggttatgaaagttctatttgataaggtattttctctaattgaggagtcagagtccaatcatttgcatacttgcatggtgttgctttcagaaatcaaggataagcacggccttttgccttcacaaaaatgttatgattctctgctggttgcttgtgaaaacgccaacaataattcacatgctgaatgaggctccttaataagaggagtatatgtagtgttcttcattacttttctacaaacaacaataggtgctg

SEQ ID NO: 5664 - DNA, 191 bp, Cicer arietinum
actagttgtgacacagatctttggggtaagagaatcaccaaagtcaagcttccaattatggtaatacgggagagaaggtgaggaagaacgagcaaggttaagacaatcagatgaacgagaatgagagagaggggagagatgagaagagcccgtgccatgtaaacgatgagagccatgaggggataaaaggg

SEQ ID NO: 5665 - DNA, 436 bp, Cicer arietinum
acctgctaagatattatacttaaattgcctactgttataggtttcgcagaaaaccagctatcctggtcagtattgtctttcactacacctaccataattcttcggatatttatgctacaatattccgttcggacttttataatcctgattatggtaaaatcaccaggcttcgggtctaactttagatacttaccgttattttaacgctcggtttaactacgtatgtatgggcaaggcctcctactcgcatctaatgttaacttggtgacccattatgcaaaaggtacttctgccattttcagtccatactccaaaatccatgcccacaacaaagaatgcatagccatccaaatggtaggtttggactgtggtgtcattgttttgaaagattatttccataaaacctttgtgagtgccattaatgagagacacatca

SEQ ID NO: 5666 - DNA, 101 bp, Cicer arietinum
actgtaatatacatgctcaagtaagagtagatgtaactcaataccctgaaacttgtgtttattcttgtgattctctctaaagtttgaactacaacttaatc

SEQ ID NO: 5667 - DNA, 222 bp, Cicer arietinum; identical to SEQ ID NO: 5592

SEQ ID NO: 5668 - DNA, 391 bp, Cicer arietinum
acaatgatatcgcctgcacgaacaacagtcttggatccatcagccaaaaccatctctaactccccctcaaacacaattccatagtcaagcgatgcagtcctatgattgtgccctgaggaatttggtggaaagtcgacgactcgaattagtgagccgggcgtatagattactggatcggtgccgacaggatctttgtcaacgagctcagctgggtacttgtcgtttctccagatagtgactgcattgctgccaaagccagaggtgagtttgagctcttcatctgataggattgcagagttctggcccttgtggtgggtgacaacccttctcagaggactaccagcgttgagacccatggtgtctgaaactgaggttttgtgaatccccgcgt

SEQ ID NO: 5669 - DNA, 190 bp, Cicer arietinum; identical to SEQ ID NO: 5063

SEQ ID NO: 5670 - DNA, 113 bp, Cicer arietinum
acagaaaacgttccagcatgtatacggctccgacgcaagaggccttgcagatgatccgagcgagaatcagcagggcagcgattgtagatagtttagctcagcacgtcctgtgc

SEQ ID NO: 5671 - DNA, 128 bp, Cicer arietinum
actagttcccgccagaagttttttagaaccgtatacgtctgatagactaagaaagatatttttaaactcatcctttgatttgagagtctcaaagtagaactgatagtccacccaatcaatataatcat

SEQ ID NO: 5672 - DNA, 120 bp, Cicer arietinum
actcttttttctatttgtcactaggatagtttcattgcatactttcttttaagtttatgaagcaaattgatgtttaggtcatgtttcaaatatttgctatagaatatggttttatttgtg

SEQ ID NO: 5673 - DNA, 102 bp, Cicer arietinum
aggaagaattcagttgttgattgttattcttctattcaagaatcatcaaggtcttttatacttgagtcatccttgagttctcgaatcttctatgtattatta

SEQ ID NO: 5674 - DNA, 297 bp, Cicer arietinum
acgcggggaagataagtgtgatatatatgactttggagtaatactactggaactcattctaggaaggacaataaagacaacaaatgatgcagaagcttttaaggatctgttgcaagcaagcttaggagctgatgaggacgctcggaggagcattgttgatcaagcaattcgcaaggcttgcttggatcaatcattgaagacaatgatggagatttgtgtgaggtgtctgattaaagagccagcagaaaggccatccatagaggatgttttgtggaatttgcagtttgctgctcaagt

SEQ ID NO: 5675 - DNA, 154 bp, Cicer arietinum
acgcgggggatcaacaaaggggataaaaaagagatcaaagtaacatatatttcaagtcccgtgaaggtgaagactaatgcttcaaattttagagctcttgtgcaagagctaactggccaagactctaatgttgcggaaattacgactatgccct

SEQ ID NO: 5676 - DNA, 438 bp, Cicer arietinum
acaattgacagtaataagcaggaaaaaatcgacgctgtggaaaacgaaggagctgagaaagtgagtctcgatgttgaagatattaacggtaagaccgaaattaacgaaggagctgagaaagcgagtctcgatgttgaagatattaacagtaagactgaaattaatgaaggagctgagaaagcgagtctcgatgttgaagatattaacagtaagaccgaaattaacgaaggagctgagaaagcgagtctcgatgttgaagatattaacggtaagaccgaaattaacgaaggagctgagaaagcgagtcttgatgttgaagatattaacggtaagaccgaaatttcagcaagtgatgaaaaagaaaccattcaaggtgaggagcaagtaaagaaaatggttgacaatgaaagtgttatttggagcagtgcacaatgaagt

SEQ ID NO: 5677 - DNA, 284 bp, Cicer arietinum
ggagcgggattttctacgggctactcggccacacaatactgcggggacgccatcggctccctaacagcagttttcagaggaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggtctctgattccttcccaaggtt

SEQ ID NO: 5678 - DNA, 435 bp, Cicer arietinum
acacaacaaacaaaaagttccgaacagtaacggagcaacttccgcgccacatcacgcttagaacgtctcttctctccacacgcttgggtcccacgcgaatgctcgcgagtcgagtgatgtttatctaagggccccacctcacagtagccgtcgcggaacggttaccaaccacgaatactatcgcgacacgtggatttccgattcatctacaccccacgactcagaacgcctcccagacgtgaaccgcatcatcccacccaaaccggccggttcactctctgaaacgctatttctcgataccgattccacaaacgacacgtcgttcacactccccgtgctgttccgcgctttcgaattactcacgctgttcgtgttcgtcacagatgaatcgaacgccggataatcggttctatgatccgggttatttcttcgacc

SEQ ID NO: 5679 - DNA, 433 bp, Cicer arietinum
caccatttcattgttgccgcggtaggggtagaactaaattattcgggatgggtagggttatcagggcacaacgtaagggtgcgggatcagtcttcaaatcccacacccaccaccgtaagggaccagccagattccgcagtctcgatttcggtgaaagaaacggttacctcaagggagtaatcaccgatatcatccatgaccctggtcgtggtgcacccctcgctaaggtctctttccgtcatccttttaggtataagaaacagagtgagcttttcgttgctgctgaaggaatctacactggacagtttatttactgtggaaagaaagctactcttgttgttggtaatgttttgcctctcagatctatccctgaaggagctgttatttgcaatgttgaacaccatgttggtgaccgtggtgctttcgctaggtg

SEQ ID NO: 5680 - DNA, 434 bp, Cicer arietinum; identical to SEQ ID NO: 818

SEQ ID NO: 5681 - DNA, 139 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcggga

SEQ ID NO: 5682 - DNA, 420 bp, Cicer arietinum
acttgggtcacatcagaggcatactcatctccctcaattgtcttggctgcaaggggtgcccatggccaaagggtcatctttgatgattatcgtgaggcttacttttggcttcgccagaacactccaccagatgccaaggtgatgtcgtggtgggattatggttatcaaatcactgccatgggaaacagaactgttattgttgacaataacacctggaacaatacacacatagcaactgttgggcgtgcaatgtcatcttatgaggatgaggcttatgacataatgagatcgcttgatgttgactatgtattagtcgtgtttggtggtgttaccggttattcctctgatgatattaataaatttctatggatggtgaggattggtggcggagtttttcctgaaataaaggaacccgattac

SEQ ID NO: 5683 - DNA, 398 bp, Cicer arietinum
cctctcttcacacacacaacgcaacccaataggattattatcgaatcgaaaaatggcggcatcggattcatctcgcgaagagaatgtttacatggcgaaattagcggaacaagccgaacgatacgaagagatggttgaattcatggaaaaagttgcaaaaacagttgaggttgatgaactaacagttgaagaaaggaatcttctttcagttgcttacaaaaatgtgataggtgcaagaagagcttcgtggagaataatttcttcaatcgaacagaaagaagagagtagaggaaatgaggatcatgttgctgttataaaggaatataggtctaaaattgagactgaacttagcaaaatttgtgatggaattttgagcctacttgaatctaatcttgttc

SEQ ID NO: 5684 - DNA, 222 bp, Cicer arietinum
accaggtcgtccggagagctcttcctacggaatccgatgaacacccgaagatttatcgtatgaagctttgggctaccaacgaagttcgtgccaagtccaagttctggtatttcttgaggaagctgaagaaggtgaagaagagcaacggccaagtccttgctatcaatgagatttttgagaagaacccaaccaagattaagaattatggtatatggttgaggc

SEQ ID NO: 5685 - DNA, 326 bp, Cicer arietinum
acgctgattctgatgataagaaagttgcacacaaagctgtttctgttaagaaacattattggaaatgggttagtgctgattatattcaaccttgatgtggtttttttattctatgaaacacacaccagacacaatgttcatatcgataataatatgagaaaatataagtgattgaatataattacagtatgtgtcttaacccttcaatgtgaagagttggtgttacataggtgttttctttttttagtatttaatctgacattttttttgggcggggaggatgcttggttatgtttgtatacatatggatagtggtgtagtacctc

SEQ ID NO: 5686 - DNA, 302 bp, Cicer arietinum
actgttatgatcttatgattcaaattaactgtatttatccaagatataagagattggttatataattcttttccaatgagaaaaaaaaaaaaaaaaaaaaaaaaaaagcttgtagcaagactaacagagggatgctcttttaggaagaagggagattaaatggtgtgtaattttactttgtccatggatggagagtttttcttgagaggcttaaaaatggaatcaatgttttttcatattttagtttccaatgtattaaattgtaagacttgatcccacaatctttttccaagaaccttaat

SEQ ID NO: 5687 - DNA, 231 bp, Cicer arietinum
acttggaggaggacgattcatcactcatgaaaacatttaagggtgcaacaactggtttggttgctggcactttctggggttctgtggttgccacctggtatgatgttcctcgtgttgagagaagtgttgctcttccggggctgattagaactttaaagatgatgggtagctatggtgccacctttgctgccataggaggagtctacataggtgtggaacagttggtgcaga

SEQ ID NO: 5688 - DNA, 435 bp, Cicer arietinum
acaggaactattgaaggcaatggagatcagtggtgggatctcccctgcaaacctcacaggggtccagatggaaaaactttgtcaggaccatgtggtagtccagctatgatacggttcttcatgagctcgaatttgatggtgagtggactgcaaattcaaaacagtcctcaattccacatgaaattcgatggctgccaaggagtgttgattgataggctaaccatctctgcacctaaactcagccctaacacagatggaatccatgttgaaaactcacaggctgttggaatatataactctatgataagcaatggggatgattgtatttcaattggacccggaacctcagatgtggacatagctggtgtcacttgtggtcctagccacgggattagcataggaagccttggtgtgcacaactcccaagcatgtgtt

SEQ ID NO: 5689 - DNA, 438 bp, Cicer arietinum
ctcttaccaatttgcacctaaccactcctgatacatttgactctgcctactattccaatcttaaaattcaaaagggattgtttcagagtgaccaagagttgttttcaaccagtggtgcagacactattgacattgtcaatagtttcaatgacaaccaaactcttttctttgcaaactttaaggcctctatgattaaaatgggtaatattaatgtgttaactggatctcaaggagaaattagacaacaatgtaactttattaatggaaactctgttgaccttgctactactgtgactagagagtcgtcagaagatggcatcgttagttcatactaagtaatttaattagcaaaagtaaggaacctaataaagattaaagagtgtggtctatcttctagaggcatatacatgccctgttcttgtggtggatggtgatagg

SEQ ID NO: 5690 - DNA, 436 bp, Cicer arietinum
actgttctgaaaataataagaggcttattcatttctctacttgtgaagtgtatgggaaaacgattggtagttttcttccaaaagatagtcctcttcgtcaggatcctgcatactatgtgcttaaagaagatgtgtctccatgcattttcggttcaatcgaaaaacaaagatggtcgtatgcatgtgcaaagcagttgattgagaggctggtttatgctgagggtgctgaaaatggcttggagtttacaattgtgaggccatttaattggattggacccagaatggatttcattcccggtattgacggtccaagtgagggtgttccacgtgttcttgcatgcttcagcaataaccttctcagaggagaacccctcaagcttgtggatggtggcgaatcccagagaacctttgtttacatcaaagatgccattgaagc

SEQ ID NO: 5691 - DNA, 437 bp, Cicer arietinum
cattttctacagaacctctagcaagaagaaacgcattgagaaatagacggtgacagagtgatagagagagagagatttcgcaatttcacaaaccctaatttcaaagagatcggcgatggcttcttctaaggatcgtgaaaacttcgtctacatcgccaagctcgccgagcaagctgagcgatacgaagagatggtggattcaatgaagagtgttgcaaatctagatgttgaactgaccgttgaagaaaggaatttgctttctgttggttataagaatgtgattggtgctcgcagagcatcgtggaggattctgtcttccattgagcaaaaggaagagacaaagggaaacgatgtaaatgcaaaacggattaaggagtataggcataaggttgaatcagagctttcaaacatctgtaatgatgttatgagagtgattg

SEQ ID NO: 5692 - DNA, 435 bp, Cicer arietinum
cgcaaggaaacatcatggtaggacagttgagggcgacaaaaccaagtcgaagcgacgaggttttggacagcgaggaacaagtgaggatcacaaatcagatcaaagctcaattcgatgctttaaaacctaaacgacccattaaacccaacagaagcgaacctgaaactcaaaaccccgttgactcaacactctcctcacacaacataccagagcttcaaaaacttcaatctcttcaatctattaattctctcgctatactttcctcagagaatttggtggatccgcaagatgagtttgtggagactcactattacaaggagttgttgtccattgataaacagcatcatgcgacgggaagtgggtttataaaagcggtgagagaaggtggtgaagatggatatgagattaagttacctgcaagctatgttgatgttg

SEQ ID NO: 5693 - DNA, 327 bp, Cicer arietinum; identical to SEQ ID NO: 5435

SEQ ID NO: 5694 - DNA, 405 bp, Cicer arietinum
acaacactcttcaattgcattatgaatggaaaggccaatctaaaactggttttaatttcaatccctgcagcaataaaccgctttcgcaaatttaattattaaatctaggcgtatacctgctctaaataaaacaacaaagctgccacctctgcgggcaacattacaaacaattgttttgaatttgcaaaatttgagttggttctaaatggaaaatccagcaagctgtcagaaaaacatgacatgtttcattactgggaggctaatttgattcccttctcaatagatgatttgagttcagacttgaggttttcaaggccttgttgctcgaaatctgagagaggacctaagccaagaatttcctccacaccattcttcccaatcctcaccttggaagcgaagaaagga

SEQ ID NO: 5695 - DNA, 206 bp, Cicer arietinum
agggtcttatatttgttgtagacagcaatgacagggatagagttgttgaagccagagatgagttacataggatgttgaatgaggatgaacttagagatgcagtattgcttgtgtttgccaacaaacaagatcttcccaatgcaatgaatgctgctgagattactgacaagctgggtctccactctctcagacagcgccactggtac

SEQ ID NO: 5696 - DNA, 396 bp, Cicer arietinum
actgcattggctcatctctctgcttatgtcccagcaatcaaggagacgcttgaagatgctgatgagaggctaggagctgacattgtgcaaaaggcacttgtagcacctgcatcattgatcgctcaaaatgctggaatagagggtgaagtggttgtggagaaaatcaagaatggtgaatgggaggttggttacaatgccatgacagacgcctatgagaatttagttgagtctggagttatcgaccctgccaaggtaacaaggtgtgctttgcagaatgctgcttcagtcgctgggatggtcttgaccacacaggccattgtggttgaaaagcctaaacccagggcacctattgctggttccccacaaggccttactgcttaagttttagatcaataa

SEQ ID NO: 5697 - DNA, 144 bp, Cicer arietinum
cacatttctcatctctgataaggatgcaataaaagacgattattttaaaggagccctaaatagaaatttcacacagccactaaaggtgaataacaagaataagataacgtcgacaacggtggaacactgaaaattcccttaata

SEQ ID NO: 5698 - DNA, 279 bp, Cicer arietinum
ctcttaccaatttggacctaaccactcctgatacatttgactctgcctactattccaatcttaaaattcaaaagggattgtttcagagtgaccaagagttgttttcaaccagtggtgcagacactattgacattgtcaatagtttcaatgacaaccaaactcttttctttgcaaactttaaggcctctatgattaaaatgggtaatattaatgtgttaactggatctcacggagaaattagacaacaatgtaactttattaatggaaactctgttgacc

SEQ ID NO: 5699 - DNA, 453 bp, Cicer arietinum
acacaagaagactccggtgctagttcatgatggaaaacccatatgtgagtcaatgatcattgttgaatacattgatgagatatggccacaaaactcattgcttccagctgatccttatgatagagctcaagcccgattttgggttaaatatatcgatgaaatgatttcgacactttcagcaatcattcgtagcaaaagtagtgaagaccgagagaaggccaaagagaatctatgggaacggctaggagttgttgaggatcaatgtttgaaagacgaaaataaattttatggaggagacaacattaacattgtagacatagctctcggatcttttgtcaaatttattgaggttttggaaaatacatttgaagtggaaattttgcaaactgagaggttcccccatttgcatttatggtttaataatttcaaggatgttcaagtcatcaaagaaaa

SEQ ID NO: 5700 - DNA, 301 bp, Cicer arietinum
cttttttggccgcaggaaccctaagatcaggagcgatccgagacagaactactctttcatcatgttggtttaccaggatctccttaccggtgatgagcttctctcagactctttcccatacaaagaacttgcgaatggagtcttgtgggaagttgaggggaagtgggttgtgaaaggagcagttgatgtagacattggtgcaaacccttctgctgaaggtggagaagatgagagtgttgatgaccaagctgttaaggttgttgacattgttgacacattcagacttcaggaacaacctgct

SEQ ID NO: 5701 - DNA, 140 bp, Cicer arietinum
aagaagatcttatatttaaagacaaagggactggtttcaatgacatcatgcataacaaagcataaaaaacttgattaaaagacctattacatttcacaagtttgtgaaaacctttcctacaaaaagcacaaagtttggca

SEQ ID NO: 5702 - DNA, 459 bp, Cicer arietinum
atcatacctagggatttttcggcggcaccatcttcttcaacaaggaacacaaaaagtagagtcttttttattgaaatccacaatcaaatatgtctggtgaagaaggtgttgttgcagtcgaaccagttgttgctgctgcggctgctattcctggtgagccaatggatatcatgactgctgttcagcttgtgctgagaaagtcccgggcttatggtggccttgcacgaggtcttcatgaaagcgcaaaggtgattgagaagcacgctgctcaactctgtgttctagctgaagactgtgaccaacctgattatgtcaagttggtgaaagccctttgcgcagagcacaatgttagcttattgactgttccaaatgcaaagacccttggagagtgggctggtttgtgtaagattgattcagagggtaaagctaggaaggtaactggctgctcctgcgtggttg

SEQ ID NO: 5703 - DNA, 435 bp, Cicer arietinum
actgatttagtatttacaaaagggcatctcacaatgccaggggaagaggaaaagagttggatcagcagggccactaaaaataaccttttatctcaaaagatggttaggaaaggaaaaaagggaacccttatgctataatacatttaaggcaggacaaatgatggaatatattctaagtaataaattctaaacagatagctttacatgaaatagctcaaagatgtcttttttctcgagccaccttctccatagaggtcattccattggagtagttcgttcatatttgttgactcggatgatacgctcgcacacacctgctcatgtgcatatctaaaatcttccatctttaagggccgaatgtcggcactgccacacagttcaggtataggtttgttctcagccaacgctaagcttttctccttcttttccttctcc

SEQ ID NO: 5704 - DNA, 184 bp, Cicer arietinum
actattaattaccagcagaacagactgctttacaactgtcaaaataaataaaaagctaaaatacataacagcttaaagaaattagagaaaaaaaacacaataacaatcttatcaccatataatagaaaaattaacgccttttctttcctgaagacaaaacgcggaaactttgcttccctttttt

SEQ ID NO: 5705 - DNA, 297 bp, Cicer arietinum
aggtacacaaatgacactggagaagttgtcaagggagtctgctcaaatttcttgtgtgacttgaagcctggatctgaagtaaagattactggaccagttggtaaagaaatgcttataccaaaagatcctaatgccaccatcatcatgttgggaactggaactggaattgctccatttcgctcatttttatggaaaatgttcttcgaaaagcacgaagattatcagttcaatggtttggcatggctcttcttaggtgtccccacaagcagttcattgctttataaggaggaatttgaa

SEQ ID NO: 5706 - DNA, 311 bp, Cicer arietinum
acaaagactacccatattcaaacagcaaaaacgtcggtcacaggcccaatgagggacctaactacagaaaactgaatgataccaaactatcatcattcataccaaatgcgatattgcaaagtgatttgagtatcatcaaaggcttcatataaaaaacctcctccaatgtttggagtgtcagaggctagaagcaaatgatctattgttcagcagaggcataaaaatatcacatcgaggtcaagattaattatcaggattaagcttcagttcctgcttcctttatttggattgatgtcttggctaaacttgct

SEQ ID NO: 5707 - DNA, 293 bp, Cicer arietinum
actaggttgaattactattgcgacactgtcatcagtagggtaaaactaacctgtctcacgacggtctaagcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctggcacctctagcttcaaattccgaaggactaaaggatcgataggccacgctttcacggttcgtattcgt

SEQ ID NO: 5708 - DNA, 234 bp, Cicer arietinum
actaatgttgagagtggacccaaagagcctccatctttatcaagggcaaagtattgaccaattggtgtaagagcataaactctttctctcttaccctctccattaatacgaatggagcaattaagaagagagtaactggccaacacaggcaacatgcgctcgagcctatcagtcaattcagggtgttgattaggaagctgagaagcaatttcagatgcatataagcttgaacca

SEQ ID NO: 5709 - DNA, 283 bp, Cicer arietinum; identical to SEQ ID NO: 4931

SEQ ID NO: 5710 - DNA, 357 bp, Cicer arietinum
acaagaacatccccttcactgtgtgggatgtcgggggtcaggacaagatccgcccattgtggaggcactacttccagaacacccagggtctcattttcgtggttgatagcaatgatagagaccgagtggttgaggcaagggacgagttgcacaggatgttgaatgaggatgaacttcgagatgctgttttgcttgtttttgccaacaaacaagatcttcccaatgcaatgaacgctgcagaaataactgacaagcttggacttcattcactccgccaacgccactggtatattcagagcacttgtgcaacttctggagagggtctttacgaaggtttggattggctttctaacaaca

SEQ ID NO: 5711 - DNA, 182 bp, Cicer arietinum
cgggcaggtacacattttgaccctcaagaaggagggttcgagctgcttctctggactcaggaagctgatcactcaactgggatgcagctacttgaatcaatttgtcaatgccatatgtctttatgccttcggcacccagttgtggaacacttcgagaaaagcacattgatgcctttgcacga

SEQ ID NO: 5712 - DNA, 392 bp, Cicer arietinum
acaatatcaatgtaacttagaaacaagaggcaaaaaccaaattcattactaatcacacataataactggaggatagtagtccctttatttgacataccaaatttattagccttcgtagtattatattaggttctttagggacaattggtggtcaacaattacaagcacacttgtattgttgagtgcattcagcaaagcccttgcctgagtctgcatcagggccttcagtcctgaaaattgaacaactccacccttctccacatttgcagaatgtttcgctgtcattgtcactactactctcaatttcaggggacacagcttcaccattaagagtgcaggtgcaattttcaccgcatttaacgaaaacttttccagcatcaggccccccgcgt

SEQ ID NO: 5713 - DNA, 349 bp, Cicer arietinum
acgcggggcgtttccagaggccaactatccaatatgagtaagcttcagagtgatgctttgagagaagccatctcaggaatcacggctgattccaaggagaaaaacaggaaatttgtggagactattgaactccagattggtcttaaaaactatgatccacaaaaggataagcgtttcagtggttctgttaaattgcctcacattcctcgtcccaagatgaaaatctgtatgcttggagacgctcagcatgttgaggaggcagagaaaataggattggactggatggatgttgaagctttgaagaagctaaacaaaaataagaaattggtgaagaaacttgcgaagaagt

SEQ ID NO: 5714 - DNA, 304 bp, Cicer arietinum
  misc_feature (68)..(68): n is a, c, g, or t
  misc_feature (163)..(163): n is a, c, g, or t
  misc_feature (186)..(187): n is a, c, g, or t
  misc_feature (225)..(225): n is a, c, g, or t
  misc_feature (249)..(249): n is a, c, g, or t
acgcggggcgtttccagaggccaactatccaatatgagtaagcttcagagtgatgctttgagagaagncatctcaggaatcacggctgattccaagggataaaaacaggaattttggggagactattaaactccagaatggtcttaaacactatgatccacanaaggataagcgtttcagtggatnngataaattgcctcacattcttcgtcccaagatgaaaanctgtatgccttggagacgctcagnatgttgaggaggtagagaaaataggaattggattggatggatgttgtagctttga

SEQ ID NO: 5715 - DNA, 427 bp, Cicer arietinum; identical to SEQ ID NO: 5641

SEQ ID NO: 5716 - DNA, 236 bp, Cicer arietinum
actacactgatcaaatcatcaaaggcctcgctttggctatgctccttgacggaaccgactcatctgctgtaacattaaagtggtcaatgtgtaatttaatgaaccatccaaagatattgaacaaggtaaaggatgaattggatattcatgtaggacaagatcgtttggtacatgaatcagaccttccaaaacttacttatcttaaaaatgtcatctatgagacgcttcagttgtgt

SEQ ID NO: 5717 - DNA, 330 bp, Cicer arietinum
acaaggttgatatgatctttgctggccatgtccatgcttatgaaagatcgtatcgattctccaatgtagattacaacataacaagcggtaaccggtatcctgtagctgacaaatcagcatctgtgtatataacggtcggagatggaggaaatcaggaaggtcttgcttctagatttatggatcttcagccagaatactctgcatttcgtgaagccagctatggacactccacactggagataaaaaatagaacacatgctatttaccactggaaccgcaacgacgacggcaagaaagtgccaactgactcattcgtattgtataaccggt

SEQ ID NO: 5718 - DNA, 401 bp, Cicer arietinum
acgcgggggagatagtagagagagttgttgttgcgtgtgtaaaccgcttcggtggtttggttccatttccatcttccaccaccaccatgccaataaccaaccaccaccacaacaacctccacacccccctccgttcaaccccatcctcctcatcttccaactctttcacctcaaagatccttctcctcctcactctcctccctgtttccttagccacaatagcattcatccttcaatggcgtggtggcataaccgatccatcaacccttttatcccctcatggctctcatcgtttacctggcacgggctcttctcatctctcccctctctctcattctcgttcatctgattgtcttaaccttgctcgttcttcctcaccttctctcccgtattaccataat

SEQ ID NO: 5719 - DNA, 404 bp, Cicer arietinum
acttctccactgtgtcccaaataacatttctagcatcaccttccaccacctccactatcacatcatttaccgatttcttaatgcaaagttgtttagcagcatcagcaactctggcagcaatctttctcaaatcagaatcaacaatgggcaaaatctcagcagctccagggccagcgagaccaacagaagaagtagcggaaggtctggcatgaaccagaacaagcctgaaagcagaactattgttgttgaaaaagtgatccagggtccatttcagagcgtatgcactgtgctcactctcatcgattgcaaccaacatcactggttgtggcttctctgactcatctgaattttttgaactcgccattccaaaaacccaattactctcttttctctttctctctcta

SEQ ID NO: 5720 - DNA, 317 bp, Cicer arietinum
accaacaaggttgctttgcaggtggcacggtgcttcgtttggctaaggatttggctgagaataacaaaggtgcacgtgtgttggttgtttgttctgaagtcactgcagtcacatttcgtggtcctagtgatactcgtttggatagtcttgttggacaagctttgtttggagatggagctgctgcattgattgttggatctgatccaattcctgaaattgagaaaccaatatttgagatggtttggactgcacaaactattgctccagatagtgaaggtgctattgatggtcaccttcgtgaagcaggactcacattt

SEQ ID NO: 5721 - DNA, 428 bp, Cicer arietinum
acccaactgatgttttcaggagagccaaaattaactccgtattagattggcatcactctaatttaagatatggagcagtgaactatgtaataaatactgtattaggacctgcacttggtcgtccactgaatccaaaagcagctgctgaagcagagaaagttttattatcttctttatcaaaactagaggatatttggctcaatggagatggacgattccttcttggcgcctttcaaccgtctatagcagatctcagcctggtttgtgaactcacgcaacttgaggttttggatgagaaggatcgggatcgaatattatctccatacaaaaaagttcttcgatggattaaagatacaaaagctgcaacaaatccacactttgacgaaatgcataatatactttatagagctaagaagaaattccaacag

SEQ ID NO: 5722 - DNA, 317 bp, Cicer arietinum
acgagaggcaattcaccagttgctgaggtggggatggaaatacaataaaaatcttgaggagcaagcttcacaactacatatgttgactgcctggtctcagattgttgaggtgtctgcatctagaagattaacaatgcttgaagatcgatctgaaattctctttcagatccttgacgcatctcttagtgcatctgcttctccagattgttcactgaatattgtattcatattatcacaggtagcattgacatgcatggctaagctgcgagatgaaaggtttatgttcccaggaagtctaagttctgacaatataacat

SEQ ID NO: 5723 - DNA, 330 bp, Cicer arietinum
acgcgggggtacacaaggtcaacatcaactccaaggccaagtcgctacgtgacttcctcgaccagcttatggcctgcacaaatatgaactgcctgacaccagaggccagtctcaagggtgactgtcaattcttgagtgccaacctttacgctaggagtgtgtttggtgaggatgctcttgctaatctgagcattgagaaggagggcgaagatggaccaatcactggtttcgtcagaataagaagtcgatcacaaggcttggcactgagcttgggctctttgaagggacttaacaagatcgggtccacggcttaggtcagctgatatacgt

SEQ ID NO: 5724 - DNA, 159 bp, Cicer arietinum
gattagcgtgtcgcggccgaggtactgaaggtggagacgaaactgctacaacgaatgatgtagaaaataagcagattgatgctcaagcttaaaaggtcttgtttatcggagagttaattaacggctgttggtttggaaacagaactgcaactctgaatc

SEQ ID NO: 5725 - DNA, 434 bp, Cicer arietinum
acttaacaaaatctacgacttccgaaagccgaattcgaatccactagtcaggttactagctaatggtcttgtaagctatgagggagaaaagtggaacaagcatagaaagataatcaaccctgcattccatttagaaaaattgaagataatgttaccaatattcttcaaaagttgcgatgatctgattagcaaatgggagaaaatgttgtcattggaaggatcgtgcgaaatgggtgtatggcctttccttcaaaatttggctagtgatgtcatttctcgaacggcgtttggaagtagttttgaagaaggaaaaagaatatttcaacttcaaatcgagcaagctgaacttacgaagcagattatgatgaaagtttatattcctggatggaggtttctaccaactacgacccataaaaggatgaaggaaattgaca

SEQ ID NO: 5726 - DNA, 161 bp, Cicer arietinum
acgcgggggaaggatttgattacgaagcgatattagggcagtgttgtgaaatgccggttggttttattcagattccggtgggtgtggccggaccgttgttgttggatggatttgagcatacagttccaatggcgactacggaagggtgtttagttgctagt

SEQ ID NO: 5727 - DNA, 309 bp, Cicer arietinum
gaaaacatgaaaatgaaacccatcaaatataaaactttaaactttcatagctggttgtcacatagcactagttgggacaaaatagacacttttcctaattagtccacatcatactatatagattaatgttatagtggaatagtagtatataatattcgttaaattttggtaagctcatcttcaaatcaacatcaattgttattacattccacataaatcaagaaactatgggttttctcgcttctttgtattcttcataatcaccattctcacttgcagttgtcttttgacggtatctgtaattgatgt

SEQ ID NO: 5728 - DNA, 349 bp, Cicer arietinum
acttcttcgcaagtttcttcaccaatttcttatttttgtttagcttcttcaaagcttcaacatccatccagtccaatcctattttctctgcctcctcaacatgctgagcgtctccaagcatacagattttcatcttgggacgaggaatgtgaggcaatttaacagaaccactgaaacgcttatccttttgtggatcatagtttttaagaccaatctggagttcaatagtctccacaaatttcctgtttttctccttggaatcagccgtgattcctgagatggcttctctcaaagcatcactctgaagcttactcatattggatagttggcctctggaaacgccccgcgt

SEQ ID NO: 5729 - DNA, 349 bp, Cicer arietinum; identical to SEQ ID NO: 5728

SEQ ID NO: 5730 - DNA, 383 bp, Cicer arietinum
acgcgggggagatagtagagagagttgttgttgcgtgtgtaaaccgcttcggtggtttggttccatttccatcttcctccaccaccatgcctataaccgaccaccaccacaacaacctccgcacccccctccgttcaaccccatcctcctcatcttccaactctttcacctcaaagatccttctcctcctcactctcctccctgtttccttagccacaatagcattcatccttcaatggcgtggtggcataaccgatccatcaacccttttatcccctcatggctctcatcgtttacctggcacgggctcttctcatctctcccctctctctcattctcgttcatctgattgtcttaaccttgctcgttcttcctcaccttct

SEQ ID NO: 5731 - DNA, 297 bp, Cicer arietinum; identical to SEQ ID NO: 5674

SEQ ID NO: 5732 - DNA, 428 bp, Cicer arietinum
acgcggggggacaggttttcttggttcatggattatcaaaagactacttgaagatggttactctgttaataccactgttagagctgatccagaacgtaagagagaccttagcttcctcacaaatcttcctaatgcatctgaaagactacaatttttcaacgccgatctaagcaatccagaaagtttttccacagcaattgaaggttgtgttgggatattccacactgcatctccaattgattttgcagttagtgaacctgaagaagttgtgacaaaaagaacagttgatggagcattaggcattttaaaagcatgtgttcattcaaagacagtaaaaagagttatatacacttcaagtggctctgctgtttcattcactggaaaagacaaacaagtcttggatgagagtgattggagtgatgttgatt

SEQ ID NO: 5733 - DNA, 161 bp, Cicer arietinum
acgcggggtaacgatttgattacgaagcgatattagggcagtgttgtgaaatgccggttggttttattcagattccggtgggtgtggccggaccgttgttgttggatggatttgagcatacagttccaatggcgactacggaagggtgtttagttgctagt

SEQ ID NO: 5734 - DNA, 230 bp, Cicer arietinum
actcgggaaccaaggaccagtgaaagggaaattagcccgtttatgtctacaatgcgggatcagctcggcttggcggatgggctttgacggaggtgtccattggtgggagcagttgtatgtagatattgcaaaagtccagtgctatatgcgttggcgggtaggcgttctggaatagttgggatttgagcatcgctgtaaatatcttgagactgcgaattgaatatacttga

SEQ ID NO: 5735 - DNA, 427 bp, Cicer arietinum
aaattgctggaggtgctactcagaattccatcagggttgctcagtggattcttcaagctcctggggcaactagtttcatgggttgcataggaaaggacaagtatggtgaggagatgaccaagaactctaaacttgctggtgtaaatgttcactattatgaagatgaaaatacacctacaggaacttgtgctgtttgtgtggttggtggtgaaaggtctcttattgccaacttatcagctgcaaattgctacaaggttgatcatttgaagaaacctgaaaattgggcattagttgaaaaggccaaatatttttatattgctggctttttcctcactgtatcccccgaatccatacaattagttgccgaacatgcagctgcaaataacaaggtcttctcgatgaacctttctgcaccctttatttgtga

SEQ ID NO: 5736 - DNA, 136 bp, Cicer arietinum
gccgaggtaccatttattggaccctgttactctagttagttgccttgattactgaacctgatagcttgtatctatcaactggtcgcactcgtagtttcagtttaactttgaactggcatgtctatttgaaagtttg

SEQ ID NO: 5737 - DNA, 148 bp, Cicer arietinum
actatgaaaatataaaggctattaagacagatatcagaaaaaattggaagtgtatataacgatttcaaaactatgaaagaaaactttgcttgtggattactgatggagtaaatttaaaggaagatgataaataacggctttatttggt

SEQ ID NO: 5738 - DNA, 134 bp, Cicer arietinum
acagggatgacgaaccttgagaagttcatctgaggtgcatctatcaagtttttgagccttgatgtagtttctgctattgcttttctagttatgaacagtgaaacagggattatgcaatctcttattcttgccag

SEQ ID NO: 5739 - DNA, 201 bp, Cicer arietinum
gcatgcaaagataaattttaatagtagtttataaacatcctcataaccatatcttattcttgtaactattatagttaaaaggagttaagcattctttcattatattgaatttcattctaagctcaggggtaatatccaccgtgccctccaccttccccacctccagcaccactattttatcctcctccatgtgcacctcca

SEQ ID NO: 5740 - DNA, 461 bp, Cicer arietinum
acgcggggggacaggttttcttggttcatggattatcaaaagactacttgaagatggttactctgttaataccactgttagagctgatccagaacgtaagagagaccttagcttcctcacaaatcttcctaatgcatctgaaagactacaatttttcaacgccgatctaagcaatccagaaagtttttccacagcaattgaaggttgtgttgggatattccacactgcatctccaattgattttgcagttagtgaacctgaagaagttgtgacaaaaagaacagttgatggagcattaggcattttaaaagcatgtgttcattcaaagacagtaaaaagagttatatacacttcaagtggctctgctgtttcattcactggaaaagacaaacaagtcttggatgagagtgattggagtgatgttgatttgtttagaactgtcaaaccatttggttggtctt

SEQ ID NO: 5741 - DNA, 403 bp, Cicer arietinum
acgtttcttgtaaaggatacgataaccacagtcacggcaccgaataacatctccagactttatggtattctccactccacaatccccgcgtacttttttttttttttttttttgaaacaactgacaaaactgtattatttgtagaattttctcagtgcccttattattttgatttaagcaattgtatatgaataatgttgctatctgttataatcaatctctataaatatatgagccaagttttggtaatttttatcaaaagctatttatttcaaaactcgtcttgacttgttgcttgcttgatccaaacatagcctccaatgcagcctacatcaatattttttctcttgtgattttcatgaatttggcacaatggaactgaaagcaacttcatgttccccgc

SEQ ID NO: 5742 - DNA, 226 bp, Cicer arietinum
acatgtccagtggttctatactaaattataatttttggaactccaacatttattttatgataataaacaataaactaatatttgtgtgtcgcaatttttattttttttatatattttttattccaagaataaaatatccttcctgaatcaagagctttgaaggagctctcaaattgtagcaagagttattttgctcgtgatttatacaaatacaggattgagtttt

SEQ ID NO: 5743 - DNA, 191 bp, Cicer arietinum
acagtcacggcacttgcggtgttcaaagtgtatgctcctcctgctttcactttgccacaatccttgcatccccatattcctacagcttttctcttcacagcatactttccacaaaattcacagaaaaatttgctgtgctgactaacttccatcttcttaatctgctttcgcagactggcaccataacgggt

SEQ ID NO: 5744 - DNA, 404 bp, Cicer arietinum
acaagtccatggctgtttcttagctttaactgccgtccctagtgtcacattagcaatacaaattcccttaaaagggtcattagaaattccttcaaacctagctgctattgtaacattctcagccacaatgtctctatagttgatatttgaaatctcaggcaaagcattagggtcataatgtgtatcagcatgtgaattgtaatcacctgtcatcttaaatgcccatttcatagtatacatgttcattctcttcacatatatgtccttcacataacctcctctaccaacagctgttttaatcctgacacctgactctgttcgaatggctgtgatgtcttcagctctaacatcttgtatccctcctgacatttcacttcccaaggctatggttgcactgtatggtg

SEQ ID NO: 5745 - DNA, 237 bp, Cicer arietinum
actaagatgaacctcaagaccaggcccagcaacctctgctaaagcccccagagcatgttcatggaaggcagacaatggaggatgaactagtttgggtagaatatggggcaatactgcacttgttcttacactcagaatttgtttaaggccatcaagtgcagtgtctgaagttttatcgacctccaatgcatgtagaagagtcggaacaatctcatcaatagcttgcattccagcact

SEQ ID NO: 5746 - DNA, 402 bp, Cicer arietinum
acatttttgtggcaagatgggttttgtaacagataaatcaaggagaggtagttcattaaaagtaaaaaatagtagattttgatgagaaaatcaataattgcataaacatctcaatgtgctcggtccctcagcacttcgagatccatttctgtagggtcagtagcctggatttcataatggacaccacctagctcgcgcctaaacctttctttagttgtggcatagagcatcttggcacggattcgagacgttgaaggagaccatgcaatgaagaagattttgctcttttgacagttctcagaagtgacaaaatcaaagtcaaacacagcatatctgcaatcattctcaggcaaagatgcagcgaaatcgtcatagctctcagcaggaccaccagtcttctca

SEQ ID NO: 5747 - DNA, 342 bp, Cicer arietinum
acgcggggtgtctgtcatgtcatgtgaactatgttgtcatggatacgaggtgcgatatgacaatggagggtatattctgagtttgatttatcaaatgttctgtagcagccctctggatgtggagggcacagaattaagaggcagattttgccttggaattcttccatgccttcttaattaggttgtctgtagtaacgagtgattgtgatgcttattttatttccttttgtccccttttcggagtttacatttgaagttttttatttttttaccttttgaaacgttcgtgtttatgtctatagcccatgtatcgagatattttacaatatcgtcaatttgcgc

SEQ ID NO: 5748 - DNA, 183 bp, Cicer arietinum
actttccactatcgcttatacattatatttagcctttgaggaaggttccccatttaatttaaacagtttatccaccatttgactttttaggctagtctattttagctcacgctaatcatagaatctcttttgatttcttttcctaaagttactaagatatttcaattcacttcgtttattatt

SEQ ID NO: 5749 - DNA, 431 bp, Cicer arietinum
acgcggggggtttctagagtttgttcacactatggattttctgctttgaccactgttcttgctgtgaactactttgatagattcatcactagtttgaagtttcaaaaggataagccatggatgacacagcttactgctgttgcttgtttgtcacttgctgctaaaatggaagagacccacgtgccacttcttttagaccttcaagttgaggattctagatttgtgtttgaagctaagactatacagagaatggagcttttggttttgtcaactctgaagtggaggatgcatcctgtgacaccgatttctttctttgaacacattgttagaaggcttggtttgaagagccgtttgcattgggagtttatgtggcgttgtgagagggttcttcttcatgtcattgtggattcaaaggctatgatgagttatct

SEQ ID NO: 5750 - DNA, 426 bp, Cicer arietinum
gaggtaccgtgagaattacttacttgataattctgtttacgaccggacgagttttacacatggcctttaatggaattaattttgtcaaaacaaatccatctcgttctgccatatcaatcatgtcatcacttgtacctgcccgagcggccgcccgggcaggtacgcggaggtatgaccttgttgatgtcaccagacaagtcttagcaaaatatgcaaatcagctgttctttaaggtcattgaggcttgccaatcacatgatgtccatggagtgaccctactcagccaaagattcctggacctggtggaagatttagacgcattgttggcttgccacgatggatttcttctaggcccatggttagaaagtgcaaagcaacaagctcaaaatgaagaacagaagagacagtttgagtggaatgctagaa

SEQ ID NO: 5751 - DNA, 134 bp, Cicer arietinum
actccaataaggccttgggctaccgaaacttatatttttgctatgtttgatgagaatcaaaagagtccggaattagaaaaacattttggagtgtttaatcctaataaacaaaagaaatatccgtttggatttgg

SEQ ID NO: 5752 - DNA, 438 bp, Cicer arietinum
acacgtgctccgatggagagttggatcaattgcttctactacttgaggaactaaatgatacagtctattggaatgatgcttgctgcagaatcatcttgtgttgtatttggaatgagcatttaagttctgctattgacttgtgtaagctcctcaaggataagttacaagatgatgaactggttatgaaagttctatttgataaggtattttctctaattgaggagtcagagtccaatcatttgcatacttgcatggtgttgctttcagaaatcaaggataagcacggccttttgccttcacaaaaatgttatgattctctgctggttgcttgtgaaaacgccaacaataattcacatgctgaatgaggctccttaataagaggagtatatgtagtgttcttcattacttttctacaaacaacaataggtgctgatgtac

SEQ ID NO: 5753 - DNA, 258 bp, Cicer arietinum
acggtgctcgatctgcaaatttattttttgtttaatggtgtccgaatttatatactctctcgttatcagccatcttgtcaatctcgtgtttaaattacaagttggctcttttttataattattattgtaaataagacttaattcacagtatagatgattagatgccttttcatcttctagaaatgctgtgtagctagactagatgtccaaatattcgcttgtaaaattgtatttagttaattaaacttttctctctgc

SEQ ID NO: 5754 - DNA, 359 bp, Cicer arietinum
acaaccattgggatggtcctaccttacctaattggattaatgttccgtgaccgcattcatcaatggttagagagatggccccagaatgctgcaatgattaggcttgctggggaagggagctggttccatcaatttcaagtggttgctctgtttcgagtttcaccttttccctatactatattcaattatgctgtagtagtgacagatatgaatttttggccctacttatgtggatcaatagcaggaatggtgccagaagctttcatctacatctacagtggtagattaataaagactttagctgatgcacaatatgggaagcatcacttgacgacagtggaaatagtgtacctgcccgg

SEQ ID NO: 5755 - DNA, 173 bp, Cicer arietinum
acgcggggggatccaataagaagcttaatgcacaacaaaaccatgaggaaattgagcttgctggaattgaagagtcccaaccttgggatgggtattatgcatcaaatccatggccaattgtcagcagccaaacacactccacaaactcggaggtcgtgcatattcttgcatta

SEQ ID NO: 5756 - DNA, 432 bp, Cicer arietinum
acgcggggactacaaggagcaagactcaattgattgcaactttcaatcgctatagagagactcatggtggttccatcactaagaaactattggatgaaggatcggatgattttcagaaatcattgtataccaccattcgttgcttcaatgatcatgtcaagtattatgaaaaggtggtgagagatgctgtcaagaagattggaactgatgaggatgcactcactcgtgtgattgtgagcagagcttacacagatttgaaaaacatctcagatgtttattataagagaaacagtgttcttctagaacatgttattgccaaagaaatctcaggagattacaagaagttccttctcactatcttagggaaagaagattgagttttttttccttttctctggtggcatctatgattatgagtttaaataagacaat

SEQ ID NO: 5757 - DNA, 172 bp, Cicer arietinum
actacccaggtcaagatattgcaaacaacttggactgggtcaatgtaatgacttatgaccttttcacctcagatgggtatccaaccacgacacagccacctgctcctttgaaaaaccctactggccaattcagtgtagatgaaggtatcacaaaatggattgggttaggagt

SEQ ID NO: 5758 - DNA, 308 bp, Cicer arietinum
ggaaaaacttatttaatttttattgataaagggagatacaaagacatgaaatatcacatttcaggagagagaaaggaaaactaaacaagagaacagtttatttgattgaaagctaacataagaagacatcaactcatgttaggtatagttgaaggatggatcagttgtaattaggattggccaaaacgtaaccctcaatggccttgaaaagagcatcaccctttgcctttccttcttgaacctccttctcattgggcttaacatctcctttggtttgatattttacgctcaccttcccaatggaccct

SEQ ID NO: 5759 - DNA, 219 bp, Cicer arietinum
acgtatacttcactagcaaagctcaaaatgaagtcaacatgtttgatatatttgagtttgtagatgttactattgattggaggtggaatatcatgtatgtattcacgataaatagtaaaatcaatgtttccattgttacccttataagacattgtgacaactataagaatttggaataggaaataataatgaaattaattgccttttcttgccccgcgt

SEQ ID NO: 5760 - DNA, 143 bp, Cicer arietinum
aacaaaaacagaaaaagacccagtccctgtgcctaaaattaaaatccagggaaagtggaatttggtgatactccttcagccaatgcccctatccaaaaaaaaccaaagacaagggcaagcgctacaatagctcaggcttaatc

SEQ ID NO: 5761 - DNA, 380 bp, Cicer arietinum
accaagacaagacagaacaagaaaagtgagcaacagggtggataacaaccagttatctactgtggaagacaaaaggaagataggctctcatgccaaaagtgtaaatctatcacatgttgagaatactcattctgatcccgatgatgatttaaatgctttgctgaaggatgaggaagatctagtaactgctcaccgtagacaagtggaggaaacaatagacattgttaaagaggagatgaatttactcgttaaagctgaccaacctggaaatcagctggatgattatattaccaaattgaataccattttgtctcaaaaggctgcaggaatatttcaattgcagacgcagttggctcaattccagagacgtctaaatgagt

SEQ ID NO: 5762 - DNA, 349 bp, Cicer arietinum; identical to SEQ ID NO: 5713

SEQ ID NO: 5763 - DNA, 339 bp, Cicer arietinum
  misc_feature (76)..(76): n is a, c, g, or t
actccttaactttctttttcggtaattttggtccaaatgctaccacatttgttgttccggctgagattttcccagntaggctgagatcgacttgtcatgggatctcagctgctgcgggaaagaccggagcaattgttggtgcatttggattcttatatgctgcacaaagtaagcataaaaatgaggctgatgaaggtgatccaactggtattggtgtgaagaattctcttattatgctcggagtggttaacttcctggggaattgtattcacctttttagtgcctgaagcaaaaggaaaatcagtggaggagatgagtggggagaatgaagaagatggt

SEQ ID NO: 5764 - DNA, 431 bp, Cicer arietinum
acttggatgagaaggctatctttcaccttaacccttctgaccgatttgtcattggaggtccccatggtgatgccggtctgaccggaagaaagattatcattgacacttatggtggatggggtgctcacggtggaggtgccttttcagggaaggacccaactaaggttgacagaagtggtgcctatattgtaaggcaggcagccaagagtattgtggctaacggtcttgctcgcagatgcattgttcaagtttcttgcgctatcggtgtgcctgaacctttgtcggtctttgttgacagttatggaactggaaagattcctgataaggagattcttcaaattgtgaaggagaaatttgactttagacctggaatgatcaccattaacttggacctaaagaggggtggacataggtttcttaagacagctgcc

SEQ ID NO: 5765 - DNA, 450 bp, Cicer arietinum
cgggaattcgattcattacctggtgccactccgccaatggtggctactaaatccaatacgagagtaataaatgttgatgtgggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttactagtccaaattcaaagactccagtggataaccctaatgaaattcaaaatcaggggcaaaatagaaaatcaccattaaagaatgttactcaaaaaactattgttaatatgccttcatcaccatatcaatca

SEQ ID NO: 5766 - DNA, 104 bp, Cicer arietinum
caattctgttaccatatccctaaattgacttgcttcttgaagatcactcatgtcacaatcttctccgtagtatctctttccagagatcattcgcatgatgttat

SEQ ID NO: 5767 - DNA, 411 bp, Cicer arietinum
acagggttcttttgctggatgaggttacagtcgatctggatgttgttactcgaatggatttattggaattcttcaaggaagaatgtgagcagagagaagctacaattgtatatgccactcacatttttgatggactggagacatgggcgactcatttggcatacatacaagaaggcgaactgagaagagcggaaaaattgtcagatgttaacgagttgaaatcttcaattaatctgctgtctgttgttgagtcctggctccgcgctgagacaaagcttgaaaagaagaaacctgtccttaacacatctcaatctcaagggaattcttttgcaagctctccattctttgcatccagacacatggcatactatcgataatctctatagataccaattgcttatgaaaatatgt

SEQ ID NO: 5768 - DNA, 386 bp, Cicer arietinum
acgcggggggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtgcttaatttggttgccaaatgtcatactcccttcttcttttcattttgttgtggaagtgtgagattgtaagtcaagtgtgt

SEQ ID NO: 5769 - DNA, 310 bp, Cicer arietinum
acgcgggggaacctcgagaagcagaagaatgctggcaaaggtagccagcttgaaactaataagaaagccatgtcgatccagtgcaaggtgtgcatgcaaacatttatctgcaccacatcagaggtgaagtgcagggagcatgctgaagctaaacaccctaaatctgacgtccttgtttgttttcctcatcttaataagtaaacatgagggaaaggcatgatcaaaccttatatcatattatatatggatcctcggtttctagtgtcaaatgcgtctgtgtttgtcttgagggctagggataaatgaaagg

SEQ ID NO: 5770 - DNA, 367 bp, Cicer arietinum
acgcggggggtgagggtaaggtctttctttctgccgtgtcgtttgctgttattttctgtcgttttcctattcagaccgaaccctaatttttcacccaaaccatgtcgaccaagcaaggtggaaaagctaagcctttgacgaaaccaaagtctgataaaaaggattacgatgagattgacatggctaacatccagaagaaaaaggatgaggagaaggctctaaaggagttaaaagctaaggcacaacacaagggatcttttggaggatctgggctcaagaaaagtggaaagaaatagaggagctctttctcatgatttcatacttccagtattgagctctgtaattacgattatgactatgacaatat

SEQ ID NO: 5771 - DNA, 342 bp, Cicer arietinum
acgcggggtgtccgtcatgtcatgtgaactatgttgtcatggatacgaggtgcgatatgacaatggagggtatattctgagtttgatttatcaaatgttctgtagcagccctctggatgtggagggcacagaattaagaggcagattttgccttggaattcttccatgccttcttaattaggttgtctgtagtaacgagtgattgtgatgcttattttatttccttttgtccccttttcggagtttacatttgaagttttttatttttttaccttttgaaacgttcgtgtttatgtctatagcccatgtatcgagatattttacaatatcgtcaatttgcgc

SEQ ID NO: 5772 - DNA, 429 bp, Cicer arietinum
acgcggtgcacacaaacaagctagctacttgttaataatatcttatttctcacactagcaataatcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgag

SEQ ID NO: 5773 - DNA, 366 bp, Cicer arietinum
acacaagtgagctgctagctcttcttatccactataaacaacaacaaagttacaagacaactcaaagaagctgtgataatcaccatactagtagctaacagcaacgatgcatatcccatttatctttgttttcagcaataacctcaactctatcaaggcagagtgtaaggtctctacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttgtgacacacttgcattttcatcttgtgctg

SEQ ID NO: 5774 - DNA, 433 bp, Cicer arietinum
actggaggagctgagtgcccttaccgacatgagatgccagtaactggggaactgtcgcaacaaaatatcaaagatcgttattatggggtgaatgatccggtggctatgaagctacttggcaaggcaggagagatggcctctctggaggctcctgaggatgagagcattaaaacactttatgttggtggacttgatgctagggtcaccgagcaggatttgcgggaccacttctatgcccatggagaaattgagtccatcaaaatggttctccaacgagcttgtgcttttgtaacctatacaaccagagaaggtgcagaaaaggcagcagaagaactctcaaacaaactggttattaagggcctaaggctaaagctgatgtggggcaggcctcaatcatcaaaacccgagtctgatggctctgatcaagcaaggc

SEQ ID NO: 5775 - DNA, 180 bp, Cicer arietinum
acttatttattaaaaaaattgcaaattaactagagaaaaaaaattggaaggaaatttcaagttaagttatgagtgaataacattcaattttgcagaacaaggagaaacacaaaacctaaaaacggttaatacgaaatcgacgaagttaaaaaagaataaagagagagagagagtagtagt

SEQ ID NO: 5776 - DNA, 368 bp, Cicer arietinum
acattaatcactgctttcttcaaaatgctaattatccaactgatataattaggagaaggaagaggagaaaagaattaggctgacaaaaaaaaaaagaaaccaataaataattgcaccaaaatgaaaaagaggagcatattcatcatcctccacctatttaattcacacttccagagctgaggcattaaaactagcaagactaatctgtgaccatatctgccacgccgttctgtgcagccgcttctgccagtctcttccagttcaattcccgctgctctgccacatctttggcttttgcccgtttctctgtatgatgcctctgacactcttcaaacaattctgcatccatttcgatgaacattttgcgt

SEQ ID NO: 5777 - DNA, 362 bp, Cicer arietinum
acgcggggccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctttattgattgcaggtccaaatggaggatccattgcaaagttgagtgtgaagtatcacaccaaaggagattttactccttctgaagaggagctcaaaagtggctaagccaagggtgatggacttttcaaggggtttgagggatattgtttggccaatc

SEQ ID NO: 5778 - DNA, 463 bp, Cicer arietinum
acgcggggccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcgcttgagggttattgtttggccaatcctaattacaattaagtgcttttattatacctggtgtgttgttttgtgacacattttattatatttagtgtgcttaatttggttgccaaatgtcatactctc

SEQ ID NO: 5779 - DNA, 407 bp, Cicer arietinum
actaatttttcactgaatgtgacatgtagaatatcccaacctgatattatgaatgtataatcatcaactaaatatataattatataatttgacttgaatgattgcttttgtttattaattggattctctcaatctcaatgtagtgcttgtctctgtcacaccatcaccttatggttccaattcaacaatttccatttcttgtgtcacaaacactgttgcacaaatgcttgtatttcgctgtgtttgcattgagaagattgtggaaaaacttggttacaaaatgtaattttacttaattcatgatcaattcaaacatgtattataatcctaacactatattaaagttagatgcgaattaatcaacattataagcagtcttgcaattaagtttacgtgactattcaatt

SEQ ID NO: 5780 - DNA, 273 bp, Cicer arietinum
acaacttggacaagatgaagcatcaggggttgaaaatgtcccttgctgtgttcactgctttcagcattggtgttgcagttcctgtttatgcagtcatttttcagcaaaagaagacagcttctggctgattcatcttcctttgcaacaataataaggtggatttagactagcatattggttttggtggttgttgtcgttttactttgaactttgttcatgtttaatcttccatatggattttccatatgtctcttgtaataatcaatttcttgt

SEQ ID NO: 5781 - DNA, 283 bp, Cicer arietinum
accattgtgaaattataaacaagccaatgagggagtgacatatgatatactgttaatctatgatactaggaaatcaggtccccaaaggtgttctccccactgtaagtaacataaagaaacccatcttcatccttcttctcatcatatatggcagacattattgctcctgtaggtggaagaacattgtccacaaaaataaagattgccttttctgcacttagtttaattcttttacggataacgtagacaaactgtccaactgtgagatcagcagggacaaggt

SEQ ID NO: 5782 - DNA, 403 bp, Cicer arietinum
  misc_feature (403)..(403): n is a, c, g, or t
acctggatttcccttggaggatatcaagttggctatcaacaccattgggagcttggttagggctaatgctctaaggagggagatggacaaacttaatgtatgatagtagtctttaattaatcactatctgtctgacttatatatacatattaatctatccttcattttttgcattttgtcgtaattaaacatgatttcttataagtgttgtttatgtgtgtaaggaaacggattaaaatttcatgtaatcccaatttatactagtgattggggttgattgaaatttgaaagcacttgtaaaagcatagactttagagttgagacacctttgcatgaggtgatatatcaactggtattaatgatatttgatatagccttgaaatactcttttagtggctaatan

SEQ ID NO: 5783 - DNA, 393 bp, Cicer arietinum
  misc_feature (12)..(12): n is a, c, g, or t
  misc_feature (24)..(24): n is a, c, g, or t
  misc_feature (128)..(128): n is a, c, g, or t
gattagcggggncgcggccgaggnacaaaaagaatgtccccggacctacaagtgaaatcgtgttgtagcggatgcagatcaaccaccgatctctacggaagcaattgcaaacacatggctctctgatntacctgtggcaaaaccatggctaaaaaccgcgctaagtgctatgattgtggagccaccctaactcgcttgattcgagaatataatgttcgtgcaagttctgccaacgataaaaactactttattggaaggtttatgactgggttgcctgatttttgagagaagaaaagtgctgaaaataaatggtgtctgcagaaggatggattgcagcgtcgagaagttactgatgctttgcgggagaagttcaagaaccggccttggctcttg

SEQ ID NO: 5784 - DNA, 296 bp, Cicer arietinum
  misc_feature (150)..(150): n is a, c, g, or t
  misc_feature (194)..(194): n is a, c, g, or t
accattttggccttgatttaatgcatagaaaagcagaggtgaaggatatcatcacagatgtaattaataacatgtctgatgaggaagaggaaggcgaggaagctgaaaatgatggtgacggggatgtagatgcaggtaaagatggtgacnacagtgatgaagatgatgatgcatgatcttatacaaaagaatanaatgacagcaggaattagaagcatgcgaggcatctattagctaaatttccaggttcattcttcctgtcagctggctatacgggttaagctttggtaggtatt

SEQ ID NO: 5785 - DNA, 166 bp, Cicer arietinum
acaccattaacctccacaagcgtctccatggctgcaccttcaagaagaaggctcccaatgccataaaggagattaggaagtttgcaaagaaagccatgggaacagatgacgtgagggtagatgttaaattgaacaaagctgtttggagccagggaatcagaagtgt

SEQ ID NO: 5786 - DNA, 403 bp, Cicer arietinum
acagtcagaaaaacaacatcatactaatatcacacatatacacacaaaaactttgtatgttatcttggtccagagagttccatagcttgtgcaagcaatgaagagtcatcagtaaggtcagaataacgctctgaagaggagagttcatttcctctacttcttgttgattcagctctctgtgaggcttcccatttctctgcaagtccatctccttcaagcatcctaacaacttctgacatttttggcctgtgacttggaagatactgagcacataaaagtgccacttgaactatttcatctaactctatcctgtcatagttgtttttcaaatctttgtcaactaacaagtcaatcttcttctcttgatgtattttcttcacccaatcaagcatagcacctttct

SEQ ID NO: 5787 - DNA, 462 bp, Cicer arietinum
acaatagatttgaccggagcaccaaaacaggttataagcaaatgtgagcgctcataatgctcatgatatagtggagagccttcagatcttctgttcgagagtcacatcaagtataccaatagatattttaggagtgtaatgttcatcggtatccacttcttcgatttcctgaacaacatcctctcccttgatgacttgcccaaacacaataagcttctcatttagatctggtatgggtgcagttgtaatgaaaagatcaaatactttgttggtgtgtttgcccttggatgttccgagcatgaatgcttcatgcttcatacttgtaggttgctttcctcttaagttccaatcagctgctcctgttccttggccatcccctacctgaatcacatagtgcttaattacgcgctgaaaaagcatccctttgaagtgccctttttgacacaaatcaataaattcatc

SEQ ID NO: 5788 - DNA, 326 bp, Cicer arietinum
acgcggggggcctgatgctggaaaagttttcgttaaatgcggtgaaaattgcacctgcactcttaatggtgaagctgtgtcccctgaaattgagagtagtagtgacaatgacagcgaaacattctgcaaatgtggagaagggtggagttgttcaattttcaggactgaaggccctgatgcagactcaggcaagggctttgctgaatgcactcaacaatacaagtgtgcttgtaattgttgaccaccaattgtccctaaagaacctaatataatactacgaaggctaataaatttggtatgtcaaataaagggactactatcctcca

SEQ ID NO: 5789 - DNA, 382 bp, Cicer arietinum
actcgtgagcgttctcgttatctgctagctcatggatattctgatattccagaagaagccactttcaccaatgttgatgagttcctggaacctcttgaactctgctatagatcactctgcgcttgtggtgatcgtgcaatagccgatggaagccttcttgatttcttgaggcaggtttcaacttttggactgtcactggtaaggcttgatataaggcaagagtcagatcgtcacactgatgttatggatgcgattaccaaacatttgggaattggatcctaccaagaatggtctgaagagaaaagacaagaatggcttttgtctgagttgagtgggataaggccattgtttggtcccgaccttcctcataccgaagaaattc

SEQ ID NO: 5790 - DNA, 172 bp, Cicer arietinum
ccgaggtactaccaaaaaagcatactaaaaagcaaatataatttcatataaaataattatatgtatagaattaataataaaaccttaggacatatctaagctcaacaaatcatattgaaggtgctggcttaacggttccaccaaggatcttgaaagaaactcactataatca

SEQ ID NO: 5791 - DNA, 427 bp, Cicer arietinum
accttgcattgccagtttttattggataagcagttattcctattgcttttatgcttttatggagaaaagcaaatgcaattggagccattcttggaacaatatttggttgtgttcttggaataatcacatggttgtctgttacaaaaatagagtatggtatgataaaccttgatacaactggaagaaatgcaccaatgcttgttggaaaccttgtttcaatactaacaggtggagctgttcatgccgcatgcagcatgttgtggcctcaaaactatgattggagtagcaccaaacaaatcacagtggttgaaaaggaaaagactgaattgccagctgaagagtttagagaagaaaagttaataagggccaaagtgtggatagtgaagtggggtgttggcttcactgttttgatagtcatattatggcc

SEQ ID NO: 5792 - DNA, 180 bp, Cicer arietinum
caggtactacagttaaccaacggaacattacatggccaatcaatacccaaaaattggtgcaatcttattttcaattagtgcattgccagtgagggtcgccagatttatcattacaacaaataaacaaacaaatggataaacatggtattgttaaatacgaagttgcaagcaatattatgt

SEQ ID NO: 5793 - DNA, 386 bp, Cicer arietinum
acacacttgacttacaatctcacacttccacaacaaaatgaaaagaagaagggagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagccccccgcgt

SEQ ID NO: 5794 - DNA, 317 bp, Cicer arietinum
accttcctccttcaaatcatccacatggctcgtgccgatttcaccaacagcagagctggtttcttgcgtaacgcattcgtcagtagtatcttgagtgttgttggatataccaaaatcagaatcagtctcacaagtgttacggccactcagatctataccattttgatcttctgatctgaaagagtcattctcagtttgcttctcttgagcaagcaattcggcttttcgggcagcaattttcttgtaatgggcttcaaaataagctttcttctgggctactgatccaggagtagcacacttctcaacttcttctaagt

SEQ ID NO: 5795 - DNA, 418 bp, Cicer arietinum
actgctaagaggcttcttgaactggcaccaaaattggttgatcaaggtgttctgaaaggtgtgataactaaaaatcttactgtggaagaagctaaaggtgctgctgaaatgatgtatgtaggaagcacacttcctgtgttgcctatcatcatgtgggatgatcaaccaattcatcatggtagggttggagaattaacaatgttactttcagatttgctatgggatgatatggtagctggccctggcacacagagagtacctgatggtgttgtcggtcctcatccggatccagtaggggatgggcctgttctgcctcatcttcttcgccaacttcttcttgattctgaaggtcttgtgtgacggcattttcgctacaccggtgggatttgactgctcagtctacctgctgtccccgcgt

SEQ ID NO: 5796 - DNA, 374 bp, Cicer arietinum; identical to SEQ ID NO: 5065

SEQ ID NO: 5797 - DNA, 319 bp, Cicer arietinum
gattgccgccccgggcaggtacgcggggggatacagccttgtcactggaggaactgaaaatcatcttgtcttgtgggatcttcgccctcttggcttgaccggcaataaggtggaaaaactttgtgatctatgtaacatcactgtgaacaagaatgctgtttttggtgatagcagtgccttggctcctggaggagtaaggattggtgccccagctatgacttctaggggtttggttgagaaggactttgagcagatcgcacagttccttcaccgcgcagtgggtctcactttagatattcgaaaggaatatggaaaactt

SEQ ID NO: 5798 - DNA, 228 bp, Cicer arietinum
accctcctcttccgcaccctcacccgcagccaacctcatcttccttgctttctcagcttcatcccattccttctccatctgccaaccagatttgtaatcacctcgatcatgcataaatttacacgaatcgccatacccacagtaaccagtttccttataatccttgcatatatcaggctgataatcaaatctggcactaactcttatgtgagcggaagccccccgcgt

SEQ ID NO: 5799 - DNA, 385 bp, Cicer arietinum
acttaacaaaatctacgacttccgaaagccgaattcgaatccactagtcaggttactagctaatggtcttgtaagctatgagggagaaaagtggaacaagcatagaaagataatcaaccctgcattccatttagaaaaattgaagataatgttaccaatattcttcaaaagttgcgatgatctgattagcaaatgggagaaaatgttgtcattggaaggatcgtgcgaaatgggtgtatggcctttccttcaaaatttggctagtgatgtcatttctcgaacggcgtttggaagtagttttgaagaaggaaaaagaatatttcaacttcaaatcgagcaagctgaacttactaatagattatgatggaaagtttatatttcctgg

SEQ ID NO: 5800 - DNA, 361 bp, Cicer arietinum
acacaagtgagctgctagctcttcttatccactataaacaacaacaaagttacaagacaactcaaagaagctgtgataatcaccatactagtagctaacagcaacgatgcatatcccatttatctttgttttcagcaataacctcaactctatcaaggcagagtgtaaggtttacacttgtaaccaacagggcgagtagcaatgttgcaacgtttagggatagtcacagcaatttgagggtcagcaccagacattttggcagtgtttgatagcataacagcacataaacaacttggattctgaccaagtttcttaacctgagcacaacaactttgtgacacacttgcattttcatcttgtg

SEQ ID NO: 5801 - DNA, 242 bp, Cicer arietinum
acataactgtgcagtctctcacagaggaaggtctaagaaaacttggaccatatgttgaaaccatggctgaagttgaaggacttgaagcacacaagagagcagttaccttaagacttcaggacatagaagccagacaggtttcaagatgattcagcaaatcctttgttctctttatctcttacgaactgtattagctttaaatttatgccaattttagacctattttcttgatgatattacct

SEQ ID NO: 5802 - DNA, 379 bp, Cicer arietinum
ggtgaaaaaggacagatttaacacaaaatctgcataataagttttgatcaccatggatgcaaaacctgcaactactaagcacaaaaatacagtgattcaacgacaataaatcccgaagtacactcagaagcttctggtttcgttcaaagggtcatagtcatatgattcaccagctttgacgaaccggcccttcacacgttttctgacatcggccctagccttccgagaagcatatcttactttcttatcaaactttcgattctttttcctttccttataacgcatgacagcattgctgcgattagcagattgaatagaactctcagcgaaaggaacacgccagggaggctcccccgagacatgcattgcagaaccgcca

SEQ ID NO: 5803 - DNA, 271 bp, Cicer arietinum
acgcggggacacaagattgatataaatcagcatgttaagttaaaacatgtatgctgcttttcttgtgaggatgcatcagaacatagatttaaaaatatataaccaaactttctcacaagagaacagaaaaagcttgttatgccacaccaccaccttgagattgtatgattaacttcagtttctcataagcatcataacaggcgtgagtataatccgacagagcacgaaagagctcaggcaaccgagttttgagactctgtagggatttctc

SEQ ID NO: 5804 - DNA, 169 bp, Cicer arietinum
ggcaggtactgtataaaatcgaagtaaaaactatcaattgaaaaattagttatccaagcagaagaaaactaatatttgactaatccacaaattcagacatgttgaacaagcttcgaaaaataccagaatcaagatctagcaacttcttccccagtatgaccatttcttt

SEQ ID NO: 5805 - DNA, 123 bp, Cicer arietinum
tagcgtggtcgcggccgaggtactttttttttttttttttttttttttttaggaacatagcaagatcatattatagctgccatcaaggggacaatatagtacctgcccgggcggccgctcgaa

SEQ ID NO: 5806 - DNA, 172 bp, Cicer arietinum
cacttgcaaatacaatgttgtcacccaaaatggagaatgcttcttcaggggtgcattcaccattctttgttggatttgacatggcaaatatggctggtcttgttgatgttgaacccttcggggcctctaatacctcttttgagaacaatcctccaacagcagatagtccccc

SEQ ID NO: 5807 - DNA, 205 bp, Cicer arietinum
accgatcataatttgcatgcagtgttggtagaattagctatgtattgttcttttaaactttgagatgcacattttgccagcttgtatcagttttggcatctatctattatcgtttttggtattctggcagttcttttcttcttgttttatttaggttaattactgttgattgagattcattttgaaagagaaatctggacacaga

SEQ ID NO: 5808 - DNA, 267 bp, Cicer arietinum
actcagggaggggacattatccctcatcattcattggtaaataacaaacataaccatgatatgtttctcaaaattaattgacagtatacagatattattattaacaaattacattaaaatgtgccaaatgacaagtttaggtagcatagtttaaatcctcccaaaaggtttctctgatatggtccagccataattgctacagcataaaaacaaataaaagtagcaataaatccacagcaacttgagccactcatctttcctaaatga

SEQ ID NO: 5809 - DNA, 400 bp, Cicer arietinum
acaaattgggggatcatgaagattttatcagtgagtatgtagactcggaatggcaaagatatatcttagatcatcagacatagaatgataaggttgcatgtcaaaagggaaacagcccagaacaagagttaaggttcctaaatgattagttgagtgaaattaacaaggtttttattaaagtcgaccaggagataggcttagaagcagccataattttatgacctcgcaacagagcgcttgttaagttttaaaagcatcgaaaatttatcggatctaaacaatataccgaaaccttgtccatattattttataattaaagcttagttataattaaatggggtagcacaacgttgagctaaattaagatttttattttttaaacgaaattataataatttaa

SEQ ID NO: 5810 - DNA, 287 bp, Cicer arietinum
accttgtccctgctgatctcacagttggacagtttgtctacgttatccgtaaaagaattaaactaagtgcagaaaaggcaatctttatttttgtggacaatgttcttccacctacaggagcaataatgtctgccatatatgatgagaagaaggatgaagatgggtttctttatgttacttacagtggggagaacacctttggggacctgatttcctagtatcatagattaacagtatatcatatgtcactccctcattggcttgtttataatttcacaatggtacct

SEQ ID NO: 5811 - DNA, 310 bp, Cicer arietinum
actgtttgccaagcgtgttctgcgcaaaaaaagactcctacaacaaatattacagcaattgggcgcagaatgacaaaggtcgcagtttcagtaaaggacgttctacgcgagatgaaagaattgaagccagattctagtgatgatcctgttgacaatagttgtgcagaaacagagtctgaaccatgcaataataattcaagtgacggtgatatttggaacgacctatcacctgaatatatgaaagtggctgaaagagccattgcagttgtgtctgacacactttcagtcctgaaagaacttattcgctcca

SEQ ID NO: 5812 - DNA, 274 bp, Cicer arietinum
acccaactgatgttttcaggagagccaaaattaactccgtattagattggtatcactctaatttaagatatggagcagtgaactatgtaataaatactgtattaggacctgcacttggtcgtccactgaatccaaaagcagctgctgaagcagagaaagtgttattatcttctttatcaaaactagaggatatttggctcaatggagatggacgattccttcttggcgcctttcaaccgtctatagcagatctcagcctggtttgtgaactcac

SEQ ID NO: 5813 - DNA, 349 bp, Cicer arietinum; identical to SEQ ID NO: 5589

SEQ ID NO: 5814 - DNA, 318 bp, Cicer arietinum
acaaattgtttttgatgatctcttagataccaaccccgagagggttcagaagggaattgattcaaaagcatgcaatgctcttctgctcaaggtcaaccaaattggatctgtgactgagagtatcgaagccgtgaggatgtccaaaaaggctggatggggtgtcatgaccagccaccgaagtggagagactgaggataccttcattgctgatcttgctgttggtttggcaacgggccaaattaatacaggagctccatgcaggtcagagcgtctcgctaagtataaccagctcttgagaattgaggaggagcttggtgc

SEQ ID NO: 5815 - DNA, 241 bp, Cicer arietinum
acttctgctgaagacctgcaatgtaacgggttatatactcgacagtgacaggatcctcaacagtaagcctgtgactttgacattcaactcgtgcccggttaataaggacacgggcatcggcttttagtccagcacaagcaagggcaatgtgatcatccagattaacaatcttccttactgatctagtgtcctggagtttggcggcggatttcttctcgacgccgagaacgacattatcggt

SEQ ID NO: 5816 - DNA, 243 bp, Cicer arietinum
acgaatcacgaagcctgagtctttgcttcaagtaagggtctccttcaagaacttccttgtgtgcagccacctgaagtaggagtttcttagtttcttcatatttgttcctcaactgctcaccaaatggccacagatcctgtgaaactaggagcctatcattcaaagctgcaattccagggtctcctttggcaaacaccatttcaactaaatcaattgtgaccctaaagaaaggccatttattgt

SEQ ID NO: 5817 - DNA, 392 bp, Cicer arietinum
acttggttattatgactgaaaaagattaccaaagaaaaaagaataagtttctgcccaaaattcatgcatgggtccaggaacatggaggtgggcaaatgattcctttcagctgtgtcttagagaagaatctttcagatatgcctcctgatgaggcagctaaatattgtgaagcgaacaacgttcaaagcgctcttcccaaaataataaaaactggattttcagctatcaatctcatttactttttcacagcgggacctgatgaggttaagtgttggcaaattagacgcctaacaaaggctcctcaagctgcaggggctatccatactgattttgaaaagggatttatatgtgctgaggtgatgaagtttgaggatctaaaggaacttgtacct

SEQ ID NO: 5818 - DNA, 360 bp, Cicer arietinum
gaaataagaatatatcatattggaaaaaacattggttcaagcaaaaacataaaatcgtttatacttgcacaagcattaaaggacaccatacacaaaaaacatccttattatattcaaaagcctagtccattgtaaattgctcctattcacctatagttgcggtatagaggggtatacatgcaactctcagcatacttgacaagattctcaggacgaggaagatgtgtagccaagcctagttcatatgcctttgcagcaacatttgcagctatgttggctgaaatttttctgatatcagagaaaggtgggtaagtcaaaccctttgcgtagtccttctctgtcacttgcttggccaaggat

SEQ ID NO: 5819 - DNA, 423 bp, Cicer arietinum
acctcaagatttcgcagagagcttctgcttgtttatgaatacatacctaatggaacagtagctgatcatcttcatgggaaccgatcgagctcgactttgcttccttgggctgtaaggttgaacattgcagtagaaacagctgaggcattagccttcctccatgcatctgatgtcatgcaccgagacgttaaatccaacaacattctcctagacgagaaatttcatgttaaggttgctgattttggcctctcaaggttgtttccaactgatgtcacacatgtaacaactgctccacaaggagcacctggttatgttgatcctgagtattatcagtgttaccaactcaccgacaagagcgatgtttatagctttggagtagtcttagtcgagcttatatcgtcattacaagccgtggatattaca

SEQ ID NO: 5820 - DNA, 231 bp, Cicer arietinum
aaaactcaaaccggaaaaatatatggtctgtgtccagatttctctttcaaaatgaatctcaatcaacagtaattaacctaaataaaacaagaagaaaagaactgccagaataccaaaaacgataatagatagatgccaaaactgatacaagctggcaaaatgtgcatctcaaagtttaaaagaacaatacatagctaattctaccaacactgcatgcaaattatgatcggt

SEQ ID NO: 5821 - DNA, 422 bp, Cicer arietinum
gcggccgcccggcaggtaccactgaggaagagaagggtccttggatctccgacgaccctactgctgagcagctcagggagatgcagcaaatgctcaccgccaacaccaccactactactctataacgactcggcgtcatcgatcacacacacctacgatcaccaactacagcccctctctcaaagtatacgaacaaaaacatatcgaaaaaaagcataatgggcgcggcgtaagcgggactgtattagaaaaagggaacatccgggtatttcacggacaatattcacgactgggcttaggtttgggtttgggaaacgggacacatccgcttatgaagaggcataggatgagggtttcgaggcaaaggaaaggaaaggaaagggaactgatttgcgccatggagttgacatatcgatacccat

SEQ ID NO: 5822 - DNA, 426 bp, Cicer arietinum
acactaaattaaacggtgattcgtcagacacctaaggatagatcttgcaaggctctagtgttctactttgccgctccatggttctaatacaaggcagctcaaacaatgtcaaacaactcagtgaatatacgagaataaagggcatctcagttctaactactgtcacaaccaacaacaacaagtcttccctgctttttgactaataattattcgttcactttcttcagacagatatcttctttaagcgagcagcaataggcatgcccataaacccaacaaacaagcagaagaaccactgtactattgggcttgtccagttgcttggaccatctatggattggttgcatctcaatttggagatataactactgttatgcaggaggaacataaagatgtgaaaactttccttgatgacttttttggtat

SEQ ID NO: 5823 - DNA, 296 bp, Cicer arietinum
acttcagtgctttgaattacaggtagcaggaccaaatggacaaatattgaaaggtgctgatactaaggttagcatggatgaaagacctggtctcactgttccaagagcacataatcttgtttgtgttccacttgcaagacctggtgctgctgctaaactcctttcctcctaaaacatacattcaaacacttaattcgtccatgtccgtttataaactaaataatcattttcaataaggtatcattgagagagtccacaatgtgtgctagtgatggtacctcggccgcgacacgcta

SEQ ID NO: 5824 - DNA, 78 bp, Cicer arietinum
gaaccaaattcgacgcttcgatttgtatttggtttcagcaagtcttccacaatacattattttgaaccacataagagt

SEQ ID NO: 5825 - DNA, 380 bp, Cicer arietinum
acgcgggggatttcgcaatttcacaaaccctaatttcaaagagatcggcgatggcttcttctaaggatcgtgaaaacttcgtctacatcgccaagctcgccgagcaagctgagcgatacgaagagatggtggattcaatgaagagtgttgcaaatctagatgttgaactgactgttgaagaaaggaatttgctttctgttggttataagaatgtgattggtgctcgcagagcatcgtggaggattctgtcttccattgagcaaaaggaagagacaaagggaaacgatgtaaatgcaaaacggattaaggagtataggcataaggttgaatcagagctttcaaacatctgtaatgatgttatgagagtgattgatgaacac

SEQ ID NO: 5826 - DNA, 405 bp, Cicer arietinum
actgtttacgcaaaatttctttttcttctcttagcttttcgcgctcattcttaataaaagtggaaacagccttcctttcattttcaatatattctgcttctttccgcaactcttcttttttttcgtcaagaagctcccactcagcttcaaacttggccttctcagctttcaacttatcagcctcagccaaaagctccaaattctgagatcgcacaagatctatctcttcctttagtctcacttcaaaaattgacaagtcgcctgtttcactttggatgacctccaatctctcctttgcgttatcaacttgtcttatttcattttccaaagatgccaaagactcctgcagatctcgcttggcttgttcaatatcatctttctcctttagcaaaaggtttttgttta

SEQ ID NO: 5827 - DNA, 143 bp, Cicer arietinum
acgcgggggcgttttggaccgctaaaggaatctgaaacagaagttgatagagttagcagccgggcacgagtggtttttaagaagtgtatggatgcagaggtagcttgcagtagtgctaaaaagttcaacatatttggatcagt

SEQ ID NO: 5828 - DNA, 196 bp, Cicer arietinum
actacttttgctcaagatgggagatggtgcgagggagagaaagctattccattaaagaaaaggagaggaaggttcgagaatgataagatattggagagtaataatgatagtaagaaagtcgtgaagggtaagatgatgaagacgaagatgaataagaaatgttcaacggtaaaagatgaagaagatgaagaagaaa

SEQ ID NO: 5829 - DNA, 222 bp, Cicer arietinum
accaggttgtccggagagctcttcctacggaatccgatgaacacccgaagatttatcgtatgaagctttgggctaccaacgaagttcgtgccaagtccaagttctggtatttcttgaggaagctgaagaaggtgaagaagagcaacggccaagtccttgctatcaatgagatttttgagaagaacccaaccaagattaagaattatggtatatggttgaggc

SEQ ID NO: 5830 - DNA, 378 bp, Cicer arietinum
actcatgtcaccattatcacttgagttaaattattataatttcatttaaaaaataaaaatcttaatttagctcaacgttctgctaccccatttaattataattaagctttaattataaaataatatggacaaggtttcggtatattgtttagatccgataaattttcgatgcttttaaaacttaacaagcgctctgttacgaggtcataaaattatggctgcttctaagcctatctccttgtcgactttaataaaaaccttcttaatttcactcaactaataatttaggaaccttaactcttgttctgggctgtttcccttttgacatacaaccttatcattctatgtctgatgatttaagatatatctttgccattc

SEQ ID NO: 5831 - DNA, 197 bp, Cicer arietinum
accggcttgtcgagggtaggttttggaggctccggcgtcggccttggattcgaaatggtgctcttcgtccgacatggtattttgatttgagggaacggtggttgcggtgacggcgaagagcaaagatgacagaggttagagagtgattggtaggtttttattctttcaaaatcaaaacaagatccccgcgtactgat

SEQ ID NO: 5832 - DNA, 403 bp, Cicer arietinum; identical to SEQ ID NO: 3294

SEQ ID NO: 5833 - DNA, 144 bp, Cicer arietinum
accaagtcttttgcaagcttggggtagtgtatatgtcgacaaaggactcgtagaatgctggatcgtcaactcctactaggacatcatcgtgaaaattatctccagctgaaatcacaaaatcaatattcagattttctcccacta

SEQ ID NO: 5834 - DNA, 402 bp, Cicer arietinum
acttgcatgaccaatatgctggtgattacctcctccatgaggatgctcaacaggattcatagcaacaccacgaaccttaggccagcagtttctcttaaccctaaacttgtggtaagcattaccagctttcaaaagtggcttctcagttcttcctccaccagcaacttgcccaatcattgccctacattcacttggcacaaccttcttggcaccagaaggaagcttgatcctagatgtatcattatcagggttgtgactgataacaatagcgtaatcaccagaggctctagcaaaagcaccacggtcaccaacatgatgctcgacattacaaataacagcaccttcagggatagaacggagaggaagaacattaccaacaacgagagtcgcttttttaccgca

SEQ ID NO: 5835 - DNA, 101 bp, Cicer arietinum
acatcctccattacattcgggaaatcaaaaactgaaatagaaaagatccttaataaaaaactagcctagtagaagaatccaaggaccttaccaccaacatt

SEQ ID NO: 5836 - DNA, 280 bp, Cicer arietinum
acattgcacagcggtccaactgtctgtctccgtatggacttctggacattgttcgagccaagaccaaggtcattgaagattatgtcaagtttaacttgcttctgaaggtaagcaggggagctaaagaagaaaggttaagggttgaagtaaataagaaactaggaggatggtttaatgtgagctggctgaaacaagatctcttctgaaagaattggccatccttatatttattgatgtaagtggagtgatgcttctgttacctaatatatgaaaaacttgt

SEQ ID NO: 5837 - DNA, 339 bp, Cicer arietinum
actaaaaaacaccattcatttccaacaatggatcttctcctattggaaaagacccttttagcccttttcatcgccgccactatcgccatcacaatttcaaaactccgtggcaaaagattcaaacttccaccaggtccaatcccagtccccgtcttcggtaactggcttctagtcggcgatgatctcaaccaccgtaatctcaccgacttagcaaaacggttcggcgatatcttcctccttcgtatgggtcaaagaaacctcgtcgtagtttcatcacctgaactcgcaaaagaggttctccacactcaaggtgtctaattcggttcccgaacaaggaac

SEQ ID NO: 5838 - DNA, 429 bp, Cicer arietinum
accgaatttccttaatggaatgtaaaggtctggtgcatttatgtcataaatcggtggtttataagagagcctaccacccactggctcggtgattctagtccaatgacccctgtgcagaaatggaaacaaaaccaccttcaatttgttcttaacataatggtcattcacttgaaagtagtattggggatcagagaaataccgacttatattgctttggacatactcagagctggatcctaatatttttcctccataagcacccaatccacctcgaatgagtcctgaaccagcaacttgaaatgcactcccaaaaggattaggttgttgtgtgcttgctggaggctgcgccacccctggttgcggtccaacattattatacattcttactgaagagaagcttgaagagagagtggtgagagtggaggcggt

SEQ ID NO: 5839 - DNA, 422 bp, Cicer arietinum
taataatttcctatttctcacactaacaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagat

SEQ ID NO: 5840 - DNA, 384 bp, Cicer arietinum
gatttcgaggcggcccgcccgggcaggtgattctcgagcctgctgagtttgatgagtggatcagggaagtcgatgttggttccgatggcaagatccgttacgaagatttcatcgctagaatggtcgctaagtgaagctacatcatgcaaatcgaatcggtttaaatgctttttcttcttctttctctagtgtttcgttatttcatctgtgatgcttgcttttttttttcattctgttttctgcaagtggattaatcaattaacctagttatgtttattacatctgtttctatttttacttgaaacaattttatgttatgtatctaaccttgagtgtggctttaggaaacgtttggataatcaaattggctatttgtttgggttg

SEQ ID NO: 5841 - DNA, 436 bp, Cicer arietinum
atctccttagccgcaacaaacaatgggacgtgtgatccgtgcacagcgtaagggagctggctccgtcttcaagtctcacacacaccaccgcaaaggaccggcacgtttccgcagtctcgacttcggagaacgtaacggttacctcaaaggtgttgtaactgacgttattcacgatccaggtcgcggtgcacctctcgctaaagttactttccgtcacccgttccgttacaagaaacagaacgaactcttcgtcgccgctgaaggtttatacaccggtcaattcatttactgcggtaaaaaagcgactctcgttgttggtaatgttcttcctctccgttctatccctgaaggtgctgttatttgtaatgtcgagcatcatgttggtgaccgtggtgcttttgctagagcctctggtgattacgctattgttatcagt

SEQ ID NO: 5842 - DNA, 362 bp, Cicer arietinum
acggtggtccctttctccgatgaatggtgggccctcgttcaatcatccccttggtttcgtgattactggcttcgtgaacgcttccaagatccccaaaatcataacgacacttcctacttctctgatttcgagatcgatgaagatgatcttttccatcaaatcgagccacaacacgaagatgaaggaggggacgggaaagaaatggtgaggttgcgagatttgaaatggagaggatgtgatggatgggctgaagttcctaggtatgcggaaaaggctccgaagattgttaagcccagagtgagcccacgggctattcatcagcctaggtagatgatgacaagtggaaacaccgtttgcgttgt

SEQ ID NO: 5843 - DNA, 430 bp, Cicer arietinum
aatatcttatttctcacactagcaatattcttaattcatcatcatgggtgttttcagttttgaggatgaggccacctcaattgtagctcctgctactctctacaaagctctagttacagatgctgacaaccttactccaaaggttattgatgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttct

SEQ ID NO: 5844 - DNA, 425 bp, Cicer arietinum
ccaaaaaaagaacaacaaacacccaaaagctgccgcgaaacaagggtgattcagcgtctatcagaagccactgattcagcagagaagagatacttcactcgtgaaagaactgaatcatgcgcgggatcataagggtggtctttggatgggatttcaagtattgcaggaacaggcttgttataactatcaaccaaaaaccttatcatatttgcaacaaattggctaatcagcacaatagtaatatcctcccttgttgtgaattctttgaatgcatcctcgatttgtttgacagttgtttttgaatccacaatgaggtaatttgtcttcctacgtatgtcaacgtttcccactccagccaaaagaaacccaactatggtatcctcatctgcaatcatagcaataagtgatgaattgctggtaggaat

SEQ ID NO: 5845 - DNA, 137 bp, Cicer arietinum
aacaagagcttggagataagccatattttggtggagaggagtttgggtatgttgatgtggctcttattcccttcacaagttggttttacacttatgagacctatgggaaactaaacatagaggaagagtgtcctaag

SEQ ID NO: 5846 - DNA, 433 bp, Cicer arietinum
actgctggaatctcaggtggtcacataaatccagcggtgacatttgggttatttttggcgaggaagttgtcattgaccagggcactgttctacatggtgatgcaagtgttgggtgctatttgtggtgctggtgttgtgaaagggtttgaaggaaaaacaagatttggtgatcttaaaggtggtgccaactttgtgaaccctggttacaccaaaggtgatggacttggtgctgaaattgttggcactttcattcttgtttacaccgttttctcagccactgatgctaagcgtagcgccagagactctcatgtccctattttggcaccattgccaattgggttcgctgtgttcttggtgcatttggctacaatcccaattactggaaccggtattaatccagctcgtagtctcggtgctgcaattatcttcaaca

SEQ ID NO: 5847 - DNA, 247 bp, Cicer arietinum
  misc_feature (1)..(1): n is a, c, g, or t
nacccgctggattgccctattcattcccagatacctgtgccggtggggaatggaaaattgttcaaggactttcgatcgatgagttctcaaggaagaagttggatttgacagcagaagagctttccgaggaaaagaatctggcttactcttgcctctcttagactgttttttttgtctatagaagtagcttcaattttgaataatgctccttctagatatatatgagttatcagaatctcttcctttg

SEQ ID NO: 5848 - DNA, 436 bp, Cicer arietinum
acgtctttatcggaaactcttacttcgatttcagggagtgtttggttggactttgatgactcaatatcattattatcatcaggtaaaataaaagatctcttcactataatcgcttttttctttgttccttgctcttctagactctgcaaacgctcttttagttgtttcacatactttattgcatctcccaacaccgaagccttatccatcttcttgaggccaggaacgagggccgaaagagcaatgaaacttcgggtaagtttttcccttcgttttctttcggccattacatgttcttgagcttgagttgagtttctcatggtctgattcgctcggttatcataatttgataatattttttcttcatatgaaccttgagaaaccaaacctgtaattttctctattttaggctttagatcggaataatccaagttgt

SEQ ID NO: 5849 - DNA, 352 bp, Cicer arietinum
ctatttggtcaacctatcaaagttaactgggcatatgctagtggtcagagagaggatacatcaggccattacaacatattcgttggcgacctcagtcctgaggttacagatgctacacttttcgcatgcttttctgtctatggaagttgttcagatgcaagggttatgtgggatcagaagactgggcgttcaaggggattcgggtttgtttcatttcgtagtcagcaggatgctcaaagtgctataaatgatttgaccggaaagtggcttggaagtagacaaatacgctgcatctgggcaacaaaaggtgccggcggcattgaagagaagcaaaactcagacaacaaaagtg

SEQ ID NO: 5850 - DNA, 402 bp, Cicer arietinum
acaaaaacgagaaccacagtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacgtgagtagcgagaaccaccatcaccaccaccatatccacgatctctgctaccaccataaccaccaccacctcctccgccatatccacctccaccaccatatcctccaccgccacctctgttatatccaccttcacgacgtccaccaccatatccaccgcctccaccatatccaccgccaccacggccgcctccaccaccgctaccacgagactgagcttcgttcacggt

SEQ ID NO: 5851 - DNA, 432 bp, Cicer arietinum
tgttgccgcggtaggggtagaactaaattattcgggatgggtagggttatcagggcacaacgtaagggtgcgggatcagtcttcaaatcccacacccaccaccgtaagggaccagccagattccgcagtctcgatttcggtgaaagaaacggttacctcaagggagtaatcaccgatatcatccatgaccctggtcgtggtgcacccctcgctaaggtctctttccgtcatccttttaggtataagaaacagagtgagcttttcgttgctgctgaaggaatctacactggacagtttatttactgtggaaagaaagctactcttgttgttggtaatgttttgcctctcagatctatccctgaaggagctgctatttgcaatgttgaacaccatgttggtgaccgtggtgctttcgctaggtgttctggtgat

SEQ ID NO: 5852 - DNA, 258 bp, Cicer arietinum
acagagaagttaccaacttttaagctatcctcttgtcactttcaataaagattcaacataaaacaataccaaggacagcataaaataccagaaacaaaatccttataaatactaaaaaaccaacttaaacgatagcattagcagcacttgcaatcctaggccacaaatcaacacactcctttccaattggaccagtgatagcagaacctttcatttctcctttaggattcacaatgacaccagcattatcttcaaagt

SEQ ID NO: 5853 - DNA, 316 bp, Cicer arietinum
acttttccctacaacatcaaggaataccttcctgtcgtcgagtcctttggattctccagtcaattgagggctgcaacatcaggacaggctttcccacagtgtgtgtttgatcactgggatatgatgtcatcagatccattggaggctggatcacaagctgcaacacttgttactgatattcgtaaggggaagggtttgaaggagcttttgactccactctccgagttcgaagacaagctttaaattatttaaactgttttctttttatttatcaacttaccttatgttctggtcattgaaactgttacctgagctt

SEQ ID NO: 5854 - DNA, 434 bp, Cicer arietinum
acttccatttcctgtcctcacgtgagtggtttagctgcgttcattaaatcggctcatcccgagtggagtccagctgccgtgagatctgctcttatgacaacggcttatacggcttacaaaaacggtctaaaattgcaggacagtgctactggaaaatattcgacgccgtttgatcatggatctggacacgtggaccctgttgctgcacttaatccaggactcgtttatgatttaacagtggatgattatttaggtttcctatgcgcgttaaactatacagcctccgaaatcacagctttggcaaggaggaaattccagtgtgacgcaggtaaaaaatacagtgtggctgatcttaattacccttcgtttgcggtggtttttgattcgatgggtggggccaacgtagtcaaacacaggagaattcttaccaacgt

SEQ ID NO: 5855 - DNA, 202 bp, Cicer arietinum
actaggttgcattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccag

SEQ ID NO: 5856 - DNA, 227 bp, Cicer arietinum
ccccgtaaagagcacaagaggtttaatctgaagaagcttacctatgaggagaggaaagctaagttgattgcacgtttgcaagcacttaacgctgctgttgatgacgaggatgaggatgaggatgatgagtgaaaagctttgtgtttgcagcccaagtgatggactatctagatctttttataatttccatttagataaacgttttcgtgagaatttttgtcgcctat

SEQ ID NO: 5857 - DNA, 438 bp, Cicer arietinum
acatttttcgtggaaatcacaatggtcgttaccttagtgatcttcatgttttggatttgagaagttggacttggtcaaaggtcgaggctaaggctggagatgagtcccctacaactttgaacccttgtgctggccattctttgattgcatggggaaataagctcctgtcaattgctggtcacacaaaagatccttccgaaagtatccaagcaaaagagtttgatctacaaacagcaacatggtcaactctaaagacttatgggaaagctccgatatcacgaggaggccaatcagtgacccttgttgggaatagcttagtaatttttggtgggcaagatgcaaagaggactctattgaatgacctgcatattcttgacttggaaactatgacatgggatgaaattgatgctgttggagcgcctccttccccaaggtctg

SEQ ID NO: 5858 - DNA, 410 bp, Cicer arietinum
taaggatcttaccaagccaaagaggcctccgagtgctttcttcgttttcatgtctgacttcagagaacaatataagaaggatcatcctaataacaaatccgtcgccgctgtcggtaaagcttgcggagaagaatggaaatcgttgtctgatgctgataaggctccctatgttgctagggcattgaagaagaaagcagagtatgagaaaaatgttcaggcttacaataggaaacaggcgggaatagaggaggaagatggttctgacaagtcgaaatctgaagttcatgatgaggatgaagaggaggaggacgatgatgaggatgatgatgagtgaagttgctgttacacgtgatgaatcttaggagaaaattggggaaaaaatatttgttttgcttaggttggggttataa

SEQ ID NO: 5859 - DNA, 432 bp, Cicer arietinum
ggcatcttaacttcaggagggagcatgatgacctctatattgatcacaatctgagcttaactgaggctctatgtggcttccagtttactgtcacacatcttgatgggaggcaactattggtcaaatcaaaccctggggaagtcatcaagccaggtcaacataaagctataaatgatgaggggatgccacaacacaataggcctttcatgaggggacgtctttacataaagtttagtgttgatttcccagactcaggttttcttccccctagccaaagccaggcattagaaaagatattacctcaaaagaccagcaagaaattgtcgcaaaaagagctagataattgtgaggagaccaccttgcatgatgtcaatattgcggaggagatgagtcgaaagaagcaacaatacagtgaggcatatgatgacgatg

SEQ ID NO: 5860 - DNA, 386 bp, Cicer arietinum
  misc_feature (386)..(386): n is a, c, g, or t
actgtgttgccaactttgagaagcgctggactgatatgccggttgtggattcaccagctgccagtccgaatgggggaaatcccttcaaggatttctcttatgcgagacctgcagcctcttttcttcaaatgaatagccctgcttgctaacttcatggtttgcattgacttaagacaacacttcttttcttatgatgattaggtagtaaattgtattagttgtatttggttgagtgaacagtgatacactgttacatgaattgccataaaaaaaacatttgtgaactttgcattatgtttgttccttgcagctctacaattgttgagctgactttgctagaacttgttatttgaagaaaataaattgcattattctatacactttan

SEQ ID NO: 5861 - DNA, 414 bp, Cicer arietinum
acaatgctgagaaaaggggcaaacgccaagtaatgattaggccatgctccaaagtcattatcaagttccttatcgttatgcaaaagcacggatacattggcgagttcgagtatgttgatgatcatagatctggaaagatcgttgttgaattgaatggtaggttgaataaatgtggtgttattagtccacgttttgatgttggtgttaagaagattgaaggttggactgctaggcttctcccttcaagacagtttgggtatattgtcttgactacctcagctggcattatggatcatgaagaggccaggagaaagaatgttggtggtaaggtccttggattcttctactaggctagtttttattaaggatcttttctatttcagtttttgatttaccgaatgtaatggaggatgt

SEQ ID NO: 5862 - DNA, 295 bp, Cicer arietinum
agagaagattccacgccgcagccatgggaagaagacctgcaaggtgttacagacaaattaaaaacaagccttaccccaagtcacgtttctgtcgtggtgttcctgatcccaagatcagaatttacgatgttggcatgaagaagaagggtgttgatgagtttcctttctgtgttcatctggttagttgggagaaagaaaatgtttcaagtgaggcactggaagctgctaggattgcttgcttcaaatacatgtccaaatttgctggaaaggatacattccacttgagagtcagggt

SEQ ID NO: 5863 - DNA, 436 bp, Cicer arietinum
actgctggaatctcaggtggtcacataaatccagcggtgacatttgggttatttttggcgaggaagttgtcattgaccagggcactgttctacatggtgatgcaagtgttgggtgctatttgtggtgctggtgttgtgaaagggtttgaaggaaaaacaagatttggtgatcttaaaggtggtgccaactttgtgaaccctggttacaccaaaggtgatggacttggtgctgaaattgttggcactttcattcttgtttacaccgttttctcagccactgatgctaagcgtagcgccagagactctcatgtccctattttggcaccattgccaattgggttcgctgtgttcttggtgcatttggctacaatcccaattactggaaccggtattaatccagctcgtagtctcggtgctgcaattatcttcaacaagg

SEQ ID NO: 5864 - DNA, 360 bp, Cicer arietinum
acagatctatggcatgctctcttcgcagcacgaacgatatcttcaatctgtgggacggctaacctcaccaaatttgctgcataaggcatgggaacatcagccccagcaattctctcaaccggtgcatcaagataaccaaaactctcttcaatgacagatgtgcagatttcagcgccaacaccgtgctggggaaacccttcttcaactgtcaccaatctgttggttttcctgacagaggcattgatggtggatcgatcaagcggtcggattgaccgtaaattaataacctcagcactgattccttcctttgctagtatctcagcagccttgagagcatatcctaccatttttgagaaggct

SEQ ID NO: 5865 - DNA, 405 bp, Cicer arietinum
actgaatctcacaaaaccaaagcctttatcacgctggacacgaacctcctctatcacaccagccccgagggaatagaaatggcgatggagatcaagctgtgttacctctgaaccaaggttacccacataaacagttgtatattgaggattgttctcaggagcatcaccgttggatgtctctttaccgtcctcagatgaaccatttgttagttccaccacacttttgttgtctgagttttgcttctcttcaatgccgccggcaccttttgttgcccagttgcagcgtatttgtctacttccaagccactttccggtcaaatcatttatagcactttgagcatcctgctgactacgaaatgaaacaaacccgaatccccttgaacgcccagtcttctgatcccacat

SEQ ID NO: 5866 - DNA, 345 bp, Cicer arietinum
accgaggtcaaccccttcgccggcaaggctaacagcggtgctacctggaccaacgacatcagccacggagagctgatccgaaccagcaacgaccagaccttccccgtcgacccttgcaacctccagctcctctaccagggccgcaaccccagcatcggtggcgattacaacagccttccttaccgccctggtctgctcactctcaagaagtaaatggaatgaaaaacagtgctagcactgcttttctttcttctgggttttgcacggacgtggatgctggacacccagttttgcgttgcaaatgggattatcatggtgattcatccatgacactcattcatctgt

SEQ ID NO: 5867 - DNA, 320 bp, Cicer arietinum
  misc_feature (1)..(1): n is a, c, g, or t
nggtgcttttctactactggaggaaaaaaaaagctcgagatcgacgatgatctgaaactacgagcattttgggacaagaggatttcacaagaggtcaatggtgatgctcttggtgaggaatttaagggctatgtcttcaaaattactggtgggtgtgacaagcaaggatttccaatgaagcaaggagtgctgacccctggccgtgttctttttttgcttcacaggggaactccttgctttcgtggatatggaaggcgcaatggacaacgcaggaggaagtctgttcgtggatgcattgtcagcccagacctctctgtcct

SEQ ID NO: 5868 - DNA, 398 bp, Cicer arietinum
accaattcaccggaatatccaatatatgattttacatacgaatttcaaaacaaagaaataaaggaaggtttgatgatttcatgaatgcaaaatgattttgacctaataaaaccaactgacaacaaaacagaaatgcataatgtgaataggaagtagcctctcccatcctgggtcaacaatcacaaatgactccaagaatagaaaagcaactatgcatagaaaaggtaatatggatgataaacagactagggatacacagtgaggtgatggaaaaaaaatgactcaagaagatgcagggttaaaagtcagaaaaaggaagagaatatctagaaacaaagcacttaggtggtgttgatgaaaaccagttgaatcctgggagttcatccattccaataacc

SEQ ID NO: 5869 - DNA, 362 bp, Cicer arietinum
gcagaaaccgatcatcaagagaaatcaggaaatcagttataagtccaggcatttcgggaagaaaccagttctgcactttcaatggttccactgatatggtaatctcatggtcccatgatccatcttgtgtcttgaaaaatcgtatcatgttgcttgttaacgcacttccttctaaacctgtatctttagcaggatcatgcaggaaccttatctccaagggtaaaagtcctttctcaccaaggtcaattgtttgtttcagttcacccccgggccagttgtatacatggagatgcctcccataaagtccatcagagacatgctgcaagttaaaaccttgtttaaaagcagtaggagcaccccat

SEQ ID NO: 5870 - DNA, 291 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtg

SEQ ID NO: 5871 - DNA, 259 bp, Cicer arietinum
acaaattcaccaaaagtctttactctgctcggtcaatcgcagctgctttccttgctaaaatccaatgatcccttgccatagttcgctccaagattcattctttcagagacctcaatgcgattctggtatatacaaatttctgcgaatattttttctcatttcatgaagaggctgggtattcgtggtgtagtaatggtatgtcggggcgttgttggaacgtttcatatcgacattccgtgggataaatcccgacgcgatg

SEQ ID NO: 5872 - DNA, 424 bp, Cicer arietinum
gttacaacattctccgtgcttttgcaactattaaccatcttcacttccaggcttattatttggctatgcaatttcctattgagaaggctcctactaagaaaattgcgactttaaaaggtggagtgaaggtacctgaattgctgaagtatccggtgagaggtcttgtttttgaaggcggcgacaccctcgaagatttatcaaacattgtttcagaggcttgcatttcccttcaaaacaacaacataccttacaatgttcttatttctgactgtggaagccaagtctttctgctacctcagtgttatgcagagaaacaagcccttggagaagtggacgcggagcttctcgacacacaagtgaatcctgcagtttgggagatcagtggacacatggtattgaagaggaaaaaggattttgatgaagc

SEQ ID NO: 5873 - DNA, 249 bp, Cicer arietinum
cgacgccgattgccatgggtttttcccctttgaaggcaagccgcaccgccggcctctgattccttcccaaggtttttccctgccgccacgacatacgactatgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgcg

SEQ ID NO: 5874 - DNA, 242 bp, Cicer arietinum
  misc_feature (229)..(229): n is a, c, g, or t
acaatgctgacaaaaggggtaaacgccaagtaatgattaggccatcctccaaagtcattatcaagttccttatcgttatgcaaaagcacggatacattggcgagttcgagtatgttgatgatcatagatctggaaagatcgttgttgaattgaatggtaggttgaataaatgtggtgttattagtccacgttttgatgttggtgttaaggatattgaaggttggactgntaggcttctccct

SEQ ID NO: 5875 - DNA, 164 bp, Cicer arietinum
accatatttccccccaatggcaaagatgacctgatgaactttgaagttgtaattcgacctgatgatggattttacttaggtggcacatttttgttttccttccaagtgtctcccatctatccacactaagcacccaaagtgaagaggaagacaaaagtctacca

SEQ ID NO: 5876 - DNA, 431 bp, Cicer arietinum
acgcggggtttccagcagggacgtttacttaaaggattattacccttctagatattgctggggcttgtgtccttgtttggagtggttaaagttgtaatgttttgaggttgtgtactgatgaatcccctaatgattttggtaaaaatcgttaagttaaggtggatacacatcttgtcatatgatcaaatggtttcgcgaaaaatcaataatcagactacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctc

SEQ ID NO: 5877 - DNA, 375 bp, Cicer arietinum
ctcagatcgcttggcgtttccagaggccaactatccaatatgagtaagcttcagagtgatgctttgagagaagccatctcaggaatcacggctgattccaaggagaaaaacaggaaatttgtggagactattgaactccagattggtcttaaaaactatgatccacaaaaggataagcgtttcagtggttctgttaaattgcctcacattcctcgtcccaagatgaaaatctgtatgcttggagacgctcagcatgttgaggaggcagagaaaataggattggactggatggatgttgaagctttgaagaagctaaacaaaaataagaaattggtgaagaaacttgcaaagaagtacctcggccgcgacacgcta

SEQ ID NO: 5878 - DNA, 427 bp, Cicer arietinum
tcagcttttacccagaggacgatgttgtgattgcaaatctggatgccgataaatatagggatctggctgaaaagtatgatgtgagtggatttcctaccttgaagttcttccccaagagcaataaagccggtgaagattacggaggtggaagagacttagatgattttgtagcttttatcaatgagaaatctggaacaagtcgaggtgcttttggacagcttacttctgaggctggcatagtagaaaatttggacgtcttggtaaaagagtttgtagctgctagtgacgaagaaaagaagaccgtctttgcccgaatggaagaggaagttgagaagcttaagggatctgcttcaagatgcgggaagatttacttgaaagctgccaagaattacagggagaaaggttctgattatgctaagaatgaaat

SEQ ID NO: 5879 - DNA, 433 bp, Cicer arietinum
gtaaaaattttttcccggcacgcacggaaagagcactgttaggagcgggattttctacgggctactcggccacacaatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaa

SEQ ID NO: 5880 - DNA, 293 bp, Cicer arietinum; identical to SEQ ID NO: 796

SEQ ID NO: 5881 - DNA, 431 bp, Cicer arietinum
actttgacctacgccttccttatcgagatgagactgatgataaagttacagttgaaagtgcagaagcaactctcaagtataacgtagcaatcaagtgtgcaactatcactccagatgaagctcgtgtcaaggagtttggcctgaagcagatgtggaagagtccaaacgggacaattagaaacattttgaatggaactgtcttcagagaaccaattatttgcaaaaacgtccctcgccttattcctggttggacaaagccaatatgtattggaaggcatgcttttggtgatcaatatcgggccactgacagcgtaattaaaggagctggaaagttgaagctggtgtttgttccggaaggccaaggtgaggcgaccgaattggaggtttataacttcactggtgaaggaggtgttgcattggctatgtacctc

SEQ ID NO: 5882 - DNA, 435 bp, Cicer arietinum
actattttcgaacgatcactgtgcttctgagctgccatcagtttgacctgatgcgaccttcagagagcatggccgatttggaggggaagaaacgcaatcaacgtttactcggcccggtaattactcctctacttcgactcgcatagccccttggctggtcccagaccttcattgggtttcctgcataccctttcaactattggacctttttttcttggtttcatttcttggagttatacgtatatgccctcaagaagatcttgagatgaggagttgccaaattcttttcatcagcatcaggctctggtcaggggtgggcggtcctggaggtttggcgtgtttatttgcatttacgacgatctgttatgtttgggaggcctgtccaacccaaccgcagcaatctgtttgcggtagcggagggcatggtcaccgatt

SEQ ID NO: 5883 - DNA, 428 bp, Cicer arietinum
acaatgcttacactagaggattttcaacaagaattgaaatgcaatattaacataaagcacagagaggaatttgatgaagagaaagaacctgatggaatggttctatcaggatggactcaaccagtgtcagccgcagaaaatgaagacaagtctgttagtaatggtgcaaacacatctgataacaatgatgagataggcatagtttctccattgaagaaacgaaagctccctgatgattccgataagtcaaataccactgacgatgcaagacataacaagcaattgcaagttatcgatgatgaagacgatcttgtcatgcttgatggggatttagatggctttaaaaagagaagagtgtcatagtaagtagtaactattaattaatctggatgagatcttgcattctagttttgtatttgattagaggt

SEQ ID NO: 5884 - DNA, 408 bp, Cicer arietinum
gcttcgatttgtcatgacctccatcggcaagaagctcactgatgatgaggttgatgagatgatccgagaggctgaccaggacggcgatggccgaatcgactacaacgagttcgtccagctcatgatgcaaaaataagagacaatattctgatacctcatcgaccaaaccttcggtcctgctatctctcgctagtcgatgagtaacgaacacgcatggcatgaggagggaactggttgaatcttctttacttagtggcaaaactgcaagcgaaacgaagggcatctgggactggttggactgaagttgtggagggtaatcggcttgcttcccgtgttacttgctatctctgtggcttttgtgccacgggctctgccttcatggcttctaacaactgagcaattttccat

SEQ ID NO: 5885 - DNA, 436 bp, Cicer arietinum
tgtgcttgttctccctatcttccaccatccaattcaagatgaagaaaaacttttccatattgtttgtgatttttcttactttctatgttctctatgtctctgctatccctgcaacaagaaccaaaaatttggaaggtgatgattcatctgtttttccttctttaactaaggaacaaggttcattaaagttggaaaatggtgaagaaattatggaatatatggatgaaagattagagaggaggattgatttggatatccaagattatggtgggactggtgcaaataaagatcatgacccaaaatcacctggaaatgatggtaattgatgtgaaaaatatatttagattaaattaatcacatcctaaactttagggaaggatctaaaatgtgtgatattgttttctcttagaatcaaatatatagattatgtgtggtt

SEQ ID NO: 5886 - DNA, 234 bp, Cicer arietinum
actgacctacatcattcattcggctgacatttcatctaccttctgaattgcatgttgatgttggagagagggctttgtgtttttatttattattattatgagttatgattaattaacgtgtttgtagaacgcggcggagaaaggggataatatgttatgtaatgataataatgatagattgaggtgttatgtttgttttcctagtgagtgaagaaaagaatatgatcagttcat

SEQ ID NO: 5887 - DNA, 210 bp, Cicer arietinum
caggtaccctgttacagaggcttaggttctatttttttcacttttaaatttcttttgtcatgaatagcatagggtgaatgctccttcctagttaaaattttgttcaagttccctttgattctgtatttcctatggtgatgtattttaaaaaactggcctattttatcaatgtaggctgatgtaatatttattatagaattcaaattacgc

SEQ ID NO: 5888 - DNA, 436 bp, Cicer arietinum
acttccatacacctcataagcgcggttgaattttgccacagtagaggagttgcacaccgcgatttaaaacctgagaatttgttactcgacgaacacggagaccttaaaatctccgattttggtctctccgctttgccagaacagcttcggcaggacgggcttttacatactcaatgtgggacccccgcttacgtggcacccgaggttgttagaaaaagaggttataacggttttaaagctgatacttggtcttgtggtgttattctttatgctttacttgctggatttcttccttttcaacatgaaaatcttattactatgtataataaggttttcaaagaagagtatcgattcccaccttggttttcgcctgaatcaaagagattaatctcgaagattctagttgcggatcctgaaagaagaatcactatttctt

SEQ ID NO: 5889 - DNA, 359 bp, Cicer arietinum
actcatagttgatatcaatgccatctattatgttaaagctccaaggatccttgacttcgttgtattgctggatgatctttttgagtgagtttacagcattgtcaggccattctacttttgaagcaggattgaatggatgtttatcaccacgaccaccgatgcttattacttttcttcacatttttatgattttgcttgagttccttcactttttcaggactgaagaaatgaacgttccaactggggttgaaaactcctgtgccttttccactatcatcgtaagtctctgtggcaaagcctaaaatgaagtggaattggtggatcttggagttgatgatatcagttgggaaattatgtaa

SEQ ID NO: 5890 - DNA, 256 bp, Cicer arietinum
ccgactttgacgccctagccagagaattctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcgg

SEQ ID NO: 5891 - DNA, 405 bp, Cicer arietinum
actacattcgcgaagacctcacgaaagaggttctgattgatggatggttccatacaggggatattggagagtggcaacctaatggaagcatgaagattattgaccggaagaaaaacatattcaagctttcacaaggagaatatgttgccgttgaaaacctggagaatattttcggccaagttccttctattgaatctatatgggtttacggaaacagttttgaggccttccttgttgctgttgttaaccccagaaagcaggcacttgaacattgggcagagcaaaatggtatatcaatggacttcaattctctgtgtgaagattctagggcaaaaggttacatacttgaagagctctcgaagattggaaaggaaaagaaggttttattctatctaatttaagttt

SEQ ID NO: 5892 - DNA, 344 bp, Cicer arietinum
accagatgtttacttaacacatttactataacagcacaccacttccaaaacatggatcaaagcagcaccaattgtttcttgtgcctactgtgatctcaatgaaaaaggtaacaattaccaaattcttgttattaacaataacagtgtatttgaggattcactttgtaacaagtaatattgaacataagcattagatatttttcatctttttcaattaacatcttattttgttgaacatactggaaactgaatgtaatgcacaacacggcactcttttgcttacgtatagagaataaaaatcactgagatcctttgagcttctttgcaatacctgcaaatacctg

SEQ ID NO: 5893 - DNA, 362 bp, Cicer arietinum
acggtggactatctctccgatgaatggagggccctcgttcaatcatccccttggtttcgtgattactggcttcgtgaacgcttccaagatccccaaaatcataacgacacttcctacttctctgatttcgagatcgatgaagatgatcttttccatcaaatcgagccacaacacgaagatgaaggaggagacgggaaagaaatggtgaggttgctagatttgaaatggagaggatgtgatgtatgggctgaagttcctaggtatgcggaaaaggctccgaagattgttaagcccagagtgagcccacgggctattcatcagcctaggtagatgatgacaagtggaaacaccgtttgcgttgt

SEQ ID NO: 5894 - DNA, 417 bp, Cicer arietinum
acagagcttacctggagaccgtggaatgaggcgactacctcgtccacagagcagcgttctggccgctttggggttttctcctgcaagggttttccccaaggatgcacggttctagggttgcagctactggcgatctttggggatcatggacttcctgcctcagggtatggaaagctacttgatctatctgtgcaagagaattctaggctggagaggaatagttcccgctgacgggatgacctcttgaaagtaaatgcgcctttgtgccgatgatatgctggatgaactagatgggagacgctgctggagggaagctctgcgaggatcaactgtattgatgtccaatgggacgtgcttcaccgacaactactgtagggcgagctatgagtagagaggtgcctcttgggggtaatgagt

SEQ ID NO: 5895 - DNA, 260 bp, Cicer arietinum
acttttccccacggaggtgctaaatgccgagcaactggtagcgggtttgttgtccgtcacataaagtttgctgaaaattacagactttattctcgaagccactttgtcaaagcgcttgaagtagctctgctacttatagtttacatcgcttatggatatgcagagggaggtgctgttacatatgttttgctaactcttagcagttgttttccttgtcatttcttggctttttgctccttacatttttaacccctccggtt

SEQ ID NO: 5896 - DNA, 451 bp, Cicer arietinum
gatttcggaggcgggccgcccgggcaggtatccctgctcggtcttttatgaagaataatggcagcagctcatccaaacatctgttattaaatgacacgttgaagatttgggttccatcaagcccaagaggtgcagaaagattacctccggcgataattgaagctgagtcagacttttatttgcgtagattgtggggtgagccaagtgaggatttaacctcaaagccgaaatacctcgtgaccttcactgtcggttatgatcagaaaaataatattgatgcagctgtgaaaaagttttcagggaatttcactatacttctgtttcattatgatggccgaacaactgaatgggatgagtttgaatggtctaagcaagctattcatgtgagtgctcgcaaacagacaaaatggtggtatgctaaacggtttctgcatcctgacattgtggcacc

SEQ ID NO: 5897 - DNA, 211 bp, Cicer arietinum
atggtggcggtgatggtggttctcgctactcacgtggcggtgaaggtggtggaaactggagggactagatttaagttcttcttgttggggtttatgattaagaatgttctccttgtcatgtcactttagtaggtttaagaaattagtggtttggctatggtatttatcatgttatggttttgtgttactgtggttctcgtttttgtttttt

SEQ ID NO: 5898 - DNA, 426 bp, Cicer arietinum
actatatgccttcaatgcaggcttgctttccaagctaccaagtaaagaaaaactagaagtatccttggagactcttcaatgtgaagtatatacagtatctccaatcagggtgtttggtcatgatgtgcaatttgcaccaattggattgcttgacatgtactctcgcggtagtttcatttttcctggagctcagtcctatcctcatcgccacttttcggaggaagtagctgtccttgatggttactttgggaagcttggatcaggcagtatggcttatattatgggcggttccaacgaagcacaaaattggcatgtttactctgcctctgcagattccgtgagcccaattgactctgtctacactttagagatgtgcatgactggcctagacagagagaaagctttggttttcttcaaagaacaatc

SEQ ID NO: 5899 - DNA, 222 bp, Cicer arietinum
acaccaatgcggcatgctagagaaggggctgcgttattgcgttctggaaaaggagacgaggatgttcttaaaggcggatttgaagaaccactttggatcacatgtgagtaatagtgaggctgatgataattaagaaggataatgtatattttggtggaccataaattggttggtgaaatggtcacgcgcattgaccagcacactgcgtttctgaattcccaa

SEQ ID NO: 5900 - DNA, 434 bp, Cicer arietinum
ccacaggtctgtcacaatggcagtggcagctctagagggcggtatggcactggcaaggcagctatgcatacaggtccaccggcgcaaaaaccagaaaagatcccagtcgggagggagattcgagagaaattatctggtggtgttgaagcattcacccagaggaaccgcccaggttctagtcctcttggtgaacacaccagacataggacttttgaggatgtgccaatgcataaggatatgcactatgcgcaacacaatgctactcgatatggcagcacttcaagaagagccatggcctcatcaaacaagccaaatacttcaggtgaccataccggcaggatgaccacaagtgggaaccgaccatctgccgcacatagaattcaaccaatgtatgacaccaaacaagcaactttcgcacgcaatgggtcactgag

SEQ ID NO: 5901 - DNA, 299 bp, Cicer arietinum; identical to SEQ ID NO: 5537

SEQ ID NO: 5902 - DNA, 455 bp, Cicer arietinum
gatttgcctgctaacaaggaaggtagatttggattcaacttattggtgggcggtttctttagtcccaagagatgtgcagaagcagctccacttgatgcatgggtctctgcagatgacgttatcccactttgtaaagctgttcttgagacatatagagaccttggcaccagaggcaatagacagaaaaccagaatgatgtggttgattgacgaactgggaatagaagtattcagatcagaggtggaaaaaagaatgccagagaagaagctttcaagagcatcccaagaagatcttattcaaaaaaaatgggaaagaagagactacttaggtgttcatccacaaaaacaagagggtttaagctatgttggtattcacattccagttggtagaatccaagcagatgagatggacgagctagctcgtttggccgacgaatatggcacaggggaactccg

SEQ ID NO: 5903 - DNA, 288 bp, Cicer arietinum
accgttgtttccccggtggtctagcctggaccaccgacagcgacgccctagccaaagccttctcttcctacggcgaagttactgattccaaggttattaacgaccgtgagactggaaggtcaaggggttttggatttgtgacgttttcaactgagcaatccatgagagacgcaattgaagggatgaacggtcaagatgttgacggacgtatttttaccgtgaacgaagctcagtctcgtggtagcggtggtggaggcggccgtggtggcggtggatatggtggaggcg

SEQ ID NO: 5904 - DNA, 160 bp, Cicer arietinum
gcaaaaaacatggactccaatagaagatagtgccactttacaacagacaatctcttacacgatgtcacgcattaatcgatcaaccgaactcggtttacagcacaaagctcaacctagaaattaaaacagttgggctgtcggattaagcttaattgggcat

SEQ ID NO: 5905 - DNA, 292 bp, Cicer arietinum
acatttatttccacaattagcttcacttacactatcaccattagtgtatttgctcatataatgctcaactccttcaattttgtagtaatgaaattcactttctttgcatgttgctataggcttagcactacatttattgctccacccaaatattccattttctaatggacaaccaacacattgattttcctcacaaagcccaaattttccacatctttgtggcaattgacactcactctcatcaaaatctctatcaaagagagtgtatgtcacttgccaaacaccatcacgt

SEQ ID NO: 5906 - DNA, 435 bp, Cicer arietinum
gtggaaaggcagaagtaacagggaagaatgtgaagagtatatcttctaattcatctgctactgagcaagacttggatacatttcttcttggagatcttgaagacagtgatgaagctccagatgatggtgatggcagctttgatgatgattttgacaagattggcaattctgatgttgaagatgagaagcatgcaaagaaagcatctgctacaacagtttaggatacgtaattaccttttaagacagttgaaattgaagtttgctgcttgcaactagcagagatatccgccagagacgaatggttgtagcagtctcaaacggtggctgtggcactctagatttggtgaattggtggagaaagcttatgtaatttgttattgtttatttgttgaccatattaccctatatagtggcggattaactcattagataaga

SEQ ID NO: 5907 - DNA, 424 bp, Cicer arietinum
acaatttttttcaaaattgcccttctgtatatgaaacattgatgcattgagtctgtttttattgcagtattttggaccgagttttgtccacgacggaagcaagatgtcactatcacctccacaatatgtagacccttatgcactcttagaagatgaaaggatatctcagatacagatagcacctcagctaaattgaattaaaggcaacattaggaaacctagtcacatatattgactgaattctgtcttttgcattttgcatatatgttgtgtatagtttatttaaatctaaatgaaagccctattagtagtgacattactcttaaatttttattttccacttagaagttaaatatgtctggattaagttgcagatcatatgaagtccatacaattgtctgaaaaaaatgaagttttgatagct

SEQ ID NO: 5908 - DNA, 161 bp, Cicer arietinum
ggcagagttacctgtgaatcaggcaaaacaatatgcagattcaagaccaagttatccgctacagctattccaattcatagcttcaaaaactccctctcacaacctcgtttgggacgtcgctaccggaagtggccaagccgccaaatctttagctacattgt

SEQ ID NO: 5909 - DNA, 430 bp, Cicer arietinum
acgacactgttcatggtcaatggaagcattttgaccttaaggttaaggactctaaaacccttctctttggtgagaagaccgttactgtttttggaactaggaaccctgaggagattccatggggtgaggttggagctgattatgttgttgagtcaactggtgttttcactgacaaggataaagctgctgctcacttgaagggtggtgccattaaggttgtcatttcagccccaagcaaagatgcacccatgtttgttgttggtgttaacgaaaatgaatacaagccagagcttaacattgtttccaatgctagctgcacaaccaattgccttgctccccttgccaaggttcttaatgaccgatttggaatcgtcgagggtcttatgaccactgtccactccatcacagctacccagaagactgttgacgg

SEQ ID NO: 5910 - DNA, 404 bp, Cicer arietinum
accattcttcctaacctcggtaagacgagcaccgagcttggttgcaaggacgtgactgagaggcatgagttcaggtgtttcatcagtggcatagccaaacatgtgaccttggtcaccagcaccaacttcctccggacgcttggtaaagtgtccgtgaacaccctgagcgatatcaggactctgttgctcgatgttgaccaagactttgcacttgtcagcatcaagaccaacatcatcagagatgaatccaatggtgcggcatgtgtcacggacaatcttctcatagtctacattggctttggttgttatctctccaaagaccatgaccatgtttgtcttggtgcatgtttcacaggcaaccttgctgtcaggatcctgttcaagacaggcatcaagcactgcat

SEQ ID NO: 5911 - DNA, 429 bp, Cicer arietinum
acactttacctatgcttgggtatgcagaggagcacgagacagttgtgttggagctgacatataactatggtgtcactgaatacaccaagggaaatgcttatgcccagattgctattggcactgatgatgtatacaagagtgctgaagtagtcaaaacagtcattcaagagcttggagggaagattaccagggaaccagggccaattctctggcctcaacacaaagatcacttctttcttagatccagatggatggaaaactgtgttggttgacaatcaagattttctgaaggaactggaatgaagaagctttccacgaattatgagtgttgctgctattttataataagttgtctgtcttgatgattgaagatcagcatgtatgttatctcagtataatagtcttcagtatggcttttatgatatgtct

SEQ ID NO: 5912 - DNA, 246 bp, Cicer arietinum
ccaagctgttgttgacctagccgctgctataaaggctggattttatgacatcggtattggtgcgggtttggaatccatgacaactaatccaatggcatgggaaggatcagtgaatcctaaagttcaaatgtttgagcaagcccaaaactgccttctcccaatggggattacctctgaaaatgtttacaatcgctttggggtttcaaggaaagaacattattaagctgcagtcgagtctcacgggcg

SEQ ID NO: 5913 - DNA, 293 bp, Cicer arietinum
actaggttgaattactattgcgacactgtcatcagtagggcaaaactaacctgtctcacgacggtctaatcccagctcacgtcccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 5914 - DNA, 440 bp, Cicer arietinum
caaccttactccaaaggttattgatgccattaagagtgttgaaattgttgaaggaaatggtggccctggaaccatcaagaaattcactttcgccgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggattcattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttatta

SEQ ID NO: 5915 - DNA, 384 bp, Cicer arietinum
gttgaattccgaaggctaccaaggactcgaggaatggcagtctgaaatacattttctaggacggctttctcatcctaacctcgggaagctgttgggatactgttacgagggaacagagcttcttctggtctatgaatacatgcagaagggcagtttggaaaatcatctctttggaaggggcgctgctgttcaaccacttccttgggacctcaggcttaagattgcaattggggctgcttctggcctttctttcttgcatacatccgatagagaaattatttacagagactttaaggcctccaatatattgcttgatgggtcctataatgcaaagatatcagattttgggctagcaaagctgggtccttcagctagtcaatccca

SEQ ID NO: 5916 - DNA, 293 bp, Cicer arietinum
actttgccgaattactattgcgacactgtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 5917 - DNA, 424 bp, Cicer arietinum
ctttgttacccggcttctaaacaccgtgacgtggctgatcggatccgcaaaattgccgatggagacgcggcgcacaggaaaatcttcgttcacggtttaggatgggacaccacctccgcaaccctaatcaatgcattttcgcaatacggtgaaatcgaagactgtaaagcggttactgacaaagtttccggtaaatccaagggttactgtttcatcctctttaagaaacgaagcggagcgcgaaacgcgttgaaggagcctcagaagaagatcggtaaccgtatgacggcgtgcctgctggcatccataggtcccgtgcagaattctctgcaacctacgccgcaggttacgccgcaaacgtctgagtatacgcagaagaagatctatatcagtaatgttggccccgatcttgatcctcagaagc

SEQ ID NO: 5918 - DNA, 384 bp, Cicer arietinum
actactgcgcctgaatcattgcaagttagttattatacaaataacaagcattagtatgccgaatgagaatagggcaaaaatatcaattaaaaatcctttagcagcatatagcatgtcctacttcatgattttaaggaataaaagattgactgctgaactttccgtggcagcaaatgtctttgtgactgcttaactctccgcggtaactactgtctttgattgagttaaactttgccaaggtgaaaaggtaaaggcacttgaaataaggtaaattatgaatgcaacatatgcagctgttattgtggacacaatagtggtgagcactgctccattcacttcagaggaaaagaattccagcaaaagatagccatttatcacacctgc

SEQ ID NO: 5919 - DNA, 336 bp, Cicer arietinum
acattgttacacagagtatcacaaatatacatttcaactcaataatacaattatataacctattactaaagataacttcaatatcataagccaaacaagattgaataacattatcctggacccatcggtatataccagatgtgggctacaacatattcaattgacaacttttttatctctgttaccccccaagatgcggtcattgacagttgcacctgacctcagactagatagcaaggcatcgcgaccagacatgaccacctggaaaaaaccatccacttcctttgcaagaagatctaatccctgagagaaattctctgctgctccgcctaattt

SEQ ID NO: 5920 - DNA, 378 bp, Cicer arietinum
gtgataaatggctatcttttgctggaattcttttcctctgaagtgaatggagcagtgctcaccactattgtgtccacaataacagctgcatatgttgcattcataatttaccttatttcaagtgcctttaccttttcaccttggcaaagtttaactcaatcaaagacagttgttaccgcggagagttaagcagtcacaaagacatttgctgccacggaaagttcagcagtcaatcttttattccttaaaatcatgaagtaggacatgctatatgctgctaaaggatttttaattgatatttttgccctattctcattcggcatactaatgcttgttatttgtataataactaacttgcaatgattcaggcgcagtagt

SEQ ID NO: 5921 - DNA, 191 bp, Cicer arietinum
gattagcgtgtgcgcggtcgaggtcaacctttttcccaaggttattgatgccattaagagtgttgaaattgttgaaggaaatggtggccctggaaccatcaagaaattcactttcgccgaagagggagaaaccaagtttgtgttgcacaaagtgtacgcaatagatgatgctaattgggcttaccactaca

SEQ ID NO: 5922 - DNA, 183 bp, Cicer arietinum
acgattcacatgtggaacatcacaattgtgggatgaaggaacgatatcttcaagcttcttcccgttgaaaatatcaattgcaacaaagtgacacttaccatgtccatgctttcctgtttttgaagtagaaacttcaacaaccttgcaaggcctggatttgatgacgatgtaaccgtttttgcg

SEQ ID NO: 5923 - DNA, 155 bp, Cicer arietinum
tttgcactttcggaggcggccgcccgggcaggtactctttcttgtatttcatattttataggaaaggaaatcggtccaaggttattatactgtataagttggagtctgaaacattatatttgtgaagttgatatatcaattcctgaaatgattgt

SEQ ID NO: 5924 - DNA, 430 bp, Cicer arietinum
acgtagctcctgaagttttcaacaaaagtttcggaggcgtttcacataaatctgatgtttatagttgtggaatgatgctgttagaaatggttggaggacgaaagaaaaacgttaacattgtagaaggtagtcgctcgagcgacttatattttccgcatttggtagtttataagaagcttgaggaaggaagtgatttggaagtggatggtataatgacaacagaagaaaatgagacagctaagagattaactatggttggtttgtggtgtattcaaacaattccatctcatagaccaacgattagtaaagtgattgatatgttggaaggtggcttggaatctttggaaatgccaccaaaacctgttatgtattctcctccaagatcaataccagaattttctactacatcaagatcattggatagtgaagt

SEQ ID NO: 5925 - DNA, 329 bp, Cicer arietinum
actgtgttcccgtcacaacaacaacccacaagagcttaaggggccccagggctggtatgatcttctaccggaagggacctaagccacccaagaagggtcagcccgagaatgcagtttatgattttgaagacaaaatcaactttgctgttttcccctcccttcagggtggtcctcacaaccaccagattggtgcccttgctgttgcttttttacaggccacgacgcccggattcaaggcatatgccaagtaagttaaggacaatgcagttgcacttggaaattacttgatcagcaagggatacagccttgtcactggaggaactgaaaat

SEQ ID NO: 5926 - DNA, 337 bp, Cicer arietinum
acggtggctttgaagatcagattacactgtgacggttgcatttccaaaattaaaagaatcattatgaagttcaaaggggtagaaacggtgatccttgacggtgacaaggatttggcaacagtgaaaggaacaatggatccgaaggagttggtagaatatttgaaggagaagctgaagcgaaacgttgatgtagttgcccctaagaaagatgaagagaagaaagagaaagacggtggaggtgaaaagaaagaagagaaaaaggaagaaaaagagaaaaaggacggtggtgatggtgagaagaagaaagaggagggtggagaagcgaaggtggaggtta

SEQ ID NO: 5927 - DNA, 350 bp, Cicer arietinum
acaagacaacattctttttcctaccaaaaatacattggcaaaatgttgtgtgtggattttcggccacttttaccgtgagattaatttctcaaaaactacaaatcaaaagacaaaaagcatgcacaccctcaaaaaaggccaaaatttcatccatgtttgcacacaacaaatttaatcagagggaaaaatcaatcttcctaaactttatgccaggtcaggaccaggagggagtgcttcataaccatcatgatgctttgtgtttgtggtatctctttcaactggaatgcacttgaggatagcagcaataggcatgctaagtgcaccaaataacacactgagtaaccagaatt

SEQ ID NO: 5928 - DNA, 195 bp, Cicer arietinum
acccgaatctccggcttataagaagctgtagtgctttattggcaccggttattctaggtcgtttagaggaaacatttggggctccagttttggaagcttatgcaatgacggaggcttctcatttaatgtcttcgaatcctttgccagaagatgggccccacaaagctgggtcggttgggaaacccgtgggtcaag

SEQ ID NO: 5929 - DNA, 256 bp, Cicer arietinum
actttgagaacgtagttcgtctgtctatcaacaagcgaggaacagatgaaggagctcttacaagagtggtggcaacaagagctgagattgatttgaaaattatagcagatgagtatcaaaggaggaacagtgtccctcttgatcgtgccattgtcaaggacaccactggtgactatgagaaaatgcttttggcaattttaggacatgatgatgcttgagataaatgcttgtgtgtgttttctcttttgagagaggt

SEQ ID NO: 5930 - DNA, 223 bp, Cicer arietinum
gctttacgtttacgtgcgtcctcactttcgaatttttgtttgtgtatagaggtcgtcttatgcgagttagcatgtgtgctttttttgtttgttttttgttgcagtaattaagtatagtccagatgttaatggttgctcagtttaaataacaacttgtaaatagttatctccttataatatgtatattaactttatttttattttttaaaattttaaatttctt

SEQ ID NO: 5931 - DNA, 499 bp, Cicer arietinum
accgagtcgcatgctcccttccgccatggggaaaacgggaattcgatttgttcttgtctacaccgttttctccgcctctgctgccaaacgtagcgctagagactctcacgttcctattttggcacccttgccaattgggttcgctgtctttttggtgcacttggccactatcccaatcactggaactggtatcaaccctgctaggagtcttggtgctgccattatcttcaacaaagaccttggctgggatgatcattggatcttctgggtgggaccatttattggagcagctctggcagctctataccaccaagtcgtaatcagagccattccctttaagtccaagtaatcaaatcaaacggtcgtgatcaatcaagcaatgttgtgggtttcatttcaacaacatcatcatgatctgttttttattattattattatttaaatttcaagtgttgtatttcggtaacatgtatgtaaagaaggtgtaatattattatga

SEQ ID NO: 5932 - DNA, 309 bp, Cicer arietinum
acttcgagatgccttcaaaaaaggcatgttgaagtatccacctgcttcggcgctttctcttttggatacatgttatgatcttagtgggagcaaggtggtgtccgttccaaagattagttttacgtttggcggtgatgtcacggtggatctcgccgcgtcggggatactttatgtggcgagtgtgaagcaagtttgtttagcatttgcggctaatggagatgatagtgatttgactatctttgggaatgtgcaacaaagaaccttagaggttgtttatgatgttggtggtgggaaaattgggtttggtta

SEQ ID NO: 5933 - DNA, 435 bp, Cicer arietinum
acccgaagctccggcttataagaagctgtagtgctttattggcaccggttattctaggtcgtttagaggaaacatttggggctccagttttggaagcttatgcaatgacggaggcttctcatttaatgtcttcgaatcctttgccagaagatgggccccacaaagctgggtcggttgggaaacccgtgggtcaagaaatggttatattggatgagtcgggtcgggttatggaagtggaagttaagggtgaggtttgtattaagggtgagaatgttaccaaaggttataagaataatgatgaagccaatacgacggggtttttgtttggttggtttcatactggtgatattgggtattttgattctgatggatatttgtatcttgtgggtcgaattaaagagctcataaatagaggaggagagaaaatatcaccaa

SEQ ID NO: 5934 - DNA, 436 bp, Cicer arietinum
acggacaaggcgaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgcctactatccagcgaaaccacagccaagggaacgggcttggcggaatcagcggggaaagaagaccctgttgagcttgactctagtccgactttgtgaaatgacttgagaggtgtaggataagtgggagctggagacagcgaaagtgaaataccactacttttaacgttattttacttattccgtgaatcggaggcggggcgctgcccc

SEQ ID NO: 5935 - DNA, 405 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccact

SEQ ID NO: 5936 - DNA, 293 bp, Cicer arietinum
actattttgcattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttattcttgtggtaacttttctgacacctctagcttcaaattccgaaggactaaaggatcgataggccacgctttcacggttcgtattcgt

SEQ ID NO: 5937 - DNA, 324 bp, Cicer arietinum
acatattgcttttatatcagctccagagaactcatccttagtcataacaaattcttctaaattgacatcatcagctagtgtcattcttgatgtgtgtatcgtgaaaatgcgtctccttgttttgatgtcagggagaggaaattcaatcttcctgtctattcgaccaggtcgcaatagagctggatcaaggctttcaattctgttggttgcgagaataacttttacatctcctctggaatcaaaaccatctaactggttcagcaactccaacatggtcctttgaatttcccgctctccacctgagtgagcatcatacctctttgt

SEQ ID NO: 5938 - DNA, 228 bp, Cicer arietinum
actaggttgccctactattgcgacactgtcgtcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgtttggctgccacaagccagttatccttgtttgtaacttttctgac

SEQ ID NO: 5939 - DNA, 434 bp, Cicer arietinum
acggtgataacccgttttgtggaaccggtttataatgccgtgagggatgagtttaggaaacaagtgacgggtccgttttcgagcttgggagcattcgacacgtgttttgtaaagacgtatgaaacattggcaccggcaattacgttgcgttttacggatttgaatttgacgctgccaatggagaatagtttgattcgtagcagttcgggttcgttggcttgtcttgctatggctgcggcaccaagtaatgtgaattctgtgttgaatgtcatcgctaattttcagcaacagaatttgagggttttgtttgataccgtcaataataaggttggaattgcccgtgagctttgtaactagctagtagctacctacctactttcttgcatggtaacattttaattacttatatttagctgagtttggatcttttgttt

SEQ ID NO: 5940 - DNA, 406 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcaagtagctttccataccctgaggcaggaagtccatgatccccaaagatcgccagtagctgcaaccctagaaccgtgcatccttggggaaaacccttgcaggagaaaaccccaaagcggccagaacgctgctctgtggacgaggtagtcgcctcattccacggtctccag

SEQ ID NO: 5941 - DNA, 449 bp, Cicer arietinum
gattttccgagcgggccgcccgggcaggtcgagagagcttgacacactttccaccaagatgcagatcttcgtgaaaaccctaacgggtaagacgatcaccctcgaggtggagtcttccgacacaatcgacaatgtcaaagcaaagatccaagacaaggaaggaattccaccagaccaacagcgtctcatcttcgccggaaagcagttggaagacggccgcactctcgccgactacaacatccagaaggaatcaactctccaccttgtcctccgtctccgcggtggcgctaagaagcgtaagaagaagacctacaccaagccaaagaagatcaagcacaagcataagaaggtgaagctcgctgttcttcaattctacaaggttgatgattctggaaaggtgcagaggttgaggaaggagtgtcctaatgctgagtgtggtgctggaactt

SEQ ID NO: 5942 - DNA, 302 bp, Cicer arietinum
acttcgatatgccttcaaaaaaggcatgttgaagtatccacctgcttcggcgctttctcttttggatacatgttatgatcttagtgggagcaaggtggtgtccgttccaaagattagttttacgtttggcggtgatgtcacggtggatctcgccgcgtcggggatactttatgtggcgagtgtgaagcaagtttgtttagcatttgcggctaatggagatgatagtgatttgactatctttgggaatgtgcaacaaagaaccttagaggttgtttatgatgttggtggtgggaaaattgggt

SEQ ID NO: 5943 - DNA, 438 bp, Cicer arietinum
accagtttatccagcagaaataacacccaagaatcttcgaggtggtttcaccacagttcatcagttaatgatctgctgtgggatgtcattaacttatcttattggagcatacgcgaattggaggattttagctctaataggtggctggcaaaggttggccgcttgaaggagagtgattcttctttacagcgccttagggggaagaatgctgatgtttataaagaggccaatgaaatcagagattatacagaagcccttcagcagcaaacagaggccagcattattggcttatttcaaatgcaatatttgaagtcacttacagtaggggttggcttgatgatactacaacagtttggagggattaatggcattgttttctatgcaaattctatatttatctctgctgggttctcggagagtattggaactatagcaatg

SEQ ID NO: 5944 - DNA, 396 bp, Cicer arietinum
acatgtaacgctggcgaaaccttcgcatcgcaagacgacgcaaaggggtcacagcagcgtagtcttgagcttcgagatgggtattttggtccgagcaaatttctccgccagatacttcttgtatgggatcaacagaacaacccttaaggactaggtccttaaattcaactacaaaaggagcatacttatagttcactttgtattttccaccggatgtggcccaatttgaggcatcccatattgtagaatacaatgacattggtttggatgggtattcacctcccatttcctcacttcttaatacctctctaattggaacttcatcaatgtaaaatatgatattttttgcggtccaaagaatgctatatctatggtatcctttagttgggtcgaacc

SEQ ID NO: 5945 - DNA, 402 bp, Cicer arietinum
acttagttgctgcttcaatgttctttttaaacacctcctgttgttcttcattaagtttgggtgtcaacaacttaatatacctcttaataaagacaagaaactgcttcttgtcaaaagcaggttgttcctgaagtctgaatgtgtcaacaatgtcaacaaccttaacagcttggtcatcaacactctcatcttctccaccttcagcagaagggtttgcaccaatgtctacatcaactgctcctttcacaacccacttcccctcaacttcccacaagactccattcgcaagttctttgtatgggaaagagtctgagagaagctcatcaccggtaaggagatcctggtaaaccaacatgatgaaagagtagttctgtctcggatcgctcctgatcttagggttcc

SEQ ID NO: 5946 - DNA, 503 bp, Cicer arietinum
gagtcgcatgctcccgtccgccatggcggaagcgggaattcgattagcgtggtcgcggccgaggtacaaaaagattgccgatggacctacaattgaaatcgtgttgtagcggatgcagatcaaccaccgatctctacggaagcaattgcaaacacatgactctctgcttaacctgtggcaaaaccatggctgaaaaccgcgctaagtgctatgattgtggagccaccctaactcgcttgattcgagaatataatgttcgtgcaagttctgccaacgataaaaactactttattggaaggtttatgactgggttgcctgatttttcaaagaagaaaagtgctgaaaataaatggtgtctgcagaaggatggattgcagcgtcgagaagttactgatgctttgcgggagaagttcaagaacaggccttggctcttggaggacgaaacaggtcagtcccagtatcagggtcatcttgaaggttcacaatcagctacatattacctg

SEQ ID NO: 5947 - DNA, 420 bp, Cicer arietinum
acttttaccatggtttgggtgaaatttagttgtcgttgtctcttcaccttctttagttcaagaatgctttaataaaaacgatattgttttagcaaaccgaccacagttgttagctggaaaatacatcttttacaactataccaccttaggttcctcttcttacggagaccattggcgtaacctacgtcgtataacagctattgatgttctctcaaacaatcgtcttaactccttcttaggagttcgaacagacgaaacaaatagacttatacaaaagcttctaaacgacactgtttctgatcaaggttttacaaaagtggaactaagacatagactaacggagatgacgtttaatggtatgatgatgatgatatctggaaaaaggtattatggagatgacagagacgtgacggatgttga

SEQ ID NO: 5948 - DNA, 458 bp, Cicer arietinum
gattgctagctgcacaaccaattgccttgctccccttgccaaggttcttaatgaccgatttggaatcgtcgagggtcttatgaccactgtccactccatcacagctacccagaagactgttgacggtccatcaagcaaggactggagaggtggaagagctgcttccttcaatattattcccagcagcactggagctgccaaggctgtaggaaaggttcttccagaactgaatggtaaattgaccggaatgtctttccgagtccctaccgtcgatgtttcagttgttgacctcactgtaaggcttgagaagaaagcaacctatgaacaaatcaaggctgctatcaaggaggaatcagagggcaagttgaagggaattttgggttacactgaagatgatgtggtatctactgactttgttggtgatagcaggtctagtatatttgatgccaaggcaggaa

SEQ ID NO: 5949 - DNA, 305 bp, Cicer arietinum
  misc_feature (305)..(305): n is a, c, g, or t
acccaagtttgatggtaatgtggcttcgtatgttcgatgctagggaccttctacttacccgcatttacttctcacatctcccgttccgattttttttccctatccatactgctttctgtaatgtaacctttgtaaggtttgacaaagaagattaagattaaattgaatttcaaattgttttttttgggtgtaaatttagactgttaaatttaatgtccagtttattagctgcagcaagtttattcatgtagaatattataaaactattcaattctttctggaccctttcacgaagttcaaatcan

SEQ ID NO: 5950 - DNA, 437 bp, Cicer arietinum
acacaagatgaccccggtgctagttcatgatggaaaacccatatgtgagtcaatgatcattgttgaatacattgatgagatatggccacaaaactcattgcttccagctgatccttatgatagagctcaagcccgattttgggttaaatatatcgatgaaatgatttcgacactttcagcaatcattcgtagcaaaagtagtgaagaccgagagaaggccaaagagaatctatgggaacggttaggagttgttgaggatcaatgtttgaaagacgaaaataaattttatggaggagacaacattaacattgtagacatagctctcggatcttttgtcaaatttattgaggttttggaaaatacatttgaagtggaaattttgcaaactgagaggttcccccatttgcatttatggtttaataatttcaaggatgttc

SEQ ID NO: 5951 - DNA, 373 bp, Cicer arietinum
accagttattacccaaaacgcataagaagctataagcatgtacccaaagtaaaatattgcagacaccaactttgtgatttctagcttggtaaagaagtagaatgttgcataaagaaagaggtatagtgcagaagaaccagaagtaaggtatgaccgccaccaccacaagtaatcctcactgcataactggaagtagcagagcacaatggtgatttcagcacaagtgacaacgaggatgatgaagaccaaaaagaggaacccgaagatgtagtaaaactgattcaaccagattgaggtgaggatgaagaagagctcaatgaaaacagctccaaaaggaagtattcctccaatcagaactgagaaagctgggttc

SEQ ID NO: 5952 - DNA, 139 bp, Cicer arietinum
cccccgttaagaagcaaagtgctggcgagttgcgtcttcacaaagatataagtgagctgaatctaccaaaatcttgtaccatatcattccccaatggcaaagatgacctgatgaactttgaagttgtaattcgacctga

SEQ ID NO: 5953 - DNA, 193 bp, Cicer arietinum
cgagagaccttgtagcaactagtggagtgcgcctcgcatctttcaccatgggtatttctagggattctatgcacaaaaggcgtgccactggtggcaagaagaaggcatggaggaagaagagaaagtacgagcttggtcgccagccagctaacaccaagctatcaagcaacaaaactgttagacgcattcgtgt

SEQ ID NO: 5954 - DNA, 295 bp, Cicer arietinum
agagaagttaccacgccgcagccatgggaagaagacctgcaaggtgttacagacaaattaaaaacaagccttaccccaagtcacgtttctgtcgtggtgttcctgatcccaagatcagaatttacgatgttggcatgaagaagaagggtgttgatgagtttcctttctgtgttcatctggttagttgggagaaagaaaatgtttcaagtgaggcactggaagctgctaggattgcttgcaacaaatacatgtccaaatttgctggaaaggatacattccacttgagagtcagggt

SEQ ID NO: 5955 - DNA, 127 bp, Cicer arietinum
gacctctatattgatcacaatctgagcttaactgaggctctatgtggcttccagtttactgtcacacatcttgatgggaggcaactattggtcaaatcaaaccctggggaagtcatcaagccaggtc

SEQ ID NO: 5956 - DNA, 432 bp, Cicer arietinum
actttgacctaggccttccttatcgtgatgagactgatgataaagttacagttgaaagtgcagaagcaactctcaagtataacgtagcaatcaagtgtgcaactatcactccagatgaagctcgtgtcaaggagtttggcctgaagcagatgtggaagagtccaaacgggacaattagaaacattttgaatggaactgtcttcagagaaccaattatttgcaaaaacgtccctcgccttattcctggttggacaaagccaatatgtattggaaggcatgcttttggtgatcaatatcgggccactgacagcgtaattaaaggagctggaaagttgaagctggtgtttgttccggaaggccaaggtgaggcgaccgaattggaggtttataacttcactggtgaaggaggtgttgcattggctatgtacctcg

SEQ ID NO: 5957 - DNA, 422 bp, Cicer arietinum
actgctttcgttcatctctctgcttatgtcccagcaatcaaggagacgcttgaagatgctgatgagaggctaggagctgacattgtgcaaaaggcacttgtagcacctgcatcattgatcgctcaaaatgctggaatagagggtgaagtggttgtggagaaaatcaagaatggtgaatgggaggttggttacaatgccatgacagacgcctatgagaatttagttgagtctggagttatcgaccctgccaaggtaacaaggtgtgctttgcagaatgctgcttcagtcgctgggatggtcttgaccacacaggccattgtggttgaaaagcctaaacccagggcacctattgctggttccccacaaggccttactgcttaagttttagatcaataattgttgtaggttaactattacggcag

SEQ ID NO: 5958 - DNA, 425 bp, Cicer arietinum
agaagaaggaaacctcgattttactttgaaaatgagacctgctgtagccgctcttattttcctcttccttttcttgtttgcagctacaatagaatcgagaaatgatctaaaggagtattggaaaactattatgaaagatgaagagatgccagtgggaattgaagggcttcttcaactgaaacctgagatagaacctgtgaagaactacaagatcaaagaagaacatgctaaaggtaaatgtgatcagcatcccataacaaacaccttaaatatcatagagaaaaaggtgatcactgaagaatttgaatcaaagcccactatttcaacttctggtgatgatggcaagattgaagattttgagccaagaccaagtgctacaagttatgatggtgatctaaaaagtgagtttgaacccagaccaagtg

SEQ ID NO: 5959 - DNA, 311 bp, Cicer arietinum
acgacgactttctgatccgtcaagtcactgatcacgaagatgatcaactactgaacgcagagcaccactttacaaccttcaagtctaagttcagtaaaagctacgcaacaaaagaggagcacgattaccgattcggcgtgtttaagtcaaatcttaagaaagcgaagctccatcagaagctcgatccttccgcggagcacggagtcactaagttttcagacttaacggcgtctgagttccgtcgccagtttcttggacttaaaaaacgtctccgtctaccggctcacgctcagaaggctccgatcttacct

SEQ ID NO: 5960 - DNA, 396 bp, Cicer arietinum
  misc_feature (381)..(382): n is a, c, g, or t
actagtgaagctgtgaatgcatactatgctgcagcattgatgggaatggcatatggtgatgcttcacttgtgagcattggatcaaccttaacatcattggaaattcttggaacaaaaatgtggtggcatgtgaaaaaggaagggaaattgtatgaagaagagtttacaaaagagaataggataatgggagttttgtggtctaataagagagatagtggactttggtttgcagcggctgagtctagagaagctaggcttggaattcagcttataccattgagtccaatttctgaagttttgttttctgatgttagttatgtgaaggatcttgtggagtggactttgcctgctttgaatagggaaggtgttggtgaaggatgnngaagggttttttgt

SEQ ID NO: 5961 - DNA, 287 bp, Cicer arietinum
gtcgaagagaggtcgtggaggatctgcgggaaacaagttccgtatgtcactgggtcttccagtggcagctacggtgaattgcgctgacaatactggtgcaaagaatctctacatcatttcagtgaaaggaatcaagggacgattgaaccgtcttccttcagcatgcgttggtgacatggtcatggctactgtcaagaagggaaaacctgatctcagaaagaaggttttgcctgccgttatcgttcgtcagcgtaagccttggcgccgaaaggatggtgtcttcatgt

SEQ ID NO: 5962 - DNA, 306 bp, Cicer arietinum
acgatcaacagctgcctcaggttttccttcttgacaaacaggatcattcaatggaaggcgatcgggattcttaaatgattctgggaactcattttccgagcattcacatacactacagtcccgcaaccggcacataccatcatcaggccaaaaagggcagtcgcaccatagcttgaccttaaaataccgaaagaatggggttttcacaagctcttggagagacggatacaatacttccttgttaagattgtccacagtttcataatcacaacaacaatcctccaccataccagtatacttcggagt

SEQ ID NO: 5963 - DNA, 350 bp, Cicer arietinum
aaatatgagaagaagattgaggaaatttttaacaggtttgaccctgtcattgaaaaggtcatcaagaaaagacaagatgttaggagaagaagaaaggagagaaatggtgaacttgaagagggtgagcagagtgctgtttttcttgatactttgcttgattttgctgaggatgagaccatggagatcaaaattaccaaggaacaaatcaagggtcttgttgtggatttcttctctgcaggaacagattcaaccgctgtggcaacagattggtgtttatcagagctgatcaacaacccaagagtgatgaagaaagctcgagaggaggttgactctgttgttggaaaagatag

SEQ ID NO: 5964 - DNA, 435 bp, Cicer arietinum
acatccagatcacctgtgcaacctctggggagggtctttatgaaggtttggactggctttccaacaacatagccaataaggcttaatacttattgtgagtattgtggattggtgattctggatgccggggtgaatattatctagctttgctttttgacagtcttgtgatcaggaattctggatgcaagggcaaattttatctggcttttatttcttggtcatcttccgaaacaacttgaatttatgtccatgtattgtggtttaggatatattggtggctaaaattgtagtaggaatttgttttgtgggctttgtaacacttttaagctttttattgggtttcgatgcaatgtccataactgtaatggagatttaattaaatgtgccccatgttctgatttatagttttattttggttatgataaatgatgagtt

SEQ ID NO: 5965 - DNA, 462 bp, Cicer arietinum
acttgctcccaaacaagtctcaatcccttttgcaagccttcaagcccaagccaaagcccaagccttcacaaactcaagttacaaagcagtgaaagtgagtcatgcaaattgtgatgaaatggaagtagggttccatgtggatgtgaaaaatgaagggtcaatggatgggacctacacccttctcattttctcaaaagcacctcatggaaaatggtcagctttgaaacaattggtgagctttcataagacctatgttccagctggatcaaagacacgtgtcaatgctggtattcatgtttgcaaccacctttccattgtggatgagtttggggttcgaagactcccaattggtgaacatgaacttcaaattggtgatctcaaacattctatttttgtccaaacttcggaccaaatcaaacattaaatgtaaaaaaaaaatgaaatatacaaaataagttttac

SEQ ID NO: 5966 - DNA, 405 bp, Cicer arietinum
acacagctcacaaaagagacttggtggagcttatgagaaacctcccgggacctttgttcctcttctctatacacaggtcctttatttctctcctcccgtctcccgcggcattaacttcaatacttaaaccccttactgaccctcaagctcagcaagaatcttctcacccttggccttggcggaggcgaagtcaccaaccatgtagaaggcaccctcaggaaggctgtcaccctcaccgttaaggatggccttgaaggagttgatggtctccttaaggtcgacgagcttaccctcgataccagtgaaaacctgggcgacagtgaaaggctggctcaggaaacgctggatcttacgggcacgctcgacagcaagcttgtcggcctcagacaactcatccatacccag

SEQ ID NO: 5967 - DNA, 376 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggatttgtgacgttttcaactgggcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggcggcggtggaggatatggtggtggaggtggatatggcggaggagg

SEQ ID NO: 5968 - DNA, 429 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaactagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcg

SEQ ID NO: 5969 - DNA, 351 bp, Cicer arietinum
gtcttgttaagatgattccaaccaagcctatggttgtggaaactttctccgagtatccaccacttggtcgtttcgccgtgagggacatgcgtcaaactgttgctgtcggtgtcatcaagagtgttgagaagaaggatccaactggagccaagatcaccaaagctgcagtgaagaagaagtgatggttgatgcagaagtggatgttgctttatagtagcttattatcttttaagagtcttagtttatttttgccttttaattttgccgtttttatgcagccaaacttgcaaaactgggttcttgatcggcgatggtcgacctttattttgtggttgttttgattttgatggt

SEQ ID NO: 5970 - DNA, 426 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttgttttacttattccgtgaatcggaggcggg

SEQ ID NO: 5971 - DNA, 317 bp, Cicer arietinum
actagaacaggggaatatatttatttggtttgtcagtcaacttgataaaccaaactttgaaaattacaacgcatgcacgccactgcagacacgtggatgctggggcagtgccttatagctgtgctaatacaacaaaaaacaaaaattaaataaataaacgcagctctcttaacaatattaatcaaacactgacgaaatatatgtgagaagaatcccctcaatcttctttttgcaacgtccatggctttctttgctttcacaccttctgtttagatccatatagtgtgatgccaagtatcagctatctagtaatgggt

SEQ ID NO: 5972 - DNA, 425 bp, Cicer arietinum
acacacttgacttacaatctcacacttccacaacaaaatgaaaagaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagcccagcacctccaactatgctgtagtggtaagcccaattagcatcatctattgcgtccactttgtgcaacacaaacttggt

SEQ ID NO: 5973 - DNA, 436 bp, Cicer arietinum
accgtatcctacagctgcaacaccatggtctaatgctgttccacatcttcctgtaaacacaccatattcgtataactgaaattccctaccgcctccttcaatagcaacactgatgggctgatttgcaacagccttttgcaaggccaattcatcatagtcaggaacatcttcataatcatcaattgaaacaactttagcatttttcctgtattggtcacatctaccatcaacagcaaggtagggataatcctcatcagagtcaatgccaccattatcaatgatgaaatcaaaggcgtagtccataaggccaccattgcatccttcattgtatgatgtatcacagtccaccagctcttgttctgatagtgaaatcaaatctcctgtcactatcttatttattccttccacggcagcaattgctgagaatgcccaacaa

SEQ ID NO: 5974 - DNA, 375 bp, Cicer arietinum
aaagaagaagaagaattttaacgtatcatcactagatgatgttatcaaaacttaaaatgtggaataaactaggagtctctcctttcacctatttacctttacatcacatatatattaatgaataataaatctagcaacataccttattcccacaagttacaaagaatattacaagcatatttctgaccaaactaggctatcttgaataaccattagccagaacagggatcctcactttgtgtcctctacttcccttcatcaaaacctctccaaaactatatgttcctgtcactgtccgaacagtaagtgtcacggtaaacctacgtgatgcaccagctttgatggttattgctggagggttcacttcaatggcaa

SEQ ID NO: 5975 - DNA, 428 bp, Cicer arietinum
aaaaattctttcttggcacgcactgttagtgcactgttaggagcgggattttctacgggctactcggccacacaatactgcggggacgccatcggctccctaacagcagttttcagagaaggaattttggagagctcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtgg

SEQ ID NO: 5976 - DNA, 293 bp, Cicer arietinum
actaggttgcattactattgcgacactgtcatcagtagggtaaaactaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 5977 - DNA, 293 bp, Cicer arietinum; identical to SEQ ID NO: 1098

SEQ ID NO: 5978 - DNA, 422 bp, Cicer arietinum; identical to SEQ ID NO: 4982

SEQ ID NO: 5979 - DNA, 430 bp, Cicer arietinum
acaagagtgtcgagcgtttgaagcctattggaaagcactcccttctcggtgctagtggggaaataagcgactttcaggagattatgcgctaccttgatgaacttatcctttatgacaacatgtgggatgatgggaattctttggggcctaaggaggtgcacaactatttaactcgtgtgatgtataataggcgcaacaagttcaatccattgtggaactcacttgttcttggtggtgttaaaaaggggcagaagtatcttggcacggttaacatgattggtattaattttgaagacaaccatgtagcaactgggcttggaaatcaccttgctaggccaattctacgtgatgagtggaatgaaaacttgacatttgaagaaggggtcagattactcgaaaaatgcatgcgtgtgcttttgtacctgcccgg

SEQ ID NO: 5980 - DNA, 436 bp, Cicer arietinum
actgcaaggacttgcaattgcattttaattgttcttgatgcaataaagccaataactcataagcgtcttattgaaaaggagctagaaggatttgatataaggttaaacaaagagccaccaaaccttactttcaggaggaaagaaaagggtgggatcaatttcacctcaactgctacaaacacacatctggatcttgatactgtgaaggctatttgtagcgagtacaggattcataatgctgatattactctaaggtatgatgctactgctgatgaccttatagatgtcattgaaggcagtagagtatatacaccctgcatctatgttgtgaacaagattgatcagatcacacttgaggaactggagattttagataagcttcctcattactgccctgtcagtgcgcacttggagtggaaccttgatgggcttctgg

SEQ ID NO: 5981 - DNA, 428 bp, Cicer arietinum
acaaagggagattataacatgggagaaggaggaagaagaaaaagaagaagaagaagctcaagtagaaatatggaaatacatatttggttttgttgaattagctgtggtgaaatgtgctattcaacttggaatagctgaagccattgaaaatcacaaaaaaccaatgtcactattagaaatatcatcaactctaaattgtgacccttcatatctcaaccgcatcatgagattcctaacacataggaaaatattcaaaacaatacctagcgaccataacgacaatcctagctatgttcaaaccccactttctcgccgtttgatttcaaacagcgaaaaaagtatgtctgctctccttttattagagagcagtcatgtgatggttgcaccttggcttagtctaagtgaacgcgttttggttaatggaaatc

SEQ ID NO: 5982 - DNA, 424 bp, Cicer arietinum
actccgcactctgcacacaattttacaagagcagggttctctggacagttctaaggctgagagcatggttaagaacctacaaatgaatggcagatatttgcgtgatgtatggtgatgatgacctctgagtgtaacaaacggggtcgtggggttatgataaagcggccgtaaagagtagtagtggatatatagaagataagctattggaagggccttatttgtcgccatacactgatgccctcataagagggataaggggttccttctgcttgtaacattatgccaattcctatgattcttttttactatattttcaaatgtattcttttttgttcgtgtaacttatacttagttaatacatagactatgtattttagctttcttgtattgtatgaacctacaaagagggttcggaggcacatat

SEQ ID NO: 5983 - DNA, 187 bp, Cicer arietinum
gcgaccgcccgagcaggtacatttttgaatcaattggagaccaaattgcaaaatgtgtctgatctgaagcaatcatcaaccgtagcaccttatgggatcagtgcatcccttttcagcacattgattaaggcctttgcctccacccttctccaaatattgctgatgatattcctctgctctataaaat

SEQ ID NO: 5984 - DNA, 240 bp, Cicer arietinum
acagctccccattacgtgctctatttgtttgagcagtaatccaccgaaactctccattctaattatactccttcatgacatcctgcatcttctcaatctctgcaatttcttctctgtcactggacttcttcacatcactataaccatctactacgacaaggctgaccagttccctctatttgctgttcttatcatagctttctaccaaaccacctatgcttttaactctgtctagtcttg

SEQ ID NO: 5985 - DNA, 183 bp, Cicer arietinum; identical to SEQ ID NO: 3622

SEQ ID NO: 5986 - DNA, 434 bp, Cicer arietinum
accaacaaggttgctttgcaggtggcacggtgcttcgtttggctaaggatttggctgagaataacaaaggtgcacgtgtgttggttgtttgttctgaagtcactgcagtcacatttcgtggtcctagtgatactcatttggatagtcttgttggacaagctttgtttggagatggagctgctgcattgattgttggatctgatccaattcctgaaattgagaaaccaatatttgagatggtttggactgcacaaacaattgctccagatagtgaaggtgctattgatggtcaccttcgtgaagcaggactcacatttcaccttcttaaagatgttcctgggattgtctcaaagaacattgataaagctttgattgaagctttccaaccattgaacatatctgattacaattcaatattttggattgcacatcca

SEQ ID NO: 5987 - DNA, 307 bp, Cicer arietinum; identical to SEQ ID NO: 5317

SEQ ID NO: 5988 - DNA, 187 bp, Cicer arietinum
cgagctacaacttggttactggagattgtggactgcgtcagcagatgtagcgatgcgtgagagaattctggtcggtgggaaaattcgacaaattgcctccgaacccgctgacgggtgacgggcttgacaaaaacagcgccttttgtgccttggtatgctggatggtgaaggaagaggggtatcctgt

SEQ ID NO: 5989 - DNA, 330 bp, Cicer arietinum
ggataaacttatttaatttttattgataaagggagatacaaagacatgaaatatcacatttcaggagagagaaaggaaaactaaacaagagaacagtttatttgattgaaagctaacataagaagacatcaactcatgttaggtatagttgaaggatggatcagttgtaattttttttggccaaaacgtaaccctcaatggccttgaaaagagcatcaccctttgcctttccttcttgaacctccttctcattgggcttagcatctcctttggtttgatattttacgctcaccttcccaatggaccctccatttgggccttcacacaatt

SEQ ID NO: 5990 - DNA, 324 bp, Cicer arietinum
acaaaatttaaccaatccagatagataaaagaacaactatgcagtaaggaaagttgattcactgacatacagattgtgaaaccatggattctcaactacaggtttgtggatgcaaggggctttgacaatagcaacaattgcatcattttcttctacgttttcttcgtttcctgtcactttcatcagaacttgctgagtctgcctctgactcagaactagtagttcctgaatctgatgaaccggagctcgcagactcattgtctgagtcagaatctgaaacttgtttctgttgttgcatgatcagacgtggcatatttttcaagt

SEQ ID NO: 5991 - DNA, 192 bp, Cicer arietinum
acatacatatccatacccatacagaagaaaagtatttttttttacagaggaaagggaagaagcaaattatatattgtcttctccagcggttgattttggtttcttcactatcaaaacagggcacttcacattctgtgcgcagtgattgctcacgcttccaaggaaagccctcttgatgacaccatagccgtg

SEQ ID NO: 5992 - DNA, 441 bp, Cicer arietinum
acggacaaggggaatccgactgtttaattaaaacaaagcattgcgatggtccctgcggatgttgacgcaatgtgatttctgcccagtgctctgaatgtcaaagtgaagaaattcaaccaagcgcgggtaaacggcgggagtaactatgactctcttaaggtagccaagtgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagctggaaacagcgaaagtgaaataccactacttttaacgttattttacttattccgtgaatcggaggcggggcgctgcccctcttt

SEQ ID NO: 5993 - DNA, 244 bp, Cicer arietinum
actaggtttacccactattgcgagaaagtcatcagtagggtaaaagtaacctgtctcacgacggtctaatcccagctcacgttccctattggtgggtgaacaatccaacacttggtgaattctgcttcacaatgataggaagagccgacatcgaaggatcaaaaagcaacgtcgctatgaacgcttggctgccacaagccagatatccctgtggtaacttttctgacacctcgagcttcaaatt

SEQ ID NO: 5994 - DNA, 329 bp, Cicer arietinum
acaaggtcctgtaatttcttcaacttgccacttattctagttcttctctcccgttcagcaatactacggggatgagtggcacagccacgcttggcacgaattttacaagggacggaatcttgtggaatatgcaatagcttgtcaacgcttgccatttcaagagatgtttgtggcagactatactgagtttcgagggcattgaggtaatgtagaagaaggtcgggatcttcgtcgtcgttgttattgttgttgtcatttctagaacgcttattatttgaagaaaatactatcgaattagaattattatttgaattatcagccccccaggt

SEQ ID NO: 5995 - DNA, 383 bp, Cicer arietinum
tccttcccgccatggagaacgcgggaattcgattagcgtggtcgcggccgaggtacaaggtcctgtaatttcttcaacttgccacttattctagttcttctctcccgttcagcaatactacggggatgagtggcacagccacgcttggcacgaattttacaagggacggaatcttgtggaatatgcaatagcttgtcaacgcttgccatttcaagagatgtttgtggcagactatactgagtttcgagggcattgaggctatgtagaagaaggtcgggatcttcgtcgtcgttgttattgttgttgtcatttctagaacgcttattatttgaagaaaatactatcgaattagaattattatttgaattatcagccccccaggt

SEQ ID NO: 5996 - DNA, 236 bp, Cicer arietinum
tgtcctttttcgaggcggccgcccgggcaggtatctcatttctctattatttttcaactctattattctcactctcattctaatggcatctgacaagaagattaggatcggtatcaacggattcggaagaattgggcgtttggttgctagagttgctcttcaaagagacgatgttgaacttgttgcaatcaacgatcctttcatcacaactgattacatgacatacatgtttaagt

SEQ ID NO: 5997 - DNA, 345 bp, Cicer arietinum
  misc_feature (345)..(345): n is a, c, g, or t
actatatacaaaagcacctaattatcgcttctcacaacttttaacgacaaatcatttcaagagcgagatatacctgtcggcttcaagcaagtgatgggacagtggcgcagaaaggacactggaaaaaagaaaactagtattatattacgatgtcgggatttggtttgactgaggactcaatgtttgaggatttctaaaagttatatgatcagacaaaggatctgttgaaagcggtgtttatttttgagatatcaaatcgtgcaatagttggttataacgggacatgggacttgaacatagcaattgcgtaacgaagcacgcagtgaataccatcttttgcaacan

SEQ ID NO: 5998 - DNA, 424 bp, Cicer arietinum
actaatatatgactattacgatgacacttgctttattgagagtaagcaacaactaacatccaatatttcaaatttaagtgattgttcattcttcatcccatagatcatcaagaagaggcttggttggtcctttgatgagtctctcctggtgaatttcacttattttcttgtaatcatctttggtcaatgaccaatcaaatatttgcaagttttgattcatcctctccttgtcatagctcttaaccacaaaagtcaatccttgttcatataaccatctgagacaaatctggactatagtcttgccatgagcatcagccaattctttgagtatatcattgtccataactaaattagctcccctgctagcaccctttctgaggggtgagaatgcagttacaattatacccttttccttgcagaaagc

SEQ ID NO: 5999 - DNA, 324 bp, Cicer arietinum
acaaaattaaacaaatccagatagataacagaacaactatgcagtaagcaaagttgattcactgacatacagattgtgaaaccatggattctcaactacaggtttgtggatgcaaggggctttgacaatagcaacaattgcatcattttcttctacgttttcttcgtttcctgtcactttcatcagaacttgctgagtctgcctctgactcagaactagtagttcctgaatctgatgaaccggagctcgcagactcattgtctgagtcagaatctgaaacttgtttctgttgttgcatgatcagacgtggcatatttttcaagt

SEQ ID NO: 6000 - DNA, 380 bp, Cicer arietinum
acagtatagattttggcaagagcgaggttgaggtgatcaagcatgtgtcaaactatttagatccagctgactcagaaatattattggacctgcttgcctcttctgagttgaaggtgacatatcagccttatgactggggtttgaactggtagatcgtgctatcaaagttctgtaaataggtcacctagattgcttttgatcttctatactcaaatgaccacaaagaaacgaaatgaatgtcctatgttggcttctctgactaattttatatgtctctacagaagggtagagtggtaggggaggaagagataaggcctaagaattatttgttttcattatttcctgttcttctatataccgtcttcctgctatattttcgt

SEQ ID NO: 6001 - DNA, 233 bp, Cicer arietinum
agcatcacggcctagtgcttgggggcgttaggaaagaccccaaagacgcttggagcgtcacggcctgggccgactctgattggaaaggcgacaatttcacaggaagatcgacgtttggatggctcgttcagcttgaagaatctacggtctcatggagagcgaaacgacatgaaacagtagcactctcaactaccgaggccgagtatactgctctatcacaatgcgccagagaa

SEQ ID NO: 6002 - DNA, 292 bp, Cicer arietinum
acgtgatggtgtttggcaagtgacatacactctctttgatagagattttgatgagagtgagtgtcaattgccacaaagatgtggaaaatttgggctttgtgaggaaaatcaatgtgttggttgtccattagaaaatggaatatttgggtggagcaataaatgtagtgctaagcctatagcaacatgcaaagaaagtgaatttcattactacaaaattgaaggagttgagcattatatgagcaaatacactaatggtgatagtgtaagtgaagctaattgtggaaataaatgc

SEQ ID NO: 6003 - DNA, 424 bp, Cicer arietinum
accagtgcgaagcctgcatcattgcttactgcagccaacttaaaatttcaactaaaatgacctgtaaagacttgaattattgtctggttctctttgcttttgttacactttgttcttgttcatatgctcatttagtatgcaactgcttttattaaaatgacagatgtgttttcctttcttgatttgtaacccgcatcaaatattctcaaccaatacagcctgattaaagcatcaaatggagagtcagttgccacaagcagctcgaagttaaatgcacttgcctctttttgggatgaggcattagataaccttcagtttctttacaggcttctctcctcctatattgactacattatcctttgtggttccaattccatggatgtcgatttcatgactcgttttgctcttcttcttcgcgaaaaac

SEQ ID NO: 6004 - DNA, 371 bp, Cicer arietinum
accgttgtttcgttggtggtctagcctggaccaccgacagcgacgccctagccaaagccttctcttcctacggcgaagttactgattccaaggttattaacgaccgtgagactggaaggtcaaggggttttggattgtgacgttttcaactgagcaatccatgagagacgcaattgaagggatgaacggtcaagatgttgacggacgtaacattaccgtgaacgaagctcagtctcgtggtagcggtggtggaggcggccgtggtggcggtggatatggtggaggcggtggatatggtggtggacgtcgtgaaggtggatataacagaggtggcggtggaggatatggtggtggaggtggatatggcggag

SEQ ID NO: 6005 - DNA, 429 bp, Cicer arietinum; identical to SEQ ID NO: 5227

SEQ ID NO: 6006 - DNA, 429 bp, Cicer arietinum
acatagcttatatttaaaatattaaaacattaatttaactttagctatgatatatgacaacaggtttatttatttttttattacaattttaatcttagtctttggaattattctccaattgtagtataattttaaaacttgtttttgtgtgaactataaatttgcaaaaacttgtatcacctttaaatatttcaataactatattaaaggctaacctgatacaagcttaacaaatttaaattttaacgcacaaaaaataggtttataaattaaactacataatgaaaaataaaaagctttattttttatatttttgaaaatagaagaaaacttagatacaatactaaaaaaaaatattggtgatattcttccactacaacacaacacaacatgtcatgttatgtttgtgattggagaatgaaaccaagt

SEQ ID NO: 6007 - DNA, 405 bp, Cicer arietinum
aacagctccccattacgtgctctatttgtttgagcagcaatccaccgaaactcaccattcaaattatactccttcatgagatcgtgcatcttctcaatctctgcaatttcttctctgtcactggacttcttcacatcaatataaccagctacaacgaccaggttgaccagttccctcaatttgctgttcttagcatagctttctaccaaaccagttatgtttttaactctgtctagccttgccatggagaaaattataggctttgaccggtccttcagtgaaccaatgcactcgtcagtctgctcggtatcatataatagcttttcaattgaaccatgcagggacgtgagtcttttctccttttcagagtaggggaaatatattgtcatatctgctccaggagag

SEQ ID NO: 6008 - DNA, 435 bp, Cicer arietinum
tacataccttaattattaagctgttaattaacacacacaaacacacttgagaatatgggcaccttggagaaaaaaggtttcacagaagagcaagaagctctggtagttaagtcatggacagcaatgaagaagaatactgcagagcttagtctcaaatttttcttgaaaatatttgaaattgctccatcagctcagaaactgttctcattcttgaaagattcaaaagttcctttggaccaaaatcccaagctcaagccacatgccatgtctgtctttctcatgacatgtgaatcagcaatccaactgcggaaggctggtaaagtaactgtgagagaatcaaacttgaaaaaacttggtgctacccattttaaaaacgatgtagtagacgagcattttgaggtaacaaagtttgcacttttggagacaataaaagaa

SEQ ID NO: 6009 - DNA, 439 bp, Cicer arietinum
actgaaagctatctttccgtgaaagaagagttaataactctacaagactctacaaccacaccaacttgtgatgaaaccgccattcccgaatcagattcaaaggatttaaactacgaatgtttcaaaaacagtgatggtgtcgcttctctgtttcctgcggatttcaaagacggttcttcagatagcgactcaagcgcaattttaaacgaagacaacaataacagtcccaacgcagcgatttcttcatctggggttctccaaaatcacaactttttgatgtcgtcttcgcaatcttcaatgagttgctttcaatttcagaagtatgtgaaaatggaagagcaaaattttcttggtggagatgagacatgtgatttcttctcagatgaacaaccacccactcttcagtggcattgttcggacgattggaattaagagaaaa

SEQ ID NO: 6010 - DNA, 340 bp, Cicer arietinum
accaaggattcaaataaggaagatagagagagattggttgttcgaaggtttaagtttgaggacccacgaattgagcaaattcaggatcttgagaatgatatgctgaggtatttcagagaggatttacataggagactcttaagtgcagattttaagaagcaagttgatggacttgaaatgctgcagaaggcacttccatccattgctaaggaagttatagaaattttggacattcttttgaggtggtttgtgttgcagttctgcaaatcaaacacaacatgtctattaaaggtgctagaatttcttcctgagttacttgacattttgaaggatgatgggt

SEQ ID NO: 6011 - DNA, 314 bp, Cicer arietinum
actatgctggaacttcttaaccagttggatggatttgaagcttcaaataagatcaaggttttgatggccacaaatcggattgatatcctggatcaagctctcctgagacctggacgtattgaccggaagattgaatttcctaaccctaatgaagagtctcgccgggatatcttgaaaatccattcaagaagaatgaatttaatgcgtgggattggtttgaagaagattgctgagaagatgaatggagcatctggtgccgagcttaaggctgtgtgcacagaagctggaatgtttgctttgagggagaggagggt

SEQ ID NO: 6012 - DNA, 333 bp, Cicer arietinum
  misc_feature (29)..(29): n is a, c, g, or t
  misc_feature (36)..(36): n is a, c, g, or t
  misc_feature (79)..(79): n is a, c, g, or t
  misc_feature (94)..(94): n is a, c, g, or t
  misc_feature (97)..(98): n is a, c, g, or t
  misc_feature (144)..(144): n is a, c, g, or t
  misc_feature (155)..(155): n is a, c, g, or t
  misc_feature (192)..(192): n is a, c, g, or t
caggcagaagggggaccaaggaggacccncagggcnccaaggggccggcgccgagacacgcaacacgcacaaaggaagnaacacaagcagccanccnnacagccaaacaggaaggccaaaacgaaaccccggaaacggccagancagagacggcnagaaaccccaaacagccacttctgaagctattggagnctggaaacatagacctttgctttgctaatgaggatgaggcaacagagcttctaacaggtgaacagaatgctgatccagtagctgctgtagaatgtctggccaaatactgtcaatggactgtactaacattgggctctaatg

SEQ ID NO: 6013 - DNA, 194 bp, Cicer arietinum
actcatctttgtctaataggagggaggacaaaatctcatcagaggagctccgcaacatttgatggcaactcctcaactatcacattgtaaaacttctggatatcagacagcatcttttcatcttccttagtgataaagttaatagcaacaccttttctaccaaaccttccactacgaccaatacggtggagata

SEQ ID NO: 6014 - DNA, 104 bp, Cicer arietinum
acgatcaacagctgcctcaggttttccttcttgacaaacaggatcattcaatggaaggcgatcgggattcttaaatgattctgggaactcattttccgagcatt

SEQ ID NO: 6015 - DNA, 380 bp, Cicer arietinum
actattcttcttctggttttctttttccttattattgttaataatattttcatcattttcaaccattgattttgaaggctttttagctttcttcttcttatcagcaggaggcttttctatttgtggccaaagctccactgattttcctgatcttgacagcttcttgatgagagtctcagcttccacgttacctgtaactgtaaccttgtgctcccgagaatcaatttctgttgtgtaaaccccttcaattccctgaagaattttcttgactctctttgtgcagccatcgcagtggatcaagactttcaaaacccacgtatgatacttgagggtttcaccgggaggaggaacctgttgatcggctggtgtggctgccattt

SEQ ID NO: 6016 - DNA, 417 bp, Cicer arietinum
acctatggggccttcatccagattgcaacatgctttggtctattgggggctttatttattggaatccctgtcaaagaaatttctggatggtggcgggtttgtttctgggtatctaacatacctgcagctctacttgctctggctatgttcttctgtgctgagagtccacattggttattcaagcaaggaagaattactgaagcagaagctgagtttgaaaggcttcttggtgtatccgaagcaaaatttgcgatatcacagttatccaaggtagatagaggagacgatactgatagtgtgaagctctctgaattgcttcgtggccatcattctaaagttgtttttattggatccaccctatttgctttacaacagctatctggtataaatgctgtgttttatttctcttcaactgtt

SEQ ID NO: 6017 - DNA, 421 bp, Cicer arietinum
atgaacagctggagaagattatgaagaccgaacgctttaagcctgataaaggatttgcaggggtttctgaaagggcaggtccaagggatagaccggttgagtttgagagtgaagaagctgatccgtttggtcttgaccagtttttgactgaggtcaagaagggtaagaaggccatggaaaatgtaggtgggggaggaactatgagagctagtgctggatcttcaatgcgagatggttcggagggaggttctggcaggactcggattggatttgaaagagggcgttaagcggatcagtgtaatggcttattgatatcatgcttaagttggtatgccttgatgtggatggtaaagataacgtggttgagtcatcacataccttttgttgccctccccaagggatcaccttataggtgttgaaa

SEQ ID NO: 6018 - DNA, 430 bp, Cicer arietinum
aaattgctggaggtgctactcagaattccatcagggttgctcagtggattcttcaagctcctggggcaactagtttcatgggttgcataggaaaggacaagtatggtgaggagatgaccaagaactctaaacttgctggtgtaaatgttcactattatgaagatgaaaatacacctacaggaacttgtgctgtttgtgtggttggtggtgaaaggtctcttattgccaacttatcagctgcaaattgctacaaggttgatcatttgaagaaacctgaaaattgggcattagttgaaaaggccaaatatttttatattgctggctttttcctcactgtatcccccgaatccatacaattagttgccgaacatgcagctgcaaataacaaggtcttctcgatgaacctttctgcaccctttatttgtgagtt

SEQ ID NO: 6019 - DNA, 292 bp, Cicer arietinum
acgtgatgctgtttggcaagtgacatacactctctttgatagagattttgatgagagtgagtgtcaattgccacaaagatgtggaaaatttgggctttgtgaggaaaatcaatgtgttggttgtccattagaaaatggaatatttgggtggagcaataaatgtagtgctaagcctatagcaacatgcaaagaaagtgaatttcattactacaaaattgaaggagttgagcattatatgagcaaatacactaatggtgatagtgtaagtgaagctaattgtggaaataaatgt

SEQ ID NO: 6020 - DNA, 426 bp, Cicer arietinum
taggaaccctgaggagattccatggggtgaggttggagctgattatgttgttgagtcaactggtgttttcactgacaaggataaagctgctgctcacttgaagggtggtgccaagaaggttgtcatttcagccccaagcaaagatgcacccatgtttgttgttggtgttaacgaaaatgaatacaagccagagcttaacattgtttcctatgctagctgcacaaccaattgccttgctccccttgccaaggttcttaatgaccgatttggaatcgtcgagggtcttatgaccactgtccactccatcacagctacccagaagactgttgacggtccatcaagcaaggactggagaggtggaagagctgcttccttcaatattattcccagcagcactggagctgccaaggctgtaggaaaggttct

SEQ ID NO: 6021 - DNA, 425 bp, Cicer arietinum
acaacaatcctttgatttacatcaccgaaaatggtgtcgatgaattcaacgatccaacactatcattagaagaagctcttttagacacttttagaattgactattattatcgtcatcttttttatattcgatctgcaatcaggaacggcgtaaatataaaaggatattttgcatggtcattgttggacaattttgaatgggcatcaggctatacagtgcgttttggaatcaattttgtagatcacaaaaatggtctcaaaagatatccaaagttgtctgcaaaatggttcaagagttttctcaaaagagattagactttatatatatgcttgatatgtttccaataaatagtttaataaaacgtatcaagcaaatgtaacttaatggatttgtggtggttcattcttaaacaactatgttacttt

SEQ ID NO: 6022 - DNA, 431 bp, Cicer arietinum
tacataccttaattattaagctgttaattaacacacacaaacacacttgagaatatgggcaccttggagaaaaaaggtttcacagaagagcaagaagctctggtagttaagtcatggacagcaatgaagaagaatactgcagagcttagtctcaaatttttcttgaaaatatttgaaattgctccatcagctcagaaactgttctcattcttgaaagattcaaaagttcctttggaccaaaatcccaagctcaagccacatgccatgtctgtctttctcatgacatgtgaatcagcaatccaactgcggaaggctggtaaagtaactgtgagagaatcaaacttgaaaaaacttggtgctacccattttaaaaacgatgtagtagacgagcattttgaggtaacaaagtttgcacttttggagacaataaa

SEQ ID NO: 6023 - DNA, 427 bp, Cicer arietinum
acctgttgtaggaggccatgcgggagttactattctcccattattttctcaggcaacacctaaagccaatctgagtgatgattacattaaggctctaacaaagaggacacaagagggaggaacagaagttgtggaagctaaggctggaaagggttctgcaactttgtcaatggcttatgctggagccatatttgctgacgcttgcctcaaaggtcttaatggagttccagatgttgttgaatgctcgtatgtgcaatccaatatcatcgccgatcttcctttcttcgcttccaaggtgaggattgggaagaatggtgtggaggaaattcttggcttaggtcctctctcagatttcgagcaacaaggccttgaaaacctcaagtctgaactcaaatcatctattgagaagggaatcaaatttgcctcc

SEQ ID NO: 6024 - DNA, 396 bp, Cicer arietinum
aagttgcaattaaaacaaaatgcattcacatatatgattaaatgacatacggtatgacacaaagtgctttacaacatcttaaattcaaaattcatacaataatgagaatataatttattcctaaataaaacacacgaagagaaaaagagtgacacttttttctttttatgaggcaaattaataattgtgcgatacatcttcagaaactttgcttccactatttttcctttgtataattgcacaatgcatattccttatgtgcactatcttcgctttattttcgatatattcctcaaatccatggatgatatggtaaaccactctctattaatggtaaggaggaggaggtgatgcatagatgtaatgcggtggaggaggggaatagaccggaggagg

SEQ ID NO: 6025 - DNA, 401 bp, Cicer arietinum
atcatgtgctacaaaggaggactctgtgcataaccaattccagacatggagtccagtttctgtccttgaaagcagcagttcctcctctggtggaaagacgaccgggatttacatccctgtgccttgtggacgtgcacgcaccaagcgtccacgtcccgcgacattcaaccctcgttcggccatgcagctcatttcccctacttcctcctttgtaggggagaatatgcagcctaatgttatctccaccaaggcatctttagagttcgaaaacgttgttgagtctcaaattgtgggcaagaaaccaaagcttgcttctggagagtcaaagaagaaaaagaaaatgaagatgccacttcctgcagctccagctgacagcaatcaggatgcttcacaacctatta

SEQ ID NO: 6026 - DNA, 428 bp, Cicer arietinum
acttcgagatgccttcaaaaaaggcatgttgaagtatccacctgcttcggcgctttctcttttggatacatgttatgatcttagtgggagcaaggtggtgtccgttccaaagattagttttacgtttggcggtgatgtcacggtggatctcgccgcgtcggggatactttatgtggcgagtgtgaagcaagtttgtttagcatttgcggctaatggagatgatagtgatttgactatctttgggaatgtgcaacaaagaaccttagaggttgtttatgatgttggtggtgggaaaattgggtttggttatggtggttgcaagtgatcaaattagttagttttgatttatagatataaccaattaactaatcaagcaaaatgaaaaatacattaaaattattgtatttttagtttttgatttgttatgg

SEQ ID NO: 6027 - DNA, 263 bp, Cicer arietinum
acatcctcccatgggtgacggtagagtggttgcttcaatctcttcgggtcgaaggtgtgcccaatcagaccaatggggcgtgccagcacaaagagaccattcagataaccaatctccacaatttcatcaatctcttgcttggtgaacattccactaccagcaagaagatctaagaaaagagatccaattgcacccccgcgtacttctttatttcaataaattttaataataacaaatattacaataatagtttaagaggaggg

SEQ ID NO: 6028 - DNA, 438 bp, Cicer arietinum
acataccagaactaaatcacatcaattgtcaatgactagttactagcaaaaaaccatattgctgtaacttgacagcatgaaacataactaagcagtattgtttataatagtcgaaaaattagcatccttgatgaagtcatcaacctaaatgaagttgacacattatggcctagctagccatcatgacataatcaattgcctgcagggcttggttggaaaaaaaccgcacgtcaacatcaggatcctcactgagctcaaccagacatggtcggatagtcttttctaccacagactgatcaacgatggggaagatggactctaatacctctgccacattgaactttatgtttggcactctgtcttttgatgctgcaacaacagcaggcaataattttgaacaagtgatttcagcgcccattacaggagctagcagggaga

SEQ ID NO: 6029 - DNA, 352 bp, Cicer arietinum; identical to SEQ ID NO: 5061

SEQ ID NO: 6030 - DNA, 327 bp, Cicer arietinum
cgttcaatcttccccttggtttcgtgattactggcttcgtgaacgcttccaagatccccaaaatcataacgacacttcctacttctctgatttcgagatcgatgaagatgatcttttccatcaaatcgagccacaacacgaagatgaaggaggagacgggaaagaaatggtgaggttgcgagatttgaaatggagaggatgtgatggatgggctgatgttcctaggtatgcggaaaaggctccgaagattgttaagcccagagtgagcccacgggctattcatcagcctaggtagatgatgacaagtggaaacaccgtttgcgttgt

SEQ ID NO: 6031 - DNA, 239 bp, Cicer arietinum
gtcaataaaaaaaactcacttttgattcttcttttctaaatcttctcacttttctttctggtaacataaaggttgaggttgataactgtttataacaattattaaatacaaagcataaaaactgcaacatattaataacattaactttaactcacctaaaattaacaattatacattccatcttccctcttgaatcaactagccttgcagataacaattaacatctcttcatttacttt

SEQ ID NO: 6032 - DNA, 300 bp, Cicer arietinum
acttcgagatgccttcaaaaaaggcatgttgaagtatccacctgcttcggcgctttctcttttggatacatgttatgatcttagtgggagcaaggtggtgtccgttccaaagattagttttacgtttggcggtgatgtcacggtggatctcgccgcgtcggggatactttatgtggcgagtgtgaagcaagtttgtttagcatttgcggctaatggagatgatagtgatttgactatctttgggaatgtgcaacaaagaaccttagaggttgtttatgatgttggtggtgggaaaattgg

SEQ ID NO: 6033 - DNA, 427 bp, Cicer arietinum
taggaaccctgaggagattccatggggtgaggttggagctgattatgttgttgagtcaactggtgttttcactgacaaggataaagctgctgctcacttgaagggtggtgccaagaaggttgtcatttcagccccaagcaaagatgcacccatgtttgttgttggtgttaacgaaaatgaatacaagccagagcttaacattgtttccaatgctagctgcacaaccaattgccttgctccccttgccaaggttcttaatgaccgatttggaatcgtcgagggtcttatgaccactgtccactccatcacagctacccagaagactgttgacggtccatcaagcaaggactggagaggtggaagagctgcttccttcaatattattcccagcagcactggagctgccaaggctgtaggaaaggttctt

SEQ ID NO: 6034 - DNA, 319 bp, Cicer arietinum
tactggtgcacgtgaagctgctttcagaaacatcaagtcaattgctgaatgccttgctgatgaacttattaatgcagcaaaaggttcatccaacagctatgcaatcaagaaaaaagatgaaattgagagagttgctaaggcgaatcgttaagcagcttttggtggcagcgggattggcgacctgaactttttgaaactatttctttcttagtttaactttatttttaagtatgatgaatgattaactttcatatttgtaatgcagatttttgaaattgtctattttcagaaatgagaggtagtgtctgcataatttggt

SEQ ID NO: 6035 - DNA, 405 bp, Cicer arietinum; identical to SEQ ID NO: 5619

SEQ ID NO: 6036 - DNA, 436 bp, Cicer arietinum
tcaatcttctaaaaccttactagctacttagcaaaatggcactttcttcttcttcttctaaatctttttctttatcatcatctaattcagtagtcaagtttttgttagctttgatgatgtttttacttataggaaattgttgtgctgaactctctgaaaacttgtatgttaaaaaatgtcctaatgttttcaatgctataaactctgttgttcactctgccgtggctaaagaacctcgtatgggagcatctcttcttcgtcttttctttcacgactgctttgttaatggttgtgatggatcggtgctacttgatgacgcatcctccattaaaggagagaaaaatgcaggtccaaacaaagattctttgagaggttttgaagtgattgatgccataaagtctaaggtggaggcattatgccccggtgtggtgtcatg

SEQ ID NO: 6037 - DNA, 428 bp, Cicer arietinum
caaactgtataattcttattgttagtttttttttcttttataaaacaccacaagggaggtgagaggggttaacttaatttaattttttttaactttttgaaagagtgaaaaaaaaaatgttggggatcttcagcagctccgtggtgtctcctccagaagaactggtggccgccggtagccgaactccgtcgccaaagacgacggcgagtttgcttctgaaaaagttcgttgagaggaaagcgtcggcggtgtcactgcaggttggggagcacgtgcagttggcttacacacatcaaggggagtcactgcggcatcccagatcatttgctgttaaggatgagatattctgcttgtttgaaggagctcttgacaatttagggagcttgatacagcaatatggacttgcaaaatctgccaatgaagtagtt

SEQ ID NO: 6038 - DNA, 196 bp, Cicer arietinum; identical to SEQ ID NO: 5602

SEQ ID NO: 6039 - DNA, 431 bp, Cicer arietinum
acattagtgatgggtttccttgcttacgtggcacaatatttgaatatggaatggattcagcttttgcttctcataagacaaatgaagcttatcttttcaaaggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagttaataattaatgtaataaatgtgtgctgtaatatatatgtggtcgcggtttgcttgggttcttaatgaaataaaa

SEQ ID NO: 6040 - DNA, 196 bp, Cicer arietinum; identical to SEQ ID NO: 5602

SEQ ID NO: 6041 - DNA, 399 bp, Cicer arietinum
gcacatgccgtacagccagcaaaatcagcatttgccacaaaatcccaaattcgacgtgctattgaagcagaaggtataccttatacatatgtttctagcaactactttgctggctattttcttcccacattagctcagcctggactctttgctccacctcccccaagagacaaagtcatcatttatggagatggaactgccaaagcggttttctacaaggaagatgacattggaaccttcaccattagaactgtggatgatccaagaacattgaacaagattgtctacataaagccccccaagaacacttactcattcaacgagcttatcgccttgtgggagaacaagattgggaagaccctcgaaaaaactcatttaccagaggataaacttctcaag

SEQ ID NO: 6042 - DNA, 393 bp, Cicer arietinum
cagtctggcttcacttattcactactagaatttacaagatggttacccgcgagcacgtccgaaatatcttcgcaggccccagcaagggcgacatggccagcttctggccccacgtcgagcccaacgtcgactggaccgtaaaaggcacccactgcaaggtctctggccgctacaggtccattgaggaattccaacaggggacaagggctttgtcatccacttgggcaggccccctgcatcttgtcgttcaaaacatcatcattgagggaaaccaagctgccgtggagcttaacgccgtcaacactaagactaagagcggcgatccctttccaaatgaatatacctgggtgctgggctttagcgacaacggcaagatcgcaacagtgagggcgt

SEQ ID NO: 6043 - DNA, 380 bp, Cicer arietinum
actgatggaagcagcaagatcatttgcccaaatgttccttccatcaaccactccagcaaagatccatttgtcactgggaaatccagccttgatcaattcaagagtcttaggtccacggactaaatcaaatccatatgcggcaacaccactcaaagatgtgagggtcttgtatgcctcagcagggacatcagcaaagtaggtctcaacaaggacatgcagaccagagaaagaaggtgcgagtgctgcgtatgcatcagtaaatgcttgcaacttgtgagattcaagatccaagacaagggtgggttcatcaaattggataaatagagcaccagctgccttgagatcagcaataacctccttgtagacagcaaggactttgg

SEQ ID NO: 6044 - DNA, 432 bp, Cicer arietinum
actttggcgtgcagttgtcaggatttgcctttactgctaatgggtgggtgcaatcctatggatctcgttgcgtcaagcccccaatcatctacggtgatgtgagccgcccaaagccaatgactgtcttctggtcatctcttgctcagagctttaccaagcgtccaatgaagggaatgcttactggccctgtcaccattctcaactggtccttcgttagagttgaccagcctagatccgaaacctgctgtcaaattgctttggctatcaaggatgaagtagaagaccttgagaagggtggtattggtgttatccaaattgatgaggctgccttgagagaggggctaccactaaggaagtcagagcatgctcactacttggactgggctgttcactccttcagaatcaccaatgttggtgttcaggattccactc

SEQ ID NO: 6045 - DNA, 429 bp, Cicer arietinum
accaacaaggttgctttgcaggtggcacggtgcttcgtttggctaaggatttggctgagaataacaaaggtgcacgtgtgttggttgtttgttctgaagtcactgcagtcacatttcgtggtcctagtgatactcatttggatagtcttgttggacaagctttgtttggagatggagctgctgcattgattgttggatctgatccaattcctgaaattgagaaaccaatatttgagatggtttggactgcacaaacaattgctccagatagtgaaggtgctattgatggtcaccttcgtgaagcaggactcacatttcaccttcttaaagatgttcctgggattgtctcaaagaacattgataaagctttgattgaagctttccaaccattgaacatatctgattacaattcaatattttggattgcac

SEQ ID NO: 6046 - DNA, 437 bp, Cicer arietinum
ctcagtaactcatggagttcatgctgtaaggcttggaaatgaagcttcaatttcacaaactataaaagtcaaacctggtcaacgttatgctttaatccttggcgcatcaaggacttgtgcacaagatgaggttttgagaatctctgtgccaccacaaactggtgatgttcctttgcaaacattgtatagtctcaatggtgatgttattgcttgggggtttaaagctacttctgatgttgctaaagtgacttttcataaccctggtgttcaagaagatccagcttgtgggcctcttcttgatgcaattgctattagagagttttaccctccaatgcctactagagccaatttggtgaaaaatccaagctttgaagaaggtccattcccaattttcaacacaacaaatggtgttttactcccaccacaacaagaagatg

SEQ ID NO: 6047 - DNA, 293 bp, Cicer arietinum
acttggttgaattactattgcgacactgtcatcagtagggtaaaactaacctgtctcacgacggtctaatcccagctcacgttccctattggtgggtgagcaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgt

SEQ ID NO: 6048 - DNA, 437 bp, Cicer arietinum
accgttttggatgggaatttgaagctcagagtgttgtcgacgatgttaagaaaaatccagaggcgtgttcgagtggaattgttcttcggagaagattgcaacttatgatgtataatattatgtataggattatgtttgatagaagatttgagagtgaagaggatcctttgtttgtgaagcttaaagctttgaatggtgaaagaagtcgtttggctcaaagctttgagtataattatggtgattttattcctattttgagaccctttttgaaaggttatttgaagctttgtaaagaggttaaggatcgtaggttgcagctcttcaaagactatttcgttgatgagagaaagaaacttggaagcaccaagagcaccaccaatgaaggactgaaatgtgctattgatcacattttggatgctcaacagaagggtgagatc

SEQ ID NO: 6049 - DNA, 428 bp, Cicer arietinum
ccgagctgaagataaaagctatgggctgggcttgggcaacgtgttctgcaagacgggtaaaggttggacatgtgtgataactaaggctgatgggcctgatgctggaaaagttttcgttaaatgcggtgaaaattgcacctgcactcttaatggtgaagctgtgtcccctgaaattgagagtagtagtgacaatgacagcgaaacattctgcaaatgtggagaagggtggagttgttcaattttcaggactgaaggccctgatgcagactcaggcaagggctttgctgaatgcactcaacaatacaagtgtgcttgtaattgttgaccaccaattgtccctaaagaacctaatataatactacgaaggctaataaatttggtatgtcaaataaagggactactatcctccagttattatgtgtgattag

SEQ ID NO: 6050 - DNA, 430 bp, Cicer arietinum
actacatcattttccataacttaatcagttaatcatcacagacaacatcactgattagtgatccacacacaatctaagatcgagctaataatcatactttattttaatataaactaacatttagactgcacaatcttaagctcccaaaccaattatcacacacacacacataaactcagcttattagcataagcatatataattaatattctaatatgctttttcatatgctcagcaacaacttagactgtcactacgggtcccacatcaacacttgataaggccttcatagcttcaaatctaggctctttagcttggaatttgagaccaacatagagcttcatgtaatcatcaaagacaaattttgggtagatttcacttgtttcattttcctttactaaggttggtgctggagagattaaagcatcat

SEQ ID NO: 6051 - DNA, 241 bp, Cicer arietinum
gataaaatctaaccacttttacattatggtgatgaaagaacagagaaaattagtgttaatgttacttatggtaatggtaataattatgggttgtatgttgaaaggttcaaatgggtttagtttgtgtaacatgaatgaagatggattggatgcttgtaagccagcagtgactcagccaccagaagatccaaagcctgaatgctgcaaggcacttaatggagctgacttgagatgtctttgt

SEQ ID NO: 6052 - DNA, 119 bp, Cicer arietinum
acaaaaacgagaaccacagtaacacaaaaccataacatgataaataccatagccaaaccactaatttcttaaacctactaaagtgacatgacaaggagaacattcttaatcataaaccc

SEQ ID NO: 6053 - DNA, 381 bp, Cicer arietinum
acaagatttgattcctaccgtatcacctcatgttgatgaggaaggatgtaaaacagtgactccattgtcagatagttttgcccgtgccgagtctcctctgcaattacacatttcaactgcaatgatggggagttttatgaagcttgccaagtctaacactgacaaaaatttagagacttgtggtatccttgcaggctcgcttaaaatctgaaaattttatattacagctctaataatccccaagcaggagtcaacatcgagttcttgtcaagctacaaatgaagaggaaatatttgaagcacaggatgagcgatctctttttccccttggctggatccatacacatcctacacaatcttgtttcatgtcatcaattgatgt

SEQ ID NO: 6054 - DNA, 431 bp, Cicer arietinum
accttgtctcacaagcgtcctagaggaagttctagcccacctaaaactaaagctattgtagattcagatgcgagtaaagaggaggatgaggaagttcaaagagcgctagcagcttcattggaaaacatgaaagaattaagtgcaattgctggaggagataataaagatgctaatgttgccggcaagttgcaagaaacagccttgtcaaataggcctgtttatccaaccctgcctgaagaacctaaggctgaaagaaatctcttatgcagaattggtttgcggcttccggatggacgccgtgttcagcgaaacttcttacgctccgatccaattcagctgctgtggtcattcattgctgttcagctaggtgaagatgagacaaaagcatttaaattaactcatgcaattcctggagcatctaaaaacctgga

SEQ ID NO: 6055 - DNA, 351 bp, Cicer arietinum
gctacagcaaataaagtttattatgtctctatgttacatgatttacaatcttattctgtaatgtggcatatggcatatataagaaatgacatctgatcaccaaacttattttacagacaaatatcaacaaagacttatcatcagacaactatcaacaaagacttatcatcgtatcgggacattttacgttcacgatggacaactacaaagcataacgtacctactacttcaaaaggtgaagcactagttgaaactatgaaaccaaaggcagctacaaagttgtcaaagaagaaaaagaagtcagaagaaggtaatgcatgtgaaattggcgactcgggcaataccaagcaa

SEQ ID NO: 6056 - DNA, 428 bp, Cicer arietinum
cagatgtttaatgaatttgatgccactggtggacccttttcaaaggagttgattcccaagctcacggttgtgaggagaaatttatcctccaaattgggggtagctataccagatattgatgtagcttacgttcggcaagttgttgccactatcatatttctaaagggagttggaggaattctatttgtgtttggcagcacatttggatcatttcttttgctttcgcatctggcgcttactactcccattctgtatgatttctacaactatagacctacgaagcctgaatacggtttactgctaaatgagttcattcagaacacagcactttttggtgcattgctattttttgtaggaatgaagaactcaattcccagaaaacagttcaggaagaagaccccaaaaacaaaaacaggatagaaattaga

SEQ ID NO: 6057 - DNA, 240 bp, Cicer arietinum
acaaggctcctacctaccaggctcctcactactagattcgctcttcgacgatgaaggatagtagctgtttgtgctgtggttattgagtgggtgactcgtgctgattcacgatcatggtatatgacctgtgtgtgaaaacgcatagcgagaggacggcgctggacttctgacttatgagagattctggagggatgtcagatatgtgtttggatggatggacttttgacatattcttcttgt

SEQ ID NO: 6058 - DNA, 240 bp, Cicer arietinum; identical to SEQ ID NO: 6057

SEQ ID NO: 6059 - DNA, 134 bp, Cicer arietinum
acacagctcacaaaagagacttggtggagcttatgagaaacctcccgggacctttgttcctcttctctatacacaggtcctttatttctctcctcccgtctcccgcggcattaacttgaatacttaaacccctt

SEQ ID NO: 6060 - DNA, 390 bp, Cicer arietinum
ccactttgaagaaacaggctaagccagctggaaggccattcggtggtccacctggtgatcgcccaaggggctcacctagattcgagggagaaaggaggtttggtggtgatcgcgatggataccgtggaggtccccgaggacctgctggtgaatttggaggagacaagggtggagctccagctgactacagaccttcttttgggggtcctggtggtagacctggttttggacgtggtgctggtagttttggagcaccaactagttcaaatgctccttaattgtaatggtttctgctctagcttatgcagttttggctgtgattagagtttatagtatttcccctctactaaaagttgtttgattattaatttgaatattcagttatttatg

SEQ ID NO: 6061 - DNA, 434 bp, Cicer arietinum
actgaagctgcacttcagtgcatcagagagaaaatggatgtgattgacctagaagatgaaaccattgatgctgagatactaaactcaatggcagtcacaaatgaacatttccagactgcccttggatccagcaatccttctgctctccgtgaaacagttgttgaagtgcccaatgtcagctggcgagatattggtggtcttgaaaatgttaagcgagaactccaggagactgttcaatatccagtggaacatcctgagaaatttgagaagtttggaatgtcaccttcaaagggggttctgttctatggtcctcctggttgtggtaaaacccttttggccaaagctattgccaatgaatgtcaagcaaacttcattagtatcaaaggtcctgagctactcacaatgtggtttggagaaagtgaggctaatgtgag

SEQ ID NO: 6062 - DNA, 432 bp, Cicer arietinum
actcatgaaggcgtgattgctggattcaaggctgcttccgttgcatgcgttgtcagtgctgtgcctacattgactgctgttcgcaagattccatgggcaaaggcaaacctcaattatactgctcaggcacttatcatatctgctgcatccattgcagcatacttcatcactgctgataaaacaatcttggaatgtgcaagaaaaaatgctcaacttgaaaattctctgagacacaatcgtgacacagtttcatcttagacacttctatactcattgctggtcttggtgaaggatttgtgctacttgcaatattcaaccagtaggcctgttgcaaaactttcctttctgggtctggctcgaatggatttgaaggtgtatatgctcaaataaaagagtttgttgttgttgttgttgttgtgtaacagttatatt

SEQ ID NO: 6063 - DNA, 224 bp, Cicer arietinum
gtctgtcatgtcatgtgaactatgttgtcatggatacgaggtgcgatatgacaatggagggtatattctgagtttgatttatcaaatgttctgtagcagccctctggatgtggagggcacagaattaagaggcagattttgccttggaattcttccatgccttctttattaggttgtctgtagtaacgagtgattgtgatgcttattttatttccttttgtccc

SEQ ID NO: 6064 - DNA, 432 bp, Cicer arietinum
actggaaatcagaatcaaacgagcttttacccttttgttccacacgagatttctgttctcgttgagctcatcttaggacacctgcgttatcttttaacagatgtgccgccccagccaacctccccacctgacaatgtcttccgcccggattggccaaccgaagtcagccttggatccaaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaatccattcatgcgcgtc

SEQ ID NO: 6065 - DNA, 383 bp, Cicer arietinum
actttggcgagcagttgtcaggatttgcctttactgctaatgggtgggtgcaatcctatggatctcgttgcgtcaagcccccaatcatctacggtgatgtgagccgcccaaagccaatgactgtcttctggtcatctcttgctcagagctttaccaagcgtccaatgaagggaatgcttactggccctgtcaccattctcaactggtccttcgttagagttgaccagcctagatccgaaacctgctatcaaattgctttggctatcaaggatgaagtagaagaccttgagaagggtggtattggtgttatccaaattgatgaggctgccttgagagaggggctaccactaatgaagtcagagcatgctcactacttggactgg

SEQ ID NO: 6066 - DNA, 327 bp, Cicer arietinum
acccattttggaggtagcaaatcaaccggttttggtttgatttacgatacagttgagaatgctaagaagtatgagcccaaatacagacttatcaggaatggtcttgacaccaaaatagagaagtcaaggaagcaaatgaaggagagaaagaatagggccaagaagatccgtggtgtaaagaagaccaaggcctctgatgctgccaaggctggaaaaaagaaatgagtttttagttgtcgtgtttgtgctttaaggttgttttgctttccaagtttttttgatagctatgttatctcatgcatggtctacaaaatgagatattttggt

SEQ ID NO: 6067 - DNA, 431 bp, Cicer arietinum
actggatcgccggcgaaccagatatctggtgataaaattggaaagactaatggtggtgatacttcttctgtgtcaccggttccttatgtctttaatggaggtatgcgaggtaggaagactaatggagctgttgagaaggtaattgagaggaggcagagaagaatgataaagaatagggagtcagctgctagatcccgcgctcgcaagcaggcttataccatggaattggaagcagaagttgcaaagttaaaagaagagaatgaagaacttcagaaaaagcaggcagaaatcatggaaattcagaaaaatcaagttaaggaaatgatgaatctgcagcgagaagtcaagagaaaatgcttaagacgaacacaaactggtccgtggtagattgaagattggattatgatttctcagttgaaaacatatgtata

SEQ ID NO: 6068 - DNA, 238 bp, Cicer arietinum
ggtgttggaacatgatgtggtggcagagaaagtgagtaatcacaagggatgctgcaaatcagggccaggttatgcttctcctcttgaagccatgtctggtcccagagagactctcatttatgtcactgctgtctattcaggaacaggaatagagaagcctgattatttggctacagtggatttggatccaaactctccaacttattcaaaattgatccatagactacctgttcctaat

SEQ ID NO: 6069 - DNA, 434 bp, Cicer arietinum
atctccagagccgcaacaaacaatgggacgtgtgatccgtgcacagcgtaagggagctggctccgtcttcaagtctcacacacaccaccgcaaaggaccggcacgtttccgcagtctcgacttcggagaacgtaacggttacctcaaaggtgttgtaactgacgttattcacgatccaggtcgcggtgcacctctcgctaaagttactttccgtcacccgttccgttacaagaaacagaacgaactcttcgtcgccgctgaaggtttatacaccggtcaattcatttactgcggtaaaaaagcgactctcgttgttggtaatgttcttcctctccgttctatccctgaaggtgctgttatttgtaatgtcgagcatcatgttggtgaccgtggtgcttttgctagagcctctggtgattacgctattgttatca

SEQ ID NO: 6070 - DNA, 333 bp, Cicer arietinum
acgttgcagatgagcaaaatcaactaaagttgcagattaatgctcaaaattgtttacattgcaaggcttgtgatatcaaagatccaaagcaaaatattgagtggacagtgccggaaggaggtggaggtccgggatactcagtcatgtagatccaggaatcagtcatactgtggtccctgaagttacgacttccggaatgtaaaataagttgctaaggttcctcatcttaaacaacaacaagcatcttacactgttctgttagaaattatgtctgttcagtgtttttcgcattttaaatattctgtgtcattgtacctcggcccgaccacgcta

SEQ ID NO: 6071 - DNA, 425 bp, Cicer arietinum
acaggagagcaacaaatcatatgcagaagcttatgctgtgggacgacacattcgtatgtctgctgataaagctcgaagagtaatcgatcagattcgtggacgtccatatgaagaaacacttatgatattggaactcatgccttatcgagcatgtgaggccattcttaagatagtgttttctgctggagcaaatgcaagcaataacttgggtctaagtaaatcaagtttagttgttagtaaagcagaggttaacgaagggaaaactttgaaaagagtaagagctcgagctcaagggcgagccaactcaattaaaaagcgcacttgtcatataactatcacagtaaaaggtttacctagcgaggctgtcgtggaagcaaatctctcttgatcctatttgagacaaaaaaatatgtatcctctccaac

SEQ ID NO: 6072 - DNA, 430 bp, Cicer arietinum
accacacaaaaaataacaaacatcagcagcctcttcagataataatcttgttggccttgacctgtgtgaagaggatatctatgaacatggccaccatgaaatgaattagaaaacccataagggaaaccagcggctccaccatacatggccccaccgtgaaatccatgcaactgaaagttaaataaggatggtataaaaccaccaaatcctgcagaaaatgtgaaattcccaaaccttgcagttgctgctggagcaaatcctcccaatccacctgtgaatccaaatccatgttgagaaaaaggatttgattcgggtggaggagcagtctccggtctctgaccggcaggacgatgagggatattaacaccaggaatagacttcgatctcggatcagttgatgtctttcctctcccatataaaggaactaact

SEQ ID NO: 6073 - DNA, 429 bp, Cicer arietinum
caatactgcggggacgccatcggctccctaacagcagttttcagagaaggaattttggagagttcaccttctctgacaacacctttgtcggatctaatggcggcacctcagaaccagaacgccttagatatcggaggacggtgcccgtggcatcggtagcgacatccttccgatcaacgacgccgattgcgatgggtttttcccctttgaaggcaagccgcaccgccggcctctgattccttcccaaggtttttccctgccgccacgacatacgactacgagctacaacttggttactggagattgtggactgcgtcagcagatgtagcgatgcgtgagagaattctggtcggtggaaaaagtcgacagtatgcccccgaacccgctgacgggtgacgggctcgagaaaatacagcgccttttgtgcct

SEQ ID NO: 6074 - DNA, 270 bp, Cicer arietinum
actacaactagtgctagtagagagcaaagctatagttattttaatactagtaaggaaagtgttttctctgaaatcatgaacccaaaagcacggtaaatttctcagaattactgttagttgcgataattttattcaagttaaaatgtatagttttttttaaaatcgcagcgcttggtcgtgatttttactaaacatgtatttaatctgatcattatgtataatggaattttagtatactatttataaggcaaagttttaggtttgaagact

SEQ ID NO: 6075 - DNA, 430 bp, Cicer arietinum
acgttgagatcggaagggttggtcttgtcaactacggaaaggactatggaaagctcgttgtcatcgtcgatgtcatcgaccaaactagggcacttgttgatgcacctgatatggagaggtcaccattgaattttaagagactttctctcactgatatcaagattgatattaagagagttcctaagaagaaggatctcatcaaggccatggaagctgctgatgtgaagggcaagtgggagaagagctcttggggtagaaaactgattgtcagaaagagaagggcagccctcaatgattttgataggttcaagattatgttggcaaagattaagagggctgctgtcgttaggcaagaacttgctaagctgaagaagactgcggcttaagcatttattttcaaattttgttatctatttccttccatttagta

SEQ ID NO: 6076 - DNA, 435 bp, Cicer arietinum
aatagaccttgcccgtcgtctcagcacaacgtcatacaacaatatgggtattgaccctgtcgatggaaaatggataccagaacatcagtggtcgagtgcccatgacttgctgtatgccaagctctgttacagcaacctactctttagaagtccccgcaaaacaccatacatcatcagcaagggcaagaagttctatgttgattggacgacaggccgaatggtcagggtcctcccgcctgcctatggtgagatcgactactttggggcttggcaaacggttcataccgaaaacagacttatctgagttcttggccaaacggacacaccctcctgccaccactatatcacctatgatctatctcatcattactacatacacatactcactggagtcgacgactattctcttacgacagacaccaccgcgaccagtca

SEQ ID NO: 6077 - DNA, 384 bp, Cicer arietinum
acgaccgtcctcaagttgctttccggcgaagataagtctctgctggtccgggggaattccttccttgtcttggatcttggctttaacgttatcgatggtgtcggagctttcgacctcaagagtgatggtcttgcctgtgagggtcttgacgaagatctgcatgcctccacgaagacggaggacgagatggagagttgactccttctggatgttgtagtcggcaagggtacctgcccgggcggccgcccgggcaggtcatgagggtgtgatggcaggagctaaggcagctgttgttgctgccattgccactgccattccaacttttgctagtgttaggatgctaccttgggcaaaagcaaacctcaatcacactgctcaagctct

SEQ ID NO: 6078 - DNA, 435 bp, Cicer arietinum
actacaaaatcccgcaactatctgaaaagagtgatgttttcagctttggcgtggctctacttgaaattgtaagcggccgagaacctctaaacataaagagaccacggattgaatggagcttggttgaatgggccaaaccatacataagagcatcaaaggtggaagaaattgtagatcctgggatcaagggaggatatcatgcagaggcattatggagagtggtggaagtagcactgcaatgtcttgaacccttctcagcatataggccgtgtatggttgatatagttcgcgagttggaggatgctctcatcatcgaaaacaatgcatctgaatacatgaagtcaatcgacagccttggaggatccaaccgctactcgattgtcatggacaaaagggtgcttccctcaactacatctacagcagaatcaaccacca

SEQ ID NO: 6079 - DNA, 430 bp, Cicer arietinum
agtgaaacagctgtgattgctgagacaggggactcatggtttaactgtcaaaagctgaaattgcctgagggatgtgggtatgagtttcaaatgcaatatggctcaattggatggtccgttggtgcaactcttggctatgcacaagcggtcccggagaagcgagtgattgcttgcattggtgatggaagctttcaggtaactgctcaggatgtatcaacaatgctgcgatgtggacagaagaccatcatcttcctgataaacaattgcggatacacaattgaggtagaaattcatgatggaccatacaatgttatcaagaactggaattacactggattaattgatgcaattcacaatggtgaaggaaaatgttggactaccaaggtagtgtgtgaagaggagctagttgaagcaattgccactgcaacag

SEQ ID NO: 6080 - DNA, 433 bp, Cicer arietinum
gcagttagcgaaattgacgaaatattcgctggaaaaaagagaaagaaatctgatgcgaaaaaaactggaaaatccggtgacgtaactaagagtgctgataaaacaaagaagatgaagaatgaaaagaaaaaatccaaaagggtagatgatggtgagtttgtagatcggccttctcgaccaagaaagaaaacagaggatggacttactatctattcggaagaggagttaggtcttagtaaaggggatgctggaaatactccactttgtccatttgattgctcttgttgcttttaatggaagctgctaatgatttgtgcactgatttccttgctccaacgaacgaaggtgttgtggttgtattacatcctttattatttacagttgggccaagtgtgacttgagttatgttgtaatgaccttgaattctttagat

SEQ ID NO: 6081 - DNA, 288 bp, Cicer arietinum
acttcttcttgacttccataatcaatgtagaatacttcaaacacgtccttaggagattgaactggtcctcgaggcacattgacaaccattgcacgataccaagacttatcagcgtggaaataacacaggactatgtcgcccttcttaggattaaaagcgccaatcagaggactttccttcaggttcaaagaagcaagctgtgtctgaatggatgctatcttttgatctccaacagtctggacataaaatttaccacctcccaagactccagtaacaattaccttaagt

SEQ ID NO: 6082 - DNA, 437 bp, Cicer arietinum
actgcactgatgcttgtttgaagagatatcttgaagctcgaaattggaatgtcgacaagtcgaagaagatgttggaagatacactcaagtggagatcagcctataagcccgaggaaattcgttgggatgaggttgcaattgaaggggagactggcaaagtttatagagcaggtttccatgacagacaaggaaggactgttcttattttgagacctggaatgcagaacacttcttcaatggagaatcagataaagcatcttgtgtatcttttggaaaatgctatgcttaaccttccaccaggtcaagaacaaatggcttggttgatagacttcactggttggtcattgaccaacaatgtgcccctcaaatcagccaaagaaaccatcagcattctacagaatcactatcctgagaggcttggcatagcatttctttat

SEQ ID NO: 6083 - DNA, 399 bp, Cicer arietinum
gccaggaaaccagaacagccttgagatcgatagtctcgcccgctatgctgttgaggaacacaacaaaaaacagaattctcttctggaatttgaaagggtgataagtgcaaaacagcaagtggtttctggaaccttgcatcacatcactcttgaggcaaaagatggggtgaataaaaaggtttatgaagtcaaggtttgggaaaagtcttggatgaacttcaaggaggtgcaggagttcaagcttgttgaagatgcatctgcggagtcaagtgcttaactaggttaataataattaataaaagtcatgttcctagcttggctcgaaggtgagacgcctaaggataatttaaaaccaggatatgtatgaaatagatccaactcttgctttcaggatttagt

SEQ ID NO: 6084 - DNA, 286 bp, Cicer arietinum
gcggacgcccgggcaggtactgctctccaactcccttctcaactgaagagagaaatcatcactaacatcgtcatcatcccaatcatcctcccactgttgagttacttctttcccttcctccttatcatcccactcttcattaatttcaaactcttcaaattcatcatcgccttcaaagagatcgatcttgacatcctcagtgacagcctttgtttcagttgccatatgcaaatctgaatcaggcatgggcggaaatggaatggaaacaacaatgaaatttgaagaa

SEQ ID NO: 6085 - DNA, 403 bp, Cicer arietinum
catggctagtgcagtttgataaatgggagttacacggtgaagagcggcatggttgtgtggtcactaccatactaagaaaggattcagattcgttcacagtgatgcacgtgcacgcgacgtggttggaacaatctgggcaaaatgaatggatattatagacggttcctaggccttattgtgatccctattgcaataaatgtaatgtaatccatgaaaaaactaatttctgcttttgaatattatgtagaccttccatcatgtggaggtgtcttatgacatacgtatcttaaatttactgttaattttctggttagctttcttgttaatcaaattttaacttgatttttattttttgaagaggtaaaaagggatttataaataattaggtcacaaccaccaagca

SEQ ID NO: 6086 - DNA, 438 bp, Cicer arietinum
acacacatgtaaggagagtattgaagaagttgatgaacaaaacaagaaaatcacttacaagctatttggtggagatattgatgagcactataagatctttaaatttatcctcgaaatatttgataagaacgatggaagtgcagtagttaagtggagtgttgaatatgagaagatcaatgaggatattcatcctccaaatggctatattgaataccttaacaaatgcactagagagattgatgcttatcttgttaaagcataactccataagtcataaataaaataatcaataaggagtaataatggcttaatggtgttggctatgtggatacgagtgatcatttaataattagtgtgatataattgtaatggcatgtgttaacgttgcctaaagatatgcatatatgcattggctttgatcctttgtttctatgtatg

SEQ ID NO: 6087 - DNA, 257 bp, Cicer arietinum
cctccctactactacaaatcccctccaccaccaacgtcgtctcctccacctccttaccattatgtgagtcctcccccacctataaaatctcctccacctccataccactacacatcaccacctcctccatccccatctccggctcccacatacatttacaaatcacctccccctccagtgaaatcaccgccaccaccagtttacatttatgcttccccgccaccaccaatctacaagtaagctgggaattcgaaagt

SEQ ID NO: 6088 - DNA, 406 bp, Cicer arietinum
acgccacctagatagtctctagactccaccttcccatcagcaaagatgttactgccacttatctctcggagttttgctccgctcaatgatttctcggcagaggaaggcgggacatcgcccttaaatatgttatttccagaaagttctgcaaatttctggttaagaatcttctttgctgtcttaactggttctccagaattagcaccttgatctccatcagcattgctttcttcaatgcctatgctcccttgcaactccaatatgcgaggagttattggtcggggtttgatttctggtggtggagcaaatatgtcatgaccactaagctccttgcactttgcatcagaaagttgcttgttcaacttattgtcttcgctttccatagttccactgagctcacgttgct

SEQ ID NO: 6089 - DNA, 342 bp, Cicer arietinum
accataacataatcaaccaccaccaccagtatcaaatccatttcacaggacctctacaaggaagtgaacctcaaaaccctcgttgaaaaattcaagaaagcttgcgaaatcgaccgcttccgtaaaaaaaccggcatctacgaagacaccgtccgccgcctcgccggagctaaacggttccgatgggtccgtgacattatcgaacaccagaagaattactcagacatatccaatgaaggtttttcagcgcgactcatcacactatacgggaaatcaggaatgcacagacacgcacacaaactgtttgatgaaatgcctcagaaaaactgtgaccgtacctgc

SEQ ID NO: 6090 - DNA, 161 bp, Cicer arietinum
acactgcatgcaagtgtggccaccaattggcaagaagaagtttgagactccctcataccttccaccattgactgaagagcaattgctaaaggaagttgaataccttctaaggaagggatgggttccttgcttggaatttgagttggagaaaggatttgtgt

SEQ ID NO: 6091 - DNA, 379 bp, Cicer arietinum
gatcaaaatgatcgatcccctttgcggtaacgatcacactaataaagaaaatacattttacatttattcaccttaacaacaaacaaaagatccaaactcagctaaatataagtaattaaaatgttaccatgcaagaaagtaggtaggtagctactagctagttacaaagctcacgggcaattccaaccttattattgacggtatcaaacaaaaccctcaaattctgttgctgaaaattagcgatgacattcaacacagaattcacattacttggtgccgcagccatagcaagacaagccaacgaccccgaactgctacgaatcaaactattctccattggcagcgtcaaattcaaatccgtaaaacgcaacgtaattgc

SEQ ID NO: 6092 - DNA, 390 bp, Cicer arietinum
acattttaattacaattacaaacattttttaaaatgcatgcaaaaatcgaatactcatttttgatacaatatattgtttttattttattttatataatatgcatctcattttggtctcacttcaatgccttcaacaataagccctcccttcaactgataaccaagttctgtaagagtcatcttaatctcttcatcactctcaccactaaaaaactctccaatcccaatctccatccagccatctaatctcttagctggcacatgaatattccctctatcttcttgtgtttgaaccactctgtttcttctattcccataaaatagtgtctccatattacacttgttctcatctttattgcacaaatatgctttccctcttttcactttgtt

SEQ ID NO: 6093 - DNA, 359 bp, Cicer arietinum
actttgaataagaaataagccagttcacagaaggaaaatgcttcctctgagcaagctttttgtccaatccccagaaaacctgaactatgctgagggttgcagatgtcacgggatctgagaaatctcctccaggtggagaaacagcaccaacaattgttacactacctgtccgttcaggacctccaaggcattttactttcccggcacgttcatagaaagaggctaaacgtgcagcaaggtaagccggatatccactatctgcaggcatttccgccagtcttcctgagatttcacgcaatgcttctgcccatcgagatgttgaatctgccatcatactgacattgtaacccatatctcta

SEQ ID NO: 6094 - DNA, 374 bp, Cicer arietinum
gaggaagtaatattagattacgactatacatttacaacaccttattgtggaagtggcgctattgagatcgataaagatctgaatgggagaaagatttcggaggaaaccggcaatgtccattgggaagactgcaaggaacaaattgatttaattgcattggcatccaaagagcctatacttttctacgacgaggtggtgttgtatgaggatgaactcgccgataatggagtatcacttcttactgtaaaggtgagagtcatgccaagttcttggtttcttctcttgcaattctggcttagagttgatggagtgttgattcgactgagagaaactcgtatgcactatgtatttggtggaagcacaaatcctgttgt

SEQ ID NO: 6095 - DNA, 401 bp, Cicer arietinum
acaaaccaccggtagagaagccaccagtttacaaacctccagttgagaaaccaccgatttacaaaccaccagtagagaagccacctgtatacaaaccaccaattgagaaaccccctgtctacacaccacctgtagagaaacctccggtatacaagccaccaattgaagagcctccagtttataagcccccagttgagaaaccaccggtttacgggcctccatatgagaagccacctcactacccagggtatcctccatatgagaagccacctcaccacccagggtatcctcctgccgatgatgacaatcgtttctaaaacttgttatattaagaaaatgtgaaaaataagaggtatatatagttttcgaagcaaggattatatattattggcatcttcatt

SEQ ID NO: 6096 - DNA, 299 bp, Cicer arietinum
acgaccgcattatgccttacatcaaggatggtaaggacgagggtgctaccattgagaccggtggtgagcgcctcggcaacaagggttacttcatcaagcccactatcttctctaatgtccgccccgacatgaagatcatgcaggaggagatctttggccctgtctgcgccatttccaagttcaaggacaagaaggaggtcatcgaccttgcccactacaccgcctacggtcttgctgccgccgtccacaccaagaacctcaacacagctctccgagttttcaacgcattgaaggctggt

SEQ ID NO: 6097 - DNA, 404 bp, Cicer arietinum
acctcagctcatagatacttctatctttgtttgaagcaatcactctgagccaatctctaacattgtgcttcttcaagtatttctttgtcaaatacttcaaatatcgtttggaaaagttactgtcagaggtaacagtgatcttgctcttctcacgggtaacagtgacagaatcaccaagggcaccagctttgccaccgactttgatcctctcttgaagaaacttctcaagagatgcaatgtccatgatcttgtcttccactggcttagaacagtcaatggtgaatgttgcacccttcttctttcccttggctccagctgcaccacttcgactcattttctcttctcttttttgtaaacctccttccgattgaagagcagcggcgacaactgcagagagaacctgc

SEQ ID NO: 6098 - DNA, 405 bp, Cicer arietinum
acaaatcaccctcaaacgcccaaatgctgcaagtgaagaaaaacctgatcaaacacacctatagtttggtcaattcaacaatttccatcaaagataactcaaacctcacgagtttaaacttcttcacgtcaactccgaaaaaagtatcctcaaatcacctcttccattctgcttgaattacctttccatttccatctctagaagatgatacagctttgtcacttttgtggcccactttaccacctgactgagctggtctctgtgtcctaggagagtgcgaggtgattttgctgttagttaaagatggcaaagaatgtcgccgagcattgttgtttttctcacttccatcttgtccaaatcttggtgatccttgagccctcaattttgcctttgcagattcagttg

SEQ ID NO: 6099 - DNA, 153 bp, Cicer arietinum
attgaaatggaaaagacgaaaacgcccaaagggaccacttcattttgcactcctcaacattattcttcgggggaaattaattaacaccatagactcattgacaaataagtgatagatagaggtgaattaattaagcattgcttctgaaggatc

SEQ ID NO: 6100 - DNA, 394 bp, Cicer arietinum
tatacgagtcctataatcacattgtgaaacgagtcgcatgctcccttccgccatggaggaagcgggaattcgattagcgtggtcgcggccgaggtaccttgcttaccctaagagtggcgctgagcgtaaagacgctgctgaaagcactcttactgcttataaatctgctcaggacattgcaaactctgagctgcctccaactcacccaatcaggcttggtcttgctctgaacttttctgtgttttactatgagattctcaactctcccgatagggcttgcggtcttgcaaaacaggcttttgacgaggctatcgctgaattggatacattgggagaggaatcatataaggatagcactctaatcatgcaacttctccgtgataacctcaccctt

SEQ ID NO: 6101 - DNA, 424 bp, Cicer arietinum
acaacacccccagcagttatcaggtgaatgtggaatcaaagcccttaacagatattacaagtaaagataaaaacatttctgatgatgaagtgaacaacgaccctatagatttattagatactatttgcaaagatgaaaattctcacataacaaatggagatttaaatcacaaggaagatcaatcaggcagtgaaaatcagaaaccaagccgaaaagcctcaattgtagcaaagcaggaacgagcagagaatggtttgcacaatagtccgacaattccaagttatatggcagcaactgaatctgcaaaggcaaaattgagggctcaaggatcaccaagatttggacaagatggaagtgagaaaaacaacaatgctcggcgacattctttgccatctttaactaacagcaaaatcacctcgcactc

SEQ ID NO: 6102 - DNA, 402 bp, Cicer arietinum
acatgtagaaaagtatagtcatattttctacagggctaagaaagagaagatgacacagtccaactcaaagctccattatgccatgcctccactcgttgctgtcctgattatctgaaagagagatgatccaataacaacaaagacgaagaaaccaagcagcacggggccaacaggatagtcttttcctttcttaacagtggtttctggcacacttcctctttttgtgatgtttttctcaaacttctccaccttcctaactgcaaggcgtcttgatgtagtcatgtttgattgttgggatattagatcgcaggtggaagaaacgaggagatcgccggaaaattgaaagacggtggttgttcccttccggcagtgcctctcttcgacctttttatacctcggccg

SEQ ID NO: 6103 - DNA, 306 bp, Cicer arietinum
acttcccctgatgaaaagcttgagccaattctaactcactaggctgtcttgagccatcccctgcatatgttcctgaaccataaggtgaaccacctttcaccttctccatctcaaacatgccagctccaaatgtgtatccaactggcacaaatatcattccatggtgaacaagttgagtaatagatgtcaacggtgtagtctcttggccacctccttgagaaccagtgctgtaaaagatgccagcaggctttcctgcaagtgactgtttgttccataggcctccagttgcatccaaaaatgatttga

SEQ ID NO: 6104 - DNA, 171 bp, Cicer arietinum
acttcccctgatgaaaagcttgagccaattctaactcactaggctgtcttgagccatcccctgcatatgttcctgaaccataaggtgaaccacctttcaccttctccatctcaaacatgccagctccaaatgcgcatccaactggtacaaatatcattccatggcgaacaa

SEQ ID NO: 6105 - DNA, 232 bp, Cicer arietinum
aagtttcaacaacatctagaagaagaaaaccaaattacacaccaaacttgtattcccacagcagcagaaatatcaaatatcactattagctggcaacaatatgcgaaattgcaaagaaatcatctaatgcatcaaagagtgcaatacattcaaactaggctaacataataatagtagttttagaaaacaaacttatgtcctgcaacttgtttcctctcttgattttctaaaa

SEQ ID NO: 6106 - DNA, 403 bp, Cicer arietinum
acaatatgaaatttgagtgacaacaaacataaatagattaatgatccacaaatattgccagcaagatattgtatggatattttttatttatcttaaaatattaatataacaaaaataaatatgctctaagcagcaggatttgattggttggactcttgcagttttttccactgttctggggttacagctttctttacagagagtgcatgaatctctttcatttcctcctctaaggcagcattcaccattctatgcctttccaatagccttttcccttcaaattgttcaggcacaatctcaactacaaaacttgcaccacaccctccagatgtatccagtacttcgatatgggaagggttaagtttggagttcaaggatgactcgacttgttcctttgacctgc

SEQ ID NO: 6107 - DNA, 256 bp, Cicer arietinum
acataacaataggaacattaggaccatatgggtgacaaaaacaccctgctcttcttgcacacaaatgcaaaatgttgctattcacaaatgaaatacttgtttttttcccaactttgttttcatagttatcaaccctagcattgtttaaccttataacaaactcatgtgcatcaattaaagaaccatagtttctattaagcaaaattccactgttcccaacaacagcacatgatgaatacttcttatcaccccgcgt

SEQ ID NO: 6108 - DNA, 205 bp, Cicer arietinum
acagagtttatatcagaaaatgtgaaccatccatacaacggccaacaggatctctagggtctgtatcatcttgggataaaaaagactctacattttcctcgagagatccatcctccacaaagcgatccacatcagcctgcaattcaagatccttatcatcccacaactggtttgaagatgatgtaagagttccagtgccatcagt

SEQ ID NO: 6109 - DNA, 192 bp, Cicer arietinum
gccgaggtaccaaaggccgacgatgcttatctctctgctctggtattatgttttagccggatttttcccgcaatactaaatgctgctgttgatctcaatttgtttgatatcatagctaaaacacaaagttcacatggttcaagcttatatgcatctgaaattgcttctcagcttcctaatcaacaccctgaa

SEQ ID NO: 6110 - DNA, 349 bp, Cicer arietinum
actgtatccccattcgttgtcataccaagaaacaacctttacaaagttatcattcaaagcaattcctgccttggcatcaaatatactagacctgctatcaccaacaaagtcagtagataccacatcatcttcagtgtaacccaaaattcccttcaacttgccctctgattcctccttgatagcagccctgatttgttcataggttgctttcttctcaagccttacagtgaggtcaacaactgaaacatcgacggtagggactcggaaagacattccggtcaatttaccattcagttctggaagaacctttcctacagccttggcagctccagtgctgctgggaataata

SEQ ID NO: 6111 - DNA, 419 bp, Cicer arietinum
cacaaacaaccataggatctgactttgccaaacgtttgagaccttcaacaagcttgggaagatctgaagcaaccttgcactgaacagcaacacgcacaacaggtgagacagaaaatttcattgctcggataggatgagcatcaacttccttctcatttgtcaatgtagcattcttggtgatatattgatccaaaccaaccatagcaacagtgttaccacaaggcacatcttcaacggtctcctgtctctttcccatccaaatgacggttctctgaacacttttcacatacaagtctttcttttcaccagggacgtaatttggtcccataattctgactttcaaacctgttgaaaccttaccagcaaatacacgaccaaaagcaaaaaaccttcccttatcagatgcgggaatcatctta

SEQ ID NO: 6112 - DNA, 266 bp, Cicer arietinum
actgattaattcattattcacaaagaaccataaaattcataacatcgtaaacttattctactgggccaacacaggccctatcacttccacaacaagtaaaagaaacatcacacagatattaatcccacagccacagattagaaaccaccacgaagacggagcacaaggctgaagggtggactccttctgaatattgcaatcaggaagggtccttccatcctccaactgcttccctgcaaagatccacctctgctggaccggaggga

SEQ ID NO: 6113 - DNA, 204 bp, Cicer arietinum
actactatttccccatgcaccaatcaagaattgctagagaaaaattctaatagtattcatcactcaaactttggtaatattaacacaagcatagatctaagaggtcaaagcttattttctaatgatgatcaatcacaaccattggattggtttagtgaaagctataatagtaacattaattataagatcaaggaggatgatcaa

SEQ ID NO: 6114 - DNA, 200 bp, Cicer arietinum
acgaatacgaaccgtgaaagcgtggcctatcgatcctttagtccttcggaatttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcaccc

SEQ ID NO: 6115 - DNA, 391 bp, Cicer arietinum
actttgctaccaaatcgttcatgttactctctgcctctgtgaactccatctcatccattccttctccagtgtaccaatgcaagaaggctttgcgccggaacatggcagtgaattgctcactcaccctcctaaacatctcctgaattgaagttgagttcccaataaaagtggaagacatcttcaagttcttgggtggaatgtcacacacactagacttcacattgttgggaatccattcaacaaaatatgaagaattcttgttctgcacattgattatttgttcatccacctctttggtgctcatctttcctctgaacattgcagatgcagtcaagtatcggccatgtcggggatcagcagcacacatcatatttttggcgtccccccgcgt

SEQ ID NO: 6116 - DNA, 359 bp, Cicer arietinum; identical to SEQ ID NO: 648

SEQ ID NO: 6117 - DNA, 173 bp, Cicer arietinum; identical to SEQ ID NO: 915

SEQ ID NO: 6118 - DNA, 433 bp, Cicer arietinum
acgcggggagtggcaaaaacagaaaaataaataaacgagaatgttaaacaattaacaacgttaaagccaaacataacttcaaactctcaatcctaatcctccatttaaattgcttcgtctccaagcctgattccgaagctccggttcgaaatggagttcgagttgttttgaaactgaaccggaccggttctattaagcgagatcacggggtttgggttagaaaattttattgacggcggtgatgagagggagctgttggttgaaccgtcggattgaacagaggtttcgtttacttgcgatctccaccgttaaatcagtgaagatcaagcttcttctttgttgttgtgttgctttaacgcttctcgcgttttccacaagtggttccactttcttattatggaataatcaaacttcttctcttcgtcgtttccct

SEQ ID NO: 6119 - DNA, 153 bp, Cicer arietinum
gcagaacctccactatgaaatggagattataaaaacatttgttactcttaaatgctgctttaaaaccaaatgttttggcttaagtaattatcgagcttccgttaagtataatataaagtaacagaaaaaatggaaactaacaaataaataggt

SEQ ID NO: 6120 - DNA, 327 bp, Cicer arietinum
accctcagtgcagccctcaaagtctttcaaaggctgttccgaatttggaagaggctggtctggatctgctctctcaaatgttgcaatatgaaccttcaaagcggatttctgcaaagaaagctatggaacatccttactttgatggcctggacaagaccaatctttaggttacaaaatgatgatttggatgtaggaattcttatcatgcttctctcgagcgcgaatcaatatctgtttttaggatgattaacttttcccgtctgattttcccattacttgatactgtggattatagagatctggattttagtctcttaaaaatacctt

SEQ ID NO: 6121 - DNA, 406 bp, Cicer arietinum
acaatggccagttgtggaagttgagaagctaagagtaaatcttgtcaacttgccccccaaagttctcaagggaggtgaattgctgcaaattaacggtgtcacagcagcacaagctgatgttgaaatttcatttgaagtgaataacattggagaggctgaagttttggacaattggacagaccctcaaattctgtgtagccaaaaggtttcatcagtaaaaagtggtttgggaccctttggtctattagtttttgcttcaaaggggttgcaagagttcacatcagtgttctttagaatattcagataccaacacaaaaatttggtgctcttttgcagtgaccaaagcaggtcttccttgaataaagataatgacatgaccacttatgggacttttatagacgtggat

SEQ ID NO: 6122 - DNA, 434 bp, Cicer arietinum
acgcgggggtgattgacgaaagaagaaagaagaaaaataaaggtaaggaaagagaaaagaagcatgaagctaagcacaataggcaatagcatattgataaaataaagcgagagcagagaaagaaagaggtaggcatggaggaagaaaaggaagcgttagtgggagaaagagaaagggaaagggaaatagttgaatcaaaatcaattaagaaggtagagatccacctatttcgccagggtgaaggacccattgcgatattcaaatcggagcttggtggctcggaacatagtcagttagatgtccgtcaaatcctccgcaaccactccctcaaatctatattcgctttcaaccctcgatctggccgcgccgcccccatccgcttcaacaccaaaaccggaaattccgtcttgtcttaccgaaacggcgccgttctc

SEQ ID NO: 6123 - DNA, 404 bp, Cicer arietinum
accttctctgacttaagtggtttcacaacctcccatgtgaaatcagcatcatctctaccaaaatgtccataagcagcagtcttcaaaaaccttttatttccacctcttaaaagatcaaggttaatagagatcattccaggcctaaaatcaaaattctccttcacaatctgaagaatttccttatcaggtatctttccagttccataagaatcaacaaagacagacaaaggctctggaacaccaatagcataagaaacttgcacaagacatctcctagcaagtgcactagcaactatactctttgcagcttgtctcacaatgtaagcaccactcctatcaacttttgttggatcttttcctgagaatgcaccaccaccatgtgcaccccatcctccgtatgtatc

SEQ ID NO: 6124 - DNA, 261 bp, Cicer arietinum
actggtgatgataaaatcagcattattcatggctattaggtcagcagtgaactgacatgaaaaatggtatttatcctcaaattttttccaatatatatctgaatctggatattttgtcttctccagtgcatgggcgattgtgcactgggtaactcccattttgtaagccaataaagatgcaacgagattcccgtcactgtagtttcctatgatgaaatcaggataaccttgcaactcagcagcaatttcactagcccgcgt

SEQ ID NO: 6125 - DNA, 110 bp, Cicer arietinum
acaaatcaagagctaccgacagccaaatagcatcatcatcaataataacaccaattactactttttggtgctgcttgattttcactatttatccttcagttcacaaaaca

SEQ ID NO: 6126 - DNA, 202 bp, Cicer arietinum
accgtgagatttacttacttgataagtctgtttacgaccggacgagttttacacatggcctttaatggaattaattttgtcaaaacaaatccatctcgttctgccatatcaatcatgtcatcacttgtacctgtgtagctatctgtgaaagtggaaaagatgcaattgaaaccgcatattgcaagaagaattgaacttaggt

SEQ ID NO: 6127 - DNA, 236 bp, Cicer arietinum
actacacttatccaatcatcaaaggcctcgctttggctatgctccttgccggaaccgactcatctgctgtaacattagagtggtcaatgtgtaatttaatgaaccatccagagatattgaagaaggtaaaggatgaattggatattcatgtaggacaagatcgtttggtagatgaatcagaccttccaaaacttacttatcttaaaaatgtcatctatgagacgcttcggttgtgt

SEQ ID NO: 6128 - DNA, 129 bp, Cicer arietinum
accttctcatctacatagttcccatgtttgtagtttagacatcaccacattcacattttcttaaaatagaaagagaaaaaaaagagttaattaacccaaaatgccccccaaaaaagttaaaaggtaatt

SEQ ID NO: 6129 - DNA, 442 bp, Cicer arietinum
acgcgggggtgattgaagaaagaagaaagaagaaaaataaaggtaaggaaagagaaaagaagcatgaagctaagcacaataggcaatagcatattgataaaataaagcgagagcagagaaagaaagaggtaggcatggaggaagaaaaggaagcgttagtgggagaaagagaaagggaaagggaaatagttgaatcaaaatcaattaagaaggtagagatccacctatttcgccagggtgaaggacccattgcgatattcaaatcggagcttggtggctcggaacatagtcagttagatgtccgtcaaatcctccgcaaccactccctcaaatctatattcgctttcaaccctcgatctggccgcgccgcccccatccgcttcaacaccaaaaccggaaattccgtcttgtcttaccgaaacggcgccgttctctacatcga

SEQ ID NO: 6130 - DNA, 423 bp, Cicer arietinum
accactcttaccaatttggacctaaccactcctgatacatttgactctgcctactattccaatcttaaaattcaaaagggattgtttcagagtgaccaagagttgttttcaaccagtggtgcagacactattgacattgtcaatagtttcaatgacaaccaaactcttttctttgcaaactttaaggcctctatgattaaaatgggtaatattaatgtgttaactggatctcaaggagaaattagacaacaatgtaactttattaatggaaactctgttgaccttgctactactgtgactagagagtcgtcagaagatggcatcgttagttcatactaagtaatttaattagcaaaagtaaggaacctaataaagattaaagagtgtggtctatcttctagaggcatatacatgccctgttct

SEQ ID NO: 6131 - DNA, 404 bp, Cicer arietinum
acttgaactgatgagataatccaatatccagcaccacatggttcaataggaatgattctctgtccatatccattgtcacgaagaagataaatggaaaagaaagagaaccacactaaaagtaaggccaataacttcaaccacggaatactcatcaatttgctattctctttagggaccataacaatgatttttggtccatcattttccttaagcattctcaccaaccctttactttcctcttcactagttccattttctagcagccctttttcaagtccattttgcctcatctcttctgattcaatattccaaaacattactccacttttgcaagtttttgaggtagaccaagcaagaaatatagcaaacattaaagttatcaaccattctggaaaaacaaggtt

SEQ ID NO: 6132 - DNA, 242 bp, Cicer arietinum
acgcattcaagggatagaaccgagtttggaaatacctttttcttgggtagttaacaacttaatgaatcctgagtatttccttcacatgtgtgtttgcttgaaagtttcagaagccagtgctgtgtagttgggatgaatttaattgtttttagccttctattttacttaaaaaaacaagatgcaagcaattcttttgtatataaatgcacgcgggggatacgaaaagatggacaaactaatga

SEQ ID NO: 6133 - DNA, 91 bp, Cicer arietinum
aagtcgaggggcgcagagcccacggttatttacaccttgtcatttttcattaagagcaaaaattctctaccctagcaaagcgctaacagcg

SEQ ID NO: 6134 - DNA, 245 bp, Cicer arietinum
gacccaaaacattccacattaattttattcagctacggttcagtgtcaacttctagttctagcagaacagatacaatgactgaaaacggagacaaaaatgtaattatcaagctgcagctgcttcctcgttgagcaacatctgatcaaagtgccagacaccgtgtcctttgccaactcttctaagctgagcgacaaactctgagatttttttgatggcttccacctgttcacccaaaaactcactt

SEQ ID NO: 6135 - DNA, 377 bp, Cicer arietinum
ggtaattccatatttttataagacttaatattaattatcaacactaatgaccattaaacagttacactttgacgagagaaaattaacagtttttcacacttctgcaagggaaaaacactaattattccctttcatttatccctagcccccaagacaaacacagacgcatttgacactagaaaccgaggatccatatataatatgatataaggtttgatcatgcctttccctcatgtttacttattaagatgaggaaaacaaacaaggacgtcagatttagggtgtttagcttcagcatgctccctgcacttcacctctgatgtggtgcagataaatgtttgcatgcacaccttgcactggatcgacatggctttctt

SEQ ID NO: 6136 - DNA, 374 bp, Cicer arietinum
gaaaactcacattttcatttttatttgttatacacttcgaacatatttcttgtaatcatgaaaagtaaatattatacacttgaatgacaaaaatgccacaacatagattaatcaatcaaaatcagttatgcatttttgtgttattctacacttaattaaaagctgaacatatcttgcggatttcaccatctgaaccagtcttcactccaatattgctcattttcaccattgatcttccaaattcaacattaaatgttaatccaagtaaccctcttaaacccaaatatctctgcacaaatatctttgtagaaggatcattccaaagtgcttgatcagattgaagaattccacgcccgttccttagattagcatag

SEQ ID NO: 6137 - DNA, 372 bp, Cicer arietinum
  misc_feature (4)..(4): n is a, c, g, or t
cagnacaaccaatgatatgtttcactatttatagataaaataccaaaggcaagttacttatgtatctaaatttttgtctgtatacgtactataatatcatccttaacaactatacaactctgcaagaacatgttcatagtacaagtttttcatatattaggtaacagaagcatcactccacttacatcaataaatataaggatggccaattctttcagaagagatcttgtttcagccagctcacattaaaccatctcctagtttcttatttacttcaacccttaacctttcttctttagctcccctgcttaccttcagaagcaagttaaacttgacataatcttcaatgaccttggtcttggctcgaacaat

SEQ ID NO: 6138 - DNA, 260 bp, Cicer arietinum
acgcgggggtgattttaccaagaagaaagaagaaaaataaaggtaaggaaagagaaaagaagcatgaagctaagcacaataggcaatagcatattgataaaataaagcgagagcagagaaagaaagaggtaggcatggaggaagaaaaggaagcgttagtgggagaaagagaaagggaaagggaaatagttgaatcaaaatcaattaagaaggtagagatcctcttatttcgccagggtgaaggacccattgcgatattc

SEQ ID NO: 6139 - DNA, 346 bp, Cicer arietinum
tagcgtggtcgaggccgaggtacgacaagaagaaattcatcaaaccacacggctaactaatggtcacccattacatagaataaatgtatcacagagacaatgacacatatactaaacatatgtatcaggaaaagaattatattacaacatgtccatgtatcagttaaggaggagactgtgaaaccacccaaccaaaccaatggctcccctgagaggaagtatccagagaggacaaccaaacaagtagaactctagttccctccgtccaaataacgaaacactacacatagtaacacagagtcagacacggggtccaacaatcaaatccgatgtctcctattttcct

SEQ ID NO: 6140 - DNA, 168 bp, Cicer arietinum
  misc_feature (117)..(117): n is a, c, g, or t
actcatgtcaccattatcacttgagttaaattattataatttcatttaaaaaataaaaatcttaatttagctcaacgttctgctaccccatttaattataattaagctttaattatnaaataatatggacaaggtttcggcatattgtttaaatcccataaaattttc

SEQ ID NO: 6141 - DNA, 381 bp, Cicer arietinum
acgacaagaagaaattcatcaaaccacacggctaactaatggtcacccattacatagaataaatgtatcacagagacaatgacacatatactaaacatatgtatcaggaaaagaattatattacaacatgtccatgtatcagttaaggaggagactgtgaaaccacccaaccaaaccaatggctcccctgagaggaagtatccagagaggacaaccaaacaagtagaactctagttccctccgtccaaataacgaaacactacacatagcaacacagagtcagacacggggcccaacaatcaaatccgatgtctcctattttccttccctaaattccggtttctgtgcagaaagaccctactgctttttattttagactcc

SEQ ID NO: 6142 - DNA, 379 bp, Cicer arietinum
actactattactccatgcaccaatcaagaattgctagagaaaaattctaatagtattcatcactcaaactttggtaatattaacacaagcatagatctaagaggtcaaagcttattttctaatgatgatcaatcacaaccattggattggtttagtgaaagctataatagtaacattaattataagatcaaggaggatgatcaaagagttgaaattagtgaaaccagtataaaaggttcagatgaaactatgtctccaaagattatatgtagtcatgacgataatataaacctaaaatttggtccgtcttatatttgggtcggccctgattgtgaagatgatatagtcgaattggatgcgacagatttattggctaagt

SEQ ID NO: 6143 - DNA, 384 bp, Cicer arietinum
gaactgtcaatacactcttgtataataaaagaaacgacaaaggaatccgataaataatagtaatcaacttggtttcacgaaacaaaataaatcacatcccaaaacagcttcagctaagcttgatatttgtaagatactagtacatcctccattacattcggtaaatcaaaaactgaaatagaaaagatccttaataaaaaactagcctagtagaagaatccaaggaccttaccaccaacattctttctcctggcctcttcatgatccataatgccagctgaggtagtcaagacaatatacccaaactgtcttgaagggagaagcctggcagtccaaccttcaatctccttaacaccaacatcaaaacgtggactaataacacca

SEQ ID NO: 6144 - DNA, 405 bp, Cicer arietinum
actaccaaaaaagcatactaaaaagcaaatataatttcatataaaataattatatgtatagaattaataataaaaccttaggacatatctaagctcaacaaatcatattgaaggtgttggcttaacggttccaccaaggatcttgaaagaaactcactataatcagccttcaaaaaggtatgttgatgcaaattatagtcttgaggcatatgattagttgaagaagcacccttatccaatattctctcatctataacacaatctttttcttccaagggcatagtcgtaatttccgcaacattagagtcttggccagttagctcttgcacaagagctctaaaatttgaagcattagtcttcaccttcacgggacttgaaatatatgttactttgatctctttttta

SEQ ID NO: 6145 - DNA, 384 bp, Cicer arietinum
gtagcaaatatacttacggcatagtctcgagtcttattaaatatatgaatagaacatgagatcgatcaaactgtttaattgcaatgacataccaccgcaacacatgatcgagaaaggaaattagataatagtgcgcctagcaaatatttagcgttttcacagaacgtttcgccaacgtaacccatataacatctgacatattaactaaacctactctccattgattaaatccataacaactcgtttaatgcttccattgtttttctttagcagcctcttgttcatctctttgccacggaaacccatctcatgcaactcttcaaggataggatcccactcagaaacaccacatagatgcctactgactgctccagattgtacctc

SEQ ID NO: 6146 - DNA, 258 bp, Cicer arietinum; identical to SEQ ID NO: 637

SEQ ID NO: 6147 - DNA, 258 bp, Cicer arietinum; identical to SEQ ID NO: 637

SEQ ID NO: 6148 - DNA, 402 bp, Cicer arietinum
acatgaccacttctgattccctttctaggctctggtgcagttccatcaaacctgccaatggataaaattggtgtccaaaattaagaaacacatttgtcatgaactagggtgaaaaagtgtaaagcccttgtttgcatttatttttagtgttccaagccattttttatttttttttaattaatatttgacctgcttttggcattagaagcattatagggtttgacttttcattgatggttcacctaaagaacacctacataaccggtttctaactatgacccaaacggatcgagattctctacagttaagtccttctgcatttaatcaaaaatttatcaagagaaaattgtgtacttcgagcacagaggatctcacagttgcttggttctgaagctcctctgg

SEQ ID NO: 6149 - DNA, 358 bp, Cicer arietinum
actcaggaccactcagttcccgaatcttagaccctcgaattaacttttcaaatgggcctgaaatgatgtctctgtagaaatcaagggtctggagcaactgttgagaggttttacccttccatttagtggcaagtgaagccactgctatgtcttctaaatagactccaatggcagtgaacttgacgaagttaccctcaatagtcaaacctctctcccctgcgccaccgaggaaataggacttggcggttgccggagatgtgaccaccggcggaaattcaagaaactcaaccttcatcccagtgatggatgctgccgtcgtcatagctacaccactttgcgtcaaattgatcgagctagt

SEQ ID NO: 6150 - DNA, 404 bp, Cicer arietinum; identical to SEQ ID NO: 4965

SEQ ID NO: 6151 - DNA, 394 bp, Cicer arietinum
acaaaagatcaaatgagtaatctttgactttggttgacccccccgcgtactactattctttggatccttcttcttcttcttcttcttcaagatttcatcactgttcattttgttccttgttctgacttgtgatcgttaattggtataacaaaatgtggaagaggatggaatttcaagaagaagcggttcaattgataaactcagatttcagagacttgagtctagctgctaatcaactcgctaatcatctcgtccaactcggtcgctttggctttggagcttctttcttcggattctttgccgccattgctgctatctatttgctggctttggatcgcacaaactggaagactaacattcttacatcactactcattccatacattttcttcag

SEQ ID NO: 6152 - DNA, 350 bp, Cicer arietinum
acttggattagcaggctatctttcaccttaacccttctgaccgatttgtcattggaggtccccatggtgatgccggtctgaccggaagaaagattatcattgacacttatggtggatggggtgctcacggtggaggtgccttttcagggaaggacccaactaaggttgacagaagtggtgcctatattgtaaggcaggcagccaagagtattgtgtctaacggtcttgctcgcagatgcattgttcaagtttcttgcgctatcggtgtgcctgaacctttgtcggtctttgttgacagttatggaactggaaagattcctgataaggagattcttcaaattgtgaaggag

SEQ ID NO: 6153 - DNA, 403 bp, Cicer arietinum
accgctttggctgcatgtgcacatccattcttcaatgatctgcgagacccaaatgttagcttgccaaacgggcaaccactacctcctttgttcaacttcacgcctcaagaactggtaaatgcgcccgaagagctgcgtaaacgcctcatccctgagcatgcaaggagttaaaatgattcagtcattgaaacatctataaaagggcattgtaaatgggttttgaattaatagaatgccatcacagccttcacagttatgactatacaactaaggatgtttaaacaccttgcaacctctttgatgggaccatgtgaagataatcaagacatgaaggtcatataacatacgatactcgttagtgtttgaattgcaaactctttgtatgcattggttctcaaagtta

SEQ ID NO: 6154 - DNA, 406 bp, Cicer arietinum
acaagagtcctcttcgatgccgaagaagccgaaagtggcttcacccttaattcctcaagttgatccctattcatatacaacacaccttgtccatcggcatcagttaaaaccaaattatccaaagtcttatgctccgaaattatcggttgcaacaagtaatgccttgcagatgcagcaatcagagaactaattgtccaaactaccctcaatttcaaaccaccgtttgtgtaaaacgaatcgggtatgcttccattatcatcaacaccgccattgttaccaccgccagcaataacaccacaagaagcatccacaacaacaccatcctgcgatttggggtgaaaaatagaggaagcgcctagaattacacaattatcaagagttgatccaaaatcagctctccatttca

SEQ ID NO: 6155 - DNA, 404 bp, Cicer arietinum; identical to SEQ ID NO: 1198

SEQ ID NO: 6156 - DNA, 377 bp, Cicer arietinum
agatataattactccacccacatttgcaataaaattttgaacataactaaactagtaggaatataaaattaaaatgcaaacaatagttgccattgttttgcctaaactaaaagtagctagcaacaataatatccatagttgagataatgaaaacgtgttgagtattttgaacataacaatacctaaaataataataaaattttagcgtcgttgagtctttccattggatcgctttccagaataaatgtgcttaggtttgagattaggtataactctatcagcttctccgcgacgtgcttccttgtttctcttcttacaagatttccttgcaagcttgattgccttaatcttttgagcagaatctcttaaaccttcac

SEQ ID NO: 6157 - DNA, 434 bp, Cicer arietinum
  misc_feature (374)..(374): n is a, c, g, or t
acattagtgatgcgtttccttgcttacgtggcacaatatttgaatatggaatggattcagcttttgcttctcataagacaaatgaagcttatcttttcaagggagaatattatgcacgtatcaattttacacctggatcaacaaatgataccattatgggtggtgtgaagaaaactcttgactattggccatctcttcgtggcataatacctcaaaataattaatcttggggttcatggttatgatcatcgtgctggaaaagctgcacaagattaattataaccttttaaaataataatatcataattaagagaataaataaagaatgttgttgttgatgtttgcttttcgctagttaataattaatgtaatanatgtgtgctgtaatatatatgtggtcgcggtttgcttgggttcttaatgaaataaaagta

SEQ ID NO: 6158 - DNA, 438 bp, Cicer arietinum
accatacaaggaagagacctgaaccattaacactggaagaagagagtgatcttgaacttgctaataagagattccttgagctatgtcaaaagtgtgttcaagccaatattcctttgttggttgatgcagagcatacatcagttcaacctgcaattgattattttacttactcatctgctatattgcataacaaaggtgaaaaccctattgtgtttggaaccattcagacttatttgaaggatgctaaggagaggttgatcttggcatcaaaggctgctgataaaatgggtattccaatgggatttaaattggtgagaggtgcttatatgtctagtgaaaggaaattggctgctgaattggggtatgcttcaccaattcataaaactattaaggacactcataagtgtttcaatgattgttcttcttttatgcttgaga

SEQ ID NO: 6159 - DNA, 336 bp, Cicer arietinum
tgactttagctttgaggattatttaaatgatcctcgcgaatcagagactttgcgaccattggacatgcataatgggatggaagttcgccttggtctatcgaaggggccagtctgcccaagttttatataaggaaatgactcaaggaacctgcatgttttttcatttaaacttcttgttgtattttcttacgttaatcagtatacagatttttagttccggatttgtgacctggacttttttttccacgcttagaatgcctttttgatttatggaattgatcaattaaaattcccagtttcaatttcttttcaatttttaaaaagaaaattgcatgg

SEQ ID NO: 6160 - DNA, 402 bp, Cicer arietinum
acgataaacatcataataataagataacaatatccccttctatcacatattgacagcaatgttcaatagattttctacttcatcacagagaagctaacagcagcgatatgcttttagcaagcacttattctttggctgagaacatttatcgctatcactaacttctagagcatcgcacgccccatcaaatacaaaaagttaagtgaacgacacaaaaaaaatgaagttactaaagggcaataatagtaagtttacaggagcaatggcacaacacatattcccctcacagacaatctctgcagtaaattataaatattcttggtgaaacgaaacaatacaaccaaattcttcaaacagcaacttgtccaaagagctccttgcggatgtgtgggagtttattac

SEQ ID NO: 6161 - DNA, 404 bp, Cicer arietinum
accgatacacacaattacacatattggttccaatatctctgcctcaagctttcatttgctatatgcacctcacttgcagttgcaagggtcacatgtgcagcttgatccacacttgcagccaccatcttcagctgcaacactcatttcagctccctcgaactgaatcttcgtcggaccaacgcccaaaaccaccgtctctgtggtttcgccgccttcggcatagttcaatccactagacctcttgttgcatctgtgaagcaataaaaattaacatccacacacacaatttgaaatataaaacttgaattagagaaaataatttatttatcaatagctattagaattaaaaaaaatatatatttttcattttctttaattttcgtcaaagttagacctcggacgcg

SEQ ID NO: 6162 - DNA, 385 bp, Cicer arietinum
  misc_feature (339)..(339): n is a, c, g, or t
  misc_feature (341)..(341): n is a, c, g, or t
accgatacacacaattacacatattggttccaatatctctgcctcaagctttcatttgctatatgcacctcacttgcagttgcaagggtcacatgtgcagcttgatccacacttgcagccaccatcttcagctgcaacactcatttcagctccctcgaactgaatcttcgtcggaccaacgcccaaaaccaccgtctctgtggtttcgccgccttcggcatagttcaatccactagacctcttgttgcatctgtgaagcaataaaaattaacatccacacacacaatttgaaatataaaacttgaattagagaaaataatttatttatcaatagctatnanaattaaaaaaaatatatatttttcattttctttaattttcgtca

SEQ ID NO: 6163 - DNA, 404 bp, Cicer arietinum
acggaaagggtagcggtcgttagattgactgtctgccttgggaggaccattgtataggagatcatggattttggaatacatcagcattgaggaggggtcaccactgctctgtgataaccgagaactctcctgcaatttgattttctcatacagatattgcttttcagcctcagcctcacttaattttgtttcaaatagttgctagtatattcttcctccgatttatcagatttggcaagagcaatcctctggagcctctcagcctcccgtttggcctcattagccttcaactgaaacatatcagcctctgcatttttaagccttacaattctctccagttcttcaatctgtgacttcttttcttgcctctccatcttgagttctcctgcttctctggccttgtc

SEQ ID NO: 6164 - DNA, 405 bp, Cicer arietinum
actaatttgtctagaaaaagacaacaaaagcctactgattgagagcagaagcaatagtagccaaaacagcaacatagtagccaaaacatttttcatttgagtagggtccaaaatccaaaacatggccaggcaaatttgacaccttattgtaagttacaacaccctgccagaaatttcaaccgaatatccctgtctcaaaatctacccttcttatttgttgctgccagaaaattctaaaaataaaactaaaaagccctcgcctatctgatcaacaaccttagtcaaagcaagagataataaaaccaaaactaagtgatgctatcactttgatggattagtctggttgctattctccaaagcctcttccaccttctcatctaatccaacctccaattttgacacctt

SEQ ID NO: 6165 - DNA, 292 bp, Cicer arietinum
acgtgatggttttcggcaagtgacatacactctctttgatagagattttgatgagagtgagtgtcaattgccacaaagatgtggaaaatttgggctttgtgaggaaaatcaatgtgttggttgtccattagaaaatggaatatttgggtggagcaataaatgtagtgctaagcctatagcaacatgcaaagaaagtgaatttcattactacaaaattgaaggagttgagcattatatgagcaaatacactaatggtgatagtgtaagtgaagctaattgtggaaataaatgt

SEQ ID NO: 6166 - DNA, 288 bp, Cicer arietinum
cccctaggaaatgggatacatttatcatgagaatctgagcaagataaattaaacaaacaccaaatcaaacggaataacaagaagttaaccatccatgcacgtattcaatgaagaagcaaacaaataattaagaagcaaaattaaataggttgatatataatgtgcactcgccgcgcgtgcatgacgaatttaagggttttggaagtcacgtggagcttgtcttgaacaaacattgataagcaagctaagtgagataggaaggttgagatttatccctaaaatgttagc

SEQ ID NO: 6167 - DNA, 362 bp, Cicer arietinum
acattcatgcctaaacaattcctaaatgtaacagtctgatcaggaaattctggtgctacacacgttcatacactatatcagtaacaactgataacagctcctgtgagactcacaggctaccactgcactaacagaacttccaacggttgttgcagttaacacaagtgacataagttgtcataggttcatcagcactgcgagtctgcatttggtaataggtggttttcctttgaccacaccgaccacacttaaactgatcagttgtagctttgggctgacctccacgctcacagtcaaacaaagccttctccttgattttctcaatctcctgcttcctttgctcactagccatttctgttgag

SEQ ID NO: 6168 - DNA, 406 bp, Cicer arietinum
actgtatccccattcgttgtcataccaagaaacaacctttacaaagttatcattcaaagcaattcctgccctggcatcaaatatactagacctgctatcaccaacaaagtcagtagataccacatcatcttcagtgtaacccaaaattcccttcaacttgccctctgattcctccttgatagcagccttgatttgttcataggttgctttcttctcaagccttacagtgaggtcaacaactgaaacatcgacggtagggactcggaaagacattccggtcaatttaccattcagttctggaagaacctttcctacagccttggcagctccagtgctgctgggaataatattgaaggaagcagctcttccacctctccagtccttgcttgatggaccgtcaacagtc

SEQ ID NO: 6169 - DNA, 108 bp, Cicer arietinum
cagaatcaaacgagcttttacccttttgttccacacgagatttctgttctcggtgagctcatcttaggacacctgcgttatcttttaacagatgtgccgccccaacca

SEQ ID NO: 6170 - DNA, 406 bp, Cicer arietinum
acaacaaatatctgtatgtcaactagatattgcgtttactcatccaatacaatgactccagcatcagaattctgtgcgttctcattcaactcggcatcactactttcatccatctctataacgccttcctttttctccgtcggtgtaggatcagaatctgttaccatatctttagtcccatcctctgctgaagaatcaagtttgcagtcattttgatgggtaggcagcgatttggaccccaaaacttcaccgtgctctactgtgggtgttagaattctgttgatatcttgacaaatgatttcgaaggacggtaacttcttcactgcattgacctcttccggttctcttgccaacgtggggttttcctcaactaccttgcacatctcattgtaaaggtcaactaatt

SEQ ID NO: 6171 - DNA, 406 bp, Cicer arietinum
actactgattgagcctttactgagcaccacctcatttgctccttccaccctgccaaagtcatgaccattgagataaaatgtggttacacagctaatgaaacacctctcctccaacagacattcttccccaaaagaagttcaagacagatcttcgacttttgttccattattactgttaagtgcttctagcggcacagaaaaatgtggctccaactcaagagcctccttataagccttcttagcttcctcttccattttctttccttcatagcactctcccaacgcagaccaagctttcgcgttcttaggactcaaaataaccgactcagtcaaatccttcagcgccgagtcaactcgtccgcgttcactcgtcgcgagtttcaactcggctctcttataaagcgcg

SEQ ID NO: 6172 - DNA, 219 bp, Cicer arietinum
ggattttattaaactaattttgattgaattattgtctcagtcttgaaattcaagaagacaattattttatacatttgagctcgaaatatttacattatttcttggcactatattaattcatttaagttctaagaagacatatttcttctttgacacaccccctcattctaaaagacatgacaaagttgaagccattggcattattagctatcatcttgt

SEQ ID NO: 6173 - DNA, 274 bp, Cicer arietinum
ttacgagagttacccttgattcgcacaattggtcatcgcgcttggttgaaaagccagtggcgcgaagctaccgtgcgttggattatgactgaacgcctctaagtcagaatccgggctagaagcgatgcgtgtgcccgtcgttcgcttgccgaccagcagtagggggccttggccccccagaggcacgtgtcgttggtggacctcgtaaggcggatgattcttgcgggacaccttgaaacgcaattcctattgagcggcgggtagaatcttttgc

SEQ ID NO: 6174 - DNA, 405 bp, Cicer arietinum; identical to SEQ ID NO: 2386

SEQ ID NO: 6175 - DNA, 348 bp, Cicer arietinum
acatctgaaaatagcttaaaatggggtgtataatcttctcttttcatctggctacaattgtaattgtaatataaacagtttataattaatcatctcctcactctcacccaaatgttaatatgaaattcatatgcaagtatgtcttatatgaatccccatggaactcaggtcaccgtgagaagaacttgactagtatctgagatttacaaaggaggaaggcgtccgagctaggtaggtatgagcgccaatatctgatttcttatgatacccatgtatttctgtatctcaccatatattggaagattctttgaacaaaatggctgcaaactggtgacagcagaatctagt

SEQ ID NO: 6176 - DNA, 406 bp, Cicer arietinum
cgttcttcataataaataaatgtcggagaatgacgtttatttattatgaagaacgattggaaggacaattatgagaatcagggctatcaaaattgccaatacaatcagctttatcttcatgttttgcatccacatttttctccggattttggtccccgaattcctgaagtcttgtgcctggtgatgaaggttctcagttttgtcgaccagaagctctatcttttcccccctgtccaggaccttttcaatattctccatcatgacacctttgacttcagaaacctgagctttgacctttgcaagcttgcttatctcctcaggatgatcaacacagtactgcatatgttccttcaatttaggcccaaattctttgttaaggctgttaggagcagctgtagatgccttc

SEQ ID NO: 6177 - DNA, 270 bp, Cicer arietinum
accaacagataaccccattccacgataagagtataaaatatttgcaagtaacttagaggctcctgttactgaaattcttcttttatttgccaactcatgcaagcgacacttgatcccaagatttctatgccaaaattggcaatcagcagcacctccagccattgtcccaagcatgtatggattgatttcaataattttcttaacagactgtgatgatatatatcctcccatactagttcgagaatcagcagctaccataacaccctcctt

SEQ ID NO: 6178 - DNA, 404 bp, Cicer arietinum
accaggcctctgcatttcttcgaacacatgtccacgtttctgattaagaacactgtagataccaccaagagcttgctcaggagcttggatttccacaaggtaaacaggctcaagaagcctaggtttggctgtcagctgtgaggcatagaacactctcctggcagtaggaatgatctgaccacctcctctatggatagcatcagtgtggaggacaacatcacacacttcaaaacaaatggctctcatgttttcttctgctaaagcaccttctttagatgcccactgaaatccagcaacaacagaatccttgatttcattcaaatactggactcccttacacatatcaaccaccatgttgggtccagtggtctcaggtccaaaacaccaaatcttcttagcaagat

SEQ ID NO: 6179 - DNA, 433 bp, Cicer arietinum
gttcattctaggaatatcgctgtgtgatggcaatgagatcggcgctgagtcgagggatcgtgactcgttcgatggactcaacatctcgtggagctttcagtcgtttctacagcggcaaaggtaagattcttagcgaagaggaacaagccaaagaaaacgtctacatccagaaatgggagcgggaaaggttggagaaactgaagctacagaatgataaggctaaggctgagaaggacaaagacactactgataagaaacctgatgggactcaaaagagctgactttaccagtcatgctatgctagccatgaaggtcacttgtgggaaacaatcatggggaataaaacacattgactctgagtgaactatggtctttgtatagattgtatgttttttttctctctcgtttatttgtagtttcttcaatggtgatg

SEQ ID NO: 6180 - DNA, 437 bp, Cicer arietinum
aattgctgcaaatttagtaaagaatggccctcttgcagttgctattaacgcagcctggatgcaaacatatatgagtggtgtctcatgcccatacatctgtgcaaaatcgcgtttggatcatggggttcttctagttggttttggaaatggttttgctcccatccgattgaaggaaaagccttactggatcataaagaattcatggggacagaattggggtgaggaaggatattacaagatctgcagaggtcgaaatatatgtggagtggattcaatggtctcaactgtagctgcagttcatgcatccaacaattaataatacggagatgctggttctggtggtctcatcctatgtgacacgactctagttcaatttgtgtaaatatataatcatgaagttgtgaatttagcttctggttctggcaaaactatctcca

SEQ ID NO: 6181 - DNA, 393 bp, Cicer arietinum
acctaactacatgtaaaagcttaccaacatcaaaacggatgaaaaaattgtattgctattattttctgctgcaaatacagagcattatttgaagatgctgtgaatattagttatcattgatgatgaatgcaacaattatcatcaaaatcacacatccaagacatattattgcatctatttcacttgcgcaagtggaaacaatatatgcctgaaccatcaatatgtaattatattaatacacacgagccttgggagggaatgattcaacctcatcatccaatgtattcaagtggaccggcctgtaatccaatcggaccttctcgttctcccagaatcccaaagtgtgtttcatccagctctcgtcgtctcttttcgtgaagtcctcacgggcat

SEQ ID NO: 6182 - DNA, 407 bp, Cicer arietinum
acttttctggatcttcattgtaggaacctccacaaaattcttctagagaagatgcatatcggaagaagttcatcagattcaagatttcacaatcagtaattttcacagagactaagttgggacaattttttgctataagttcgaggtcctgaattctgacattggcaatatcagtcaggtaaaaattaagtgtctcaagaactgtattattcaaagcaagcacatgcagccattcaccatctttctcgacaactgagctttcctccataaacaagactcttaaattcttgcaaaagcgaccaacatagtaaagtccatcagtggagaatccagaacacttctctaacttaagagcatgaagactattacatcgcgaacgagcaagaatctgaagatcagaatcagtt

SEQ ID NO: 6183 - DNA, 404 bp, Cicer arietinum
actaatcccggccgatatagccaatccaacaacccttctccatgctccttgtctttgcaccatttccttagcaaattcaggatccactatcaaactagccaaattagggttcctttgataagctttcttaatcctatccaaaaacactgctcttataatacacccacctttccaaatcctagctaattcccctaaattcaaattccaacctttctcgtcactctttgccctcaacaaattcatcccttgagcatagctacaaatctttgaagcatacaaagcttgtctcacatcatcaattaacctcttcttatcaatcccacttttcacaaaccctgcttcctcgttcaaccctgcttccttcaaaaccgcagatgcattctccctctcttccttcaacccac

SEQ ID NO: 6184 - DNA, 220 bp, Cicer arietinum
agttcaaattatttaatatcattcaaaggataatttgcaatttatcagtcactacaaatggatgaagtgcttatatataaaatgaaaaaaagacacatgtataattaaaatcaggacctactattgccaaattattgaactactaacactactatagccaaatatacttagaataccatccaaaagcgttgttcatgttcacccttcatggtaaaaaagt

SEQ ID NO: 6185 - DNA, 377 bp, Cicer arietinum
ctcacaaaatcactttcattttaaattacgacaacactagaaacaatggtcacatatattctagcagaaataacaaatgtagcaaccatcagaggtttaaaattaaaaataaacatacaacaaaaccgttgttcataaccataagcatcaattcccagttttttaaaataattgtgcagtaattaagatattgtgcatttaaaaaacaaagcatataaatatcctggccacgtcctgagtgatttataagaaaaatacttcttaaggtgatggtgagtgacggcggttgtcatcatcttcctctatggggctcctatcatccctggggctgcggctgcggctacggctacggctgcggctgcggccattagccttag

SEQ ID NO: 6186 - DNA, 279 bp, Cicer arietinum
tacgattagcgtggtcgaggccgcccgggcaggtactggaaatcagaatcaaacgagcttttacccctttgttccacacgagatttccgttctcgttgagctcatcttaggacacctgcgttatcttttaacagatgtgccgccccagccaaactccccacctgacaatgtcttccgcccggattggccaaccgaagtcagccttggatccaaaaagaggggcagcgccccgcctccgattcacggaataagtaaaataacgttaaaagtagtggtatt

SEQ ID NO: 6187 - DNA, 157 bp, Cicer arietinum
actggaaatcagaatcaaacgagcttttacccttttgttccacacgagatttctgctctcgctgagctcatcttaggacacctgcgttatcttttaacagatgtgccgccccagccaaactccccacctgacaatgtcttccgcccggattggccaa

SEQ ID NO: 6188 - DNA, 396 bp, Cicer arietinum
gccgataattttcagaaaatattacaaaaggggttgcttagttttcctctttaagagatgttgcattctggtggtaaaccctgtggaaatcgttttgtgtcgttgcagtaattgtatatcatgtaattcttctgcacccatttcaacctcccttggcctgtaacatccagctcctgtgaaaaccaggaacctttggcggaagcgtcagacacagaacttgagccacaagatgatgctccagaagaccagatgcaagcctcagcattaaaattcctgtaggaagctgtgaatggagcttgtgtccaatctgttttaacaagtccacctcttgttgcccagtcatctgcattccacaaacttgaatatattctcattggctgcttctttgggaagggt

SEQ ID NO: 6189 - DNA, 226 bp, Cicer arietinum
ggctgaaaccttatttattcattgagaaaaacatcatttacataaatgaccttgtatgatatttgcacccaaattaaagctgtggcgaacaaatgaaattctattacaacaacagattaaaagttccttaacattagtaaggaaaacttaaacgaattgattctcaatacaactaaaaacaaacatagaaagaaaccattttttttccaaagaaacatttatttgt

SEQ ID NO: 6190 - DNA, 303 bp, Cicer arietinum
acaaaaacgagaaccacagtaacacaaaaccataacatgataaataccatagccaaaccactaatttcttaaacctactaaagtgacatgacaaggagaacattcttaatcataaaccccaacaagaagaacttaaatctagtccctccagtttccaccaccttcaccgccacgtgagtagcgagaaccaccatcaccaccaccatatccacgatctctgctaccaccataaccaccaccacctcctccgccatatccacctccaccaccatatcctccaccaccacctctgttatatccacc

SEQ ID NO: 6191 - DNA, 404 bp, Cicer arietinum
gatgaaccggtccgcgagtcatgaatcatcgctaagccaccagtctgaggcggtaaatgcggcggcggtggatggagagagtaaagagagtgatgaaagtatggcttcggttgaaacggctgagacttcgatgaacttatttagagatgaaccggagtcaaccagagatttgaaacgggtggaccgaaccggtgaaagtggagaggaaaatgttggtttagaattgactcttgggtttgaaccggtttcacgtgttcatcacgtggttcctgtgaagaaaagaagagttgaattgaaagattgtggtggcggctcatggaagattgagctggggcttccataaacggcttaaggggctttgtgttccggttcagttttgacttaatcggctttctatcatttgt

SEQ ID NO: 6192 - DNA, 415 bp, Cicer arietinum
accctcgctgaccacaatatccagaaggaatctacccttcatctcgtcctccgtcttcgtggaggtatgcagatctttgtgaagaccctcaccggtaagaccatcactctcgaagttgaaagctctgacaccatcgacaacgtgaaggctaagatccaagacaaggaaggaatcccaccagaccagcagagactcatcttcgccggaaagcagcttgaagatggccgcaccttagctgactacaacatccagaaggagtcaacccttcaccttgtgttgcgtcttcgtggtggtatgcaaatcttcgtgaagaccctcactggtaaaactattacccttgaggtggagagttctgacacaatcgacaacgttaaggccaagatccaggataaggaaggtattcccccagatcagc

SEQ ID NO: 6193 - DNA, 163 bp, Cicer arietinum
caacccaaacaaatagccaatttgattatccaaacgtttcctaaagccacactcaaggttagatacataacataaaattgtttcaagtaaaaatagaaacagatgtaataaacataactaggttaattgattaatccacttgcaaaaaacagaatgaaaaaaa

SEQ ID NO: 6194 - DNA, 378 bp, Cicer arietinum
cacatgacctgaacaatcagattctatggctccactgttgtcacctgttgccactccccatctactgcttctttccataatgtcacattgttgtttccatcagctacagccagtatatttcctgtcaatgaccatgaaaccctccaaacaggtgtcttgaaatcattcaaaaccttgccatcccaatgatccccttctttgcctacagtccatatgatgactttaccatcctgtgatgcactagcaatggtagatttaggaagtcccaaattcggtgcccaagcaacatctcgaacccaatctgtatgcatctgaagtgcagggaagtagtccattttccagtgtccgttgttgagcttccacaccttcacagtatta

SEQ ID NO: 6195 - DNA, 309 bp, Cicer arietinum
actcattacctccaagaggcacctctctactcgtagccagctctacagtagttgtcggtgaagcacgtcccattggacatcaatacagctgatctcagcagcgcttccctccagcaacgcttctatctagttcatccagcatatcatcggcacaaaggcgctttactttcaagaggtcatcccgtcagcgggaactattcctctccagcctagaattctcttgcactgatagatcaagtagctttccataccctgaggcaggaagtccatgatcccctaagatcgccagtagctgcaacctaggactgt

SEQ ID NO: 6196 - DNA, 288 bp, Cicer arietinum
aaatggcaaaccaaaacgccatcgttttactcctcgctttcgttattctcctcaccgacgtagcaacaaccgttcaaggcgattcaacaaaaaagacgctagtcaaatacaaacacggaaaaaaatactgtgatcaaggatgggaatgtcaaggttggtcgatttactgttgtaatttaaccataactgattattttcaaacgtatcagcttgagaatctgttttcaatgacaaactcgccggatgcacacgccgctgggatttgggattatcattcttttattgctg

SEQ ID NO: 6197 - DNA, 273 bp, Cicer arietinum
acgagaggaaccgttgattcgcacaattggtcatcgcgcttggttgaaaagccagtggcgcgaagctaccgtgcgttggattatgactgaacgcctctaagtcagaatccgggctagaagcgatgcgtgtgcccgtcgttcgcttgccgaccagcagtagggggccttggccccccagaggcacgtgtcgttggtggacctcgtaaggcggatgagccttgcgggacaccttgaaacgcaattcctattgagcggcgggtagaatcttttgca

SEQ ID NO: 6198 - DNA, 349 bp, Cicer arietinum
acaacgcaaacggtgtttccacttgtcatcatctacctaggctgatgaatagcccgtgggctcactctgggcttaacaatcttcggagccttttccgcatacctaggaacttcagcccatccatcacatcctctccatttcaaatctcgcaacctcaccatttctttcccgtctcctccttcatcttcgtgttgtggctcgatttgatggaaaagatcatcttcatcgatctcgaaatcagagaagtaggaagtgtcgttatgattttggggatcttggaagcgttcacgaagccagtaatcacgaaaccaaggggatgattgaacgagggcccaccattcatcggaga

SEQ ID NO: 6199 - DNA, 342 bp, Cicer arietinum
acatggcttagctcgccgagcaagccgagcgctactaagagatggtggagttcatggagaaggtttccgccaacgctgataacgaggaactcacggtggaggaaaggaaccttctctccgtagcttacaagaacgtcatcggagctcgacgcgcttcgtggcgtatcatttcctctattgaacagaaagaggagagccgcggcaacgaggaccacgtcgctgtcatccgtgactaccgatctaagatcgagtcagagctctctaacatctgtgacggtattctcaagctcctcgattctcgtctgattccttccgcttcctctggcgattctaaggttttct

SEQ ID NO: 6200 - DNA, 425 bp, Cicer arietinum
accgagtataccccttggataagttggatgccaaagctataactgatagttttggcaaaggaatatggaaaaaggctataatagcactcacccatgcccagttctctccaccagatggattgccttatgaagaatttttctcaaaaagatctgaggctctcttgcaaattgtcagatcaggtgcctccttgaagaaggatgctgctcaggcttctgctattcctgttgttttgatcgagaatagtgggagatgcaacaaaaatgaaagtgatgaaaaggttcttccaaatgggattgcttggattcctcatctggtcaaaacaatcacagaagttgcactgaacaaaagtgaatctattcatgttgacaagaatttgattgaaggaccaaacccaaatcagagaggaaagttatggattcctctc

SEQ ID NO: 6201 - DNA, 431 bp, Cicer arietinum
acgacactgttcctggtcaatggaagcattttgaccttaaggttaaggactctaaaacccttctctttggtgagaagaccgttactgtttttggaactaggaaccctgaggagattccatggggtgaggttggagctgattatgttgttaagtcaactggtgttttcactgacaaggataaagctgctgctcacttgaagggtggtgccaagaaggttgtcatttcagccccaagcaaagatgcacccatgtttgttgttggtgttaacgaaaatgaatacaagccagagcttaacattgtttccaatgctagctgcacaaccaattgccttgctccccttgccaaggttcttaatgaccgatttggaatcgtcgagggtcttatgaccactgtccactccatcacagctacccagaagactgttgacggt

SEQ ID NO: 6202 - DNA, 427 bp, Cicer arietinum
tgccattaagagtgttgaaattgttgaaggaaatggtggccctggaaccatcaagaaattcactttcgtcgaagagggagaaaccaagtttgtgttgcacaaagtggacgcaatagatgatgctaattgggcttaccactacagcatagttggaggtgctgggcttccagacacagttgagaagatctcatttgaggctaaattgattgcaggcccaaatggaggatccattgcaaagttgagtgtgaagtatcacaccaaaggagattttactccttctgaagaggagctcaaaagtggcaaagccaagggtgatggtcttttcaaggcacttgagggttattgtttggccaatcctaattacaattaagtgcttttattatacctggtgtgttgttttgtgacacattttattatatttagtgtg

SEQ ID NO: 6203 - DNA, 405 bp, Cicer arietinum
accaaaattgcaagggattacaaaggaaaatcaaagggtttttttcaggcagactcattcttgctcttgggttgaggcaccatttgttgcatccatgggctcagcttgggcttcaccttcggcacccttctttcctttcttcttctttccaccacctttcttctttgtctttatgcccaatgctagccaggccttaatttcgggatcatctacagttttagtaggctgcaattcctggagtgaatgagttgtgatgcgatccgatccatttggcattaacaagaccgtgaatttgatgtgtgcaacataatcaccagccttttcgtgtagaacaggatacggctgcaggagctcgtgattcatgcattccactaaaccgagacgagctcttttttcttccaaagc

SEQ ID NO: 6204 - DNA, 318 bp, Cicer arietinum
cagaggacaaacatcaagaaaaactttgtttgtttccaatcacaaaatcaaaaagcaaaaagtagctgtttgtttcaatcatgaagcaaaaaatagttataaagttgcatatggactgtgagaaatgcagaaacaaagcacttaaaacagctgctgaggtcaaaggtgtggtttcagtggcattggaaggagatgataaagatcgtgtgtgtgtgactggtgataatatcgacacagtttgcttagccaacatgctaaagaaaaaattcaatgatgtaacaattcttagtgtggaagaggtgaaaaataaaacagctg

SEQ ID NO: 6205 - DNA, 435 bp, Cicer arietinum
acgtcaattctccaggagggtcagttacagctggcatggcaatatttgatactatgaggcacattcgacctgatgtgtccactgtttgtgttggattagcagcaagtatgggtgcttttctgctaagtgcagggaccaaaggaaaaagattcagcttgccaaattcaaggataatgattcatcaaccgctcggtggttttcaaggagggcaatctgacatagatattcaggcaaatgaaatgctgcatcacaaggcaaacctgaatggatatctctcctatcaaactggccaaagtctagagaaaattaaccaggatacagaccgtgattattttatgagtgcaaaagaagccaaagaatatggactcattgatggtgtcattatgaatcctctcaaagcacttcagcctttggcagctgcagaagagggtaaag

SEQ ID NO: 6206 - DNA, 402 bp, Cicer arietinum
accagccccatggttcctcagagatatactgagtcacttgtttcacgctcaagtaattgtcaagtccccattctcccagttcacggccaaaaccactacgtttaatgcctccccatggggcttgagtgaagcatggttgagagcaattgatccatacgattccagccttaaaagtcttagtaatgcgctcacatctttctagatcatttgatattacagcagcccctaagccatagattgtgtcatttgctagatcaatagcttcttcctcagtgctaaatgtttttacacacagaacaggtccaaatacttcttctttccaaatttgcatggaagtagtcacatcagtgataatggttggttcaacaaagaatcctttctttagatgctctggtcgagacc

SEQ ID NO: 6207 - DNA, 432 bp, Cicer arietinum
actttggcattgactacccttctcacattatcgccgctatttaaaccttaacttgcaacgggttttgcagtgactgacttaatggcttccgcgtatgtcctgtgctggtaggtaagtgtcgattcaagcaggtcccaaagggatgtcttaggattccatccaagctgcttgtttattatggtcatgtccggaattcttttgtcactgtcatcatatccctcaccataaaattctttggagctcacatcaactgtaggcgtctcaatagttggacctccacttaccttcgcatagacctggatcatcatttcggcgagctgcctaactgtaacctcattgtttgggttaccaacattaaagatgtggccattggctctggcagggtcttcaatcatcaataagacagcttcaatggcatctttgatgtaaaca

SEQ ID NO: 6208 - DNA, 405 bp, Cicer arietinum
accaattctgatcattaattagttagctccataatagcagcaacaatgtcaccattggcagctttgagagccttcacagctcttgatcttggcacaccagcttgagtaaccaccaactcaatatcctttggatctacaccagtctcgcctacatcctcatcttctggagcaacaccggaggattctggtttcgctccaacgttgctcaaattaggggccttgaactgctctgctgcctgagtttgtagctgtgagctcaagtcttcgatcttagcttccccgaatataatgtaggtgtcggcagttgggctcttgaaaacgtcaggtttggagatgacaaacaagatattcttgttcttcttgactgtcacacgactgacaccagtaactggtttcattccaagt

SEQ ID NO: 6209 - DNA, 321 bp, Cicer arietinum
tacggtggcggaggtggtgatggtggttcccgctactctcgtggtggaggtggtggtggtggtggaagctggagagattagtgtattagatgttaagtttggttcaatctattatgattatgtgttttctggtgttattattgatctacgattgggcatctgttatgttgtgagagttcaatttttgagtctttgtctttttgcatcggatagatcctcctatttcctttgtctgagagactttttgtacattttcaaatcggagcttggtggctcggaacgtttgcagttggatgtccgtcaaatcctccgcaaccactc

SEQ ID NO: 6210 - DNA, 292 bp, Cicer arietinum
acgaataccaaccgtgaaagcgtggcctatcgatcctttagtccttcggaatttgaagctagaggtgtcagaaaagttaccacagggataactggcttgcggtagccaagtgttcatagcgacgttgctttttgatccttcgatgtcggctcttcctatcattgttaagcagaattcaccaagtgttggattgttcacccaccaatagggaacgtgagctgggttagaccggcgtgagacaggttagttttaccctactgatgactgtgtcgcaatagtaattcaacctagt

SEQ ID NO: 6211 - DNA, 343 bp, Cicer arietinum
caagaaagcaatttccccagatggcccgaaacaagcaaactgctcgtaagtcaactggtggaaaagctccaaggaagcaacttgctaccaaggctgcacgtaagtctgcaccaactaccggtggtgtcaagaagccacatcgttatcgtcctggaaccgttgctcttcgtgagattaggaaataccagaagagtactgaacttttgatcaggaagcttcctttccagaggttggttcgtgaaattgctcaggacttcaagactgacctacgtttccagagccatgctgtgcttgcattgcaagaagctgcagaagcataccttgttggactctttgaggacac

SEQ ID NO: 6212 - DNA, 197 bp, Cicer arietinum
actacaaattttccgacctcacgaaagagattctgattgatggatggttccatacaggggatattggagagtggcaacctaatggaagcatgaagattattgaccggaagaaaaacatattcaagctttcacaaggagaatatgttgccgttgaaaacctggagaatattttcggccaagttccttctattgaatct

SEQ ID NO: 6213 - DNA, 431 bp, Cicer arietinum
actcccattctcaaacacaaaaaagaccatcaaatcactcttaacaaaaccagcaagcgtcaacacgaggaagaattaaaactgctggaagaagagactgcgagaagactggaagaagctatcaggaagaatgttgaggagaagcttaattcagaggaagtcaaattagaaatagaaaggcgtgtagcagagggcgtaaagaatttatttgatgatgttgaagttcaacttgaaaaagaaaagcaagatgctcttaatgaagctaggaggaaagaagaacaagctcgaaaagagagagaagagttggataagatgcttgaagagaataggaggagagtggaagagtctcagagaagagaagccctagagctgcaacggaaggaggaggaacggcaaagggaattagagatgattcggcgacagaaagaaga

SEQ ID NO: 6214 - DNA, 404 bp, Cicer arietinum
ctttcttctctaagtttgtatttgcaagttagttgaagaaaacattaacacttgttagctactacaagagtttaagatggcttccaaaacttgttccacacttgctcttttcttcacactcaacctcctcttcttttcacttgtttcagcttctggatcttgttcatgcaacccaaatccaaacccaaacccaaagcccagtccaactccaaagccaaagccaaacccaaacccaaagcccaacccaagtccaaaacccaacccaagtccaaaaccaaccccttcaagtggctcatgtcccagtgatacactaaaacttggtgtatgtgccaatgtcctaaatgggttactaaatataaaattgggtcaaccaccggtggccccttgttgctcacttctagaag

SEQ ID NO: 6215 - DNA, 223 bp, Cicer arietinum
cgaggtactgtatccccattcgttgtcataccaagaaacaacctttacaaagttatcattcaaagcaattcctgccttggcatcaaatatactagacctgctatcaccaacaaagcgagtagataccacatcatcttcagtgtaacccaaaattcccttcgacttgccctctgattcctccttgatagcagccctgatttgctcataggttggtttcttctca

SEQ ID NO: 6216 - DNA, 403 bp, Cicer arietinum
actctgctccggaaaggtttactatgaacttgatgagcatcgatctaaggttgatgcatcggatgttgcaatatgtagggtggaacagctttgtcctttcccttacgaccttgtccaacgagagcttaaacgatatccaaatgcagaggttgtttggtgtcaagaagaaccaatgaacatgggtggatacacttacatcttaccgcgacttgtctcttccatgaaagctgtaggtagaggtggttttgatgacgtcaaatatgtcggtcgtgctccatctgcagccacagccactggtttcctcaaggttcaccagaaggagcaagccgagattgccgagaaagcccttcaacgggaaccagtcaacttcccattctgaaaggttttgcatatgaatgctttt

SEQ ID NO: 6217 - DNA, 188 bp, Cicer arietinum
caagggagaccccggtattgctgctctttatgacaggctccttgtttcagaagatctatggcctttcggcgagcagttgaggaccaaatttgaagaaactaagaaactcctacttcaggtggctgcgcacaaggatcttcttgagggagacccttacttgaagcaaagactccgcttgcgtgattcgt

SEQ ID NO: 6218 - DNA, 322 bp, Cicer arietinum
acacaaataagctatcaaatattcccgaaagtctagttatccatttcttttgatttgtctacagttcggagtttgatttttcttcgcttaaacttttgtcgttcactcccacaagctcggtatcaaatataagtgttgcaccccctggaatagtgggtggggagccctgctctccgtagccaagttttgctggtattttcagtttccgcttcccaccgagacacattcccaataatccttggtcccatcctttgatcacttggccactaccaagctcaaagtcaattggattatttctttcaaagcttgaatcaaaaacagt

SEQ ID NO: 6219 - DNA, 404 bp, Cicer arietinum; identical to SEQ ID NO: 1019

SEQ ID NO: 6220 - DNA, 236 bp, Cicer arietinum
actacactgatcagatcatcaaaggccttgctttggccatgctccttgctggaaccgactcatctgctgtaactttagagtggtcaatgtctaatttgttgaaccatccagagatattgaagaaggtaaaggatgaattggatattcatgtaggacaagatcgtttggtagatgaatcagaccttccaaaacttacttatcttaaaaatgtcatctatgagacgcttcggttgtgt

SEQ ID NO: 6221 - DNA, 282 bp, Cicer arietinum
acaaagcccgcctgggagagatcttcacaatgactgatctcggacccgccaaacacttcctcggcgtaagaataacccgcgacaggaacgcaaggctaatctatcctccccaggatgcatatttcaatagaatactgaagagattcggcttagaaaactgccgaccagtcaagacccccatggagcgaaattcgctctcgacactgcgaccaagagacgatggcgactcggcttctccagaagagcgagaagactatagctcgaaaaccggctcactcatgt

SEQ ID NO: 6222 - DNA, 438 bp, Cicer arietinum
accatcttaaccaaaacaaccacaaaataaaggtcgaccatcgccgatcaagaacccagttttgcaagtttggctgcataaaaacggcaaaattaaaaggcaaaaataaacttagactcttaaaagataataagctactataaagcaacatccacttctgcatcaaccatcacttcttcttcactgcagctttggtgatcttggctccagttggatccttcttctcaacactcttgatgacaccgacagcaacagtttgacgcatgtccctcacggcgaaacgaccaagtggtggatactcggagaaagtttccacaaccataggcttggttggaatcatcttaacaagaccagcatcaccattcttcaaaaacttaggctccttctcaagttccttaccagatcgcctgtcgatcttggtgagaagctcagcgaact

SEQ ID NO: 6223 - DNA, 425 bp, Cicer arietinum
acgaatgggatgcagatgcagctctagaagcaatgatacgagacagtttggaaagttggattatgattgtatgtaacaagccaaatgaagtaacgattactgattagcaagggtggagaagctctgctgttccagcctggcattaatcattctacaatattggtcctgttagaagtgccaaatattgtttgtgtatatgttatttgatgatattccttgagtgtttgggctcgtgttaataaaattatgtctgattgcctgtctttgatagtgtcatttagatcaaagtcttgttacctcaaatttagagataaaactttggtagtaggttgtgtcacccaaagggtagacctttaatctgaatatcatttcagtgctgtcatggtgtgctagttcccatatttgatgaagtttaggcttcagct

SEQ ID NO: 6224 - DNA, 399 bp, Cicer arietinum
  misc_feature (345)..(345): n is a, c, g, or t
acacacttgacttacaatctcacacttccacaacaaaatgaaaggaagaagagagtatgacatttggcaaccaaattaagcacactaaatataataaaatgtgtcacaaaacaacacaccaggtataataaaagcacttaattgtaattaggattggccaaacaataaccctcaagtgccttgaaaagaccatcacccttggctttgccacttttgagctcctcttcagaaggagtaaaatctcctttggtgtgatacttcacactcaactttgcaatggatcctccatttgggcctgcaatcaatttagcctcaaatgagatcttctcaactgtgtctggaagnccagcacctccaactatgctgtagtggtaagcccaattagcatcatctattgcg

SEQ ID NO: 6225 - DNA, 402 bp, Cicer arietinum
actctcaaatcaataatcaccaatctagattcttcctcataactgaattcaacctcttctgaatcaacagtaatcaacttgggccgagccgatgaataagcaccgaactggccacatccgcgcactttcatggtgacattttcacttccatttggtccatagctgaactctttgacagctcctcctgaattgaacatcttgattaaaccaataggagcaaatttgacaccatttggtaattccttcacagggactaatgtaaaaacttcatattctcgcaatttcaaagtaactgagatagaaacatcctttggaaggtagactaattcgccacaaagatgcgaaaatataactgtgtctcctttccatttatcatctgcagccgcagataaatgatcaaca

SEQ ID NO: 6226 - DNA, 405 bp, Cicer arietinum
acaagagtcctcttcgatgccgaagaagccgaaagtggcttcacccttaattcctcaagttgatccctattcatatacaacacaccttgtccatcggcatcagttaaaaccaaattatccaaagtcttatgctccgaaattatcggttgcaacaagtaatgccttgcagatgcagcaatcagagaactaattgtccaaactaccctcaatttcaaaccaccgtttgtgtaaaacgaatcgggtatgcttccattatcatcaacaccgccattgttaccaccgccagcaataacaccacaagaagcatccacaacaacaccatcctgcgatttggggtgaaaaatagaggaagcgcctagaattacacaattatcaagagttgatccaaaatcagctctccatttc

SEQ ID NO: 6227 - DNA, 435 bp, Cicer arietinum
actgagctgaacaagaaaatttacaagcttggcaagtctggagaagagacccatgatgcccaaactgattatgataggactgagaaagacatcaccccaatgggtggattcccccactatggtgttgtgaaggaggattatctgatgatcaagggaggtgttgttggtcccaagaaaagggttattactttgcgtcagtctctactcaagcagacttctcgcaatgccttggaggatatcaaacttaagtttatcgatacctcttcaaagtttgggcatggtcgcttccagacaacacaagagaaacagaagttctatggacgcctcaaagcttagttatggctgctgctttgaaatgttggaaatcgttatttatgttatttttgttgccatccttttaaactctgttgtggtgtcttccgttagctattttgg

SEQ ID NO: 6228 - DNA, 358 bp, Cicer arietinum
attcgagatcatgagtctgacccaaatcttaggaacattgaacttgagggaaattttgaacaaattaaggatgcaagtaacatggtgaaggatttactggtgaccctgcaaatgtctgcaccacctaaatcaaaccaaggtgctcctggtgcccctggccatcatcatggaagcaacttcaaaacaaaactgtgtgagaattttacaaaaggatcttgcacttttggagatagatgtcattttgcacatggagcggctgaattgcgaaaatgaaaactttgccttggtgatgtggtgcattatcctatcaatccaggactattttgattattattgttgtgcattgctacttaggggt

SEQ ID NO: 6229 - DNA, 375 bp, Cicer arietinum; identical to SEQ ID NO: 853

SEQ ID NO: 6230 - DNA, 403 bp, Cicer arietinum
acaaagatatggttgaatcctgtagcctacattattacatcccattaaactcacccccatcaatttaaaaaacagcagcttttactctcctaaccaactccttcctcatcagttgcctgtcaaagcctgatgcagccaaaacccctctattttcctcagcccttctcaagaggtttggcataacagtctctacaggtccaaatggcatgtatttgctgacctgaaaccctgcattgctcaaaccaaaagaaagtgcctctgacattccatatagttgtgcaaattcaagcttgtggttcacctttccaatccccaattcacgtgcttttgcagcagccaattttcctgattcaacattatgagttgcaagaacaaccccaccaggtccattagcaatcttctc

SEQ ID NO: 6231 - DNA, 277 bp, Cicer arietinum
actggaaatcagaatcaaacgagcttttacccttttgttccacacgagatttctgttctcgttgagctcatcttaggacacctgcgttatcttttaacagatgtgccgccccaaccaaactccccacctgacaatgtcttccgcccggattggccaaccgaagtcaggcttggatccaaaaagaggggcagcgccccgcctccgattcacggaataagcaaaacaacgttaaaagtagtggtatttcactttcgctgtctccagctcccacttatcc

SEQ ID NO: 6232 - DNA, 436 bp, Cicer arietinum
acttgttgggtatctaagtatctcaaccaaatcaaggaatgttttagtaaatgaggttctgttccatcagcccagcagggtccgtagatcactgccaagtttcatgtgatgccaacgcaaccaatcagcagccccaacttaaaagagtgacacactcctaaacgctggttccctcattcttaccggcgtgagcctcagaatcaatggtagtctcagggttgttggcatagtcatcctcaccactgagctcctcaagagtcttacgggcagtctcagggataaggagagtagtgaagataccgagaagcatgaagagagcatagatctcgaggacgtggtccatccagggggcctcgttcttgtcggtggcaccgtgggtgcggaggatggagatggcaccctggccaatgatggaaccaatctttcctgaggcagc

SEQ ID NO: 6233 - DNA, 308 bp, Cicer arietinum
gaaaacagtcagagagaaggcaaacttgttgtcagagtcccaagatattgcagccaccatcaatttggagacacaagatattccagatgctcggacttatcttttgaccgtgaaggaaataagaaccaagagaggtcttacagatgatcttggtgcagaggctatgatgtttgatgcattggagaaagttgaaaagaatataaagaaacctctactgagaaatgatgagaaaggaatggaccttctcttggcagagtttgataagatcaatcagaaacttggaattcgaagagaagatttgcctaagt

SEQ ID NO: 6234 - DNA, 407 bp, Cicer arietinum
ctttgtttttcatccatttattaatcaacatgaaaaacaacacaatcaataattcccaattattcctcctcctaatcttaccgggaataattcttctctccgccacaaaagcccaagcccaaaacaagtccaatgatttcacagatacaaatcctaacgaattcaacccttccttcgctataatcatagtaattttagtcgctgctcttttcctcatgggctttttctccatctacatccgtcgctgcgccgattcaccaacttctaacttcgttctccccatcaccgacggtagatcgcgtagggcggcgcgtggactcgattcatcggtcatcaatacttttccgattctcgaatactctgaagttaagatccacaaaattggaaaagagattttggagtgtgcc

SEQ ID NO: 6235 - DNA, 306 bp, Cicer arietinum; identical to SEQ ID NO: 5962

SEQ ID NO: 6236 - DNA, 330 bp, Cicer arietinum
tagcgtggtcgggccgaggtacaatgacacagaatatttaaaatgcgaaaaacactgaacagacataatttctaacagaacagtgtaagatgcttgttgttgtttaagatgaggaaccttagcaacttattttacattccggaagtcgtaacttcagggaccacaggatgactgattcctggatctacatgactgagtatcccggacctccacctccttccggcactgtccactcaatattttgctttggatctttgatatcacaagccttgcaatgtaaacaattttgagcattaatctgcaactttagttgattttgctcatctgcaa

SEQ ID NO: 6237 - DNA, 428 bp, Cicer arietinum
gccgagaatttccgcgctctctgcaccggtgagaaaggtgtcggacggagcggcaagccacttcacttcaagggatcctccttccatcgtgtgatccccaacttcatgtgtcagggaggtgacttcaccgccgggaacggaaccggaggagaatcgatctacggatccaaattcgccgatgagaacttcatcaagaagcataccggtcctggtatcttatctatggctaacgctggtccaggaaccaacggatctcagtttttcgtctgcactgcaaagaccgaatggctcgacggtaaacacgttgtgtttggtcaggttgttgaaggacttgatgttgtgaaggagatcgataaggttggatcaagcagcgggaagacctctaagcctgtgaagatcgctgactgtggtcaactctcttagatgat

SEQ ID NO: 6238 - DNA, 404 bp, Cicer arietinum
actggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggattggccaaccgaagtcagccttggatcctaaaagaggggcagcgccccgcctccgattcacggaataagtaaaataacgttaaaagtagtggtatttcactttcgctgtttccagctcccacttatcctacacctctcaagtcatttcacaaagtcggactagagtcaagctcaacagagtcttctttccccgctgattccgccaagcccgttcccttggctgtggtttcgctggatagtagacagggacagtgg

SEQ ID NO: 6239 - DNA, 403 bp, Cicer arietinum
aagaaagaaagaaagcgctttcagtgactgagagagtgataaaacgctattccaacatgccgatcagaaatattgccatcggaaatccacaagaggcaactcacccagacaccttgaaagctggtctcgctgagtttatctcaaccttcatcttcgtcttcgccggctccggttcaagcatcgcttacaacaagctaaccaacgacggtgctgctactccctccggcctcatctccgccgctatcgctcatgcgtttgctctctttgttgctgtttccgtaggtgccaatatctccggtggtcatgttaaccccgccgtcactttcggtgccttcgttggtggtaacatcaccctcctccgtggtatcgtttacattatcgctcaactcctcggatccatcgt

SEQ ID NO: 6240 - DNA, 306 bp, Cicer arietinum
cttttccttggcacccgctgttagcgttctgctagggcagaaaatttttacaggccaaaatggcaacaaaagcagctgcgggactagcgggaccctaacagctgctggaagaaagggattcagagagttgacctttcttcgtgacaagtgttttcaacggcactgagcttcgcgagctcttgacatcgcctccgggcaccttttcatttgtcttatctacgacttcttctcaccccgacatttcggcttcgcgagcctgcgacattccggcctctgtgcccctcgacttcccgtaacaccgacttc

SEQ ID NO: 6241 - DNA, 288 bp, Cicer arietinum
accataacctgggaattctggtcagttgtgaatccatcccatagagccatgaactcggttttcatatttaacaaagcctcgtgatctgacgtacgacgttgacccaaaaaactgtctacttcatcaatgaatatgatggcaggctgaagcttataagccaagctaaatacagcacacacaagcttttgggcatctccgaaccatttgctcatcaaattggatatccttacattaatgaaaactgctccagattccttagcaatagctttggcaagcatggttttccca

SEQ ID NO: 6242 - DNA, 431 bp, Cicer arietinum
acttggcaagctgaacctggtgttgtagccgaagctgttaacactgccattcaggttggatacagacatattgattgtgctgaagcatacaggaatcaagcagagattggttctgcactaaaaaagctttttgaggatggtgttgttaaacgtgaggagttatggatcacctcaaaactatggtgttcagatcatcatccagaagatgtgccaaaagcattggataaaactttacatgatttgcaacttgactaccttgatctctatctgatccactggccagtcagcatgaaaaggggaacaggtgaatttaaggctgaaaatcttgatcatcccgacatacccagcacatggaaagcaatggaagcactgtatgactctggcaaggctaaagctattggagtcagcaatttctcctcaaagaaacttca

SEQ ID NO: 6243 - DNA, 236 bp, Cicer arietinum
actacactgatcacatcatcaaaggccttgctttggccatgctccttgctggaaccgactcatctgctgtaactttagagtggtcaatgtctaatttgttgaaccatccagagatattgaagaaggtaaaggatgaattggatattcatgtaggacaagatcgtttggtagatgaatcagaccttccaaaacttacttatcttaaaaatgtcatctatgagacgcttcggttgtgt

SEQ ID NO: 6244 - DNA, 406 bp, Cicer arietinum; identical to SEQ ID NO: 3490

SEQ ID NO: 6245 - DNA, 374 bp, Cicer arietinum
actgtatccccattcgttgtcataccaagaaacaacctttacaaagttatcattcaaagcaattcctgccttggcatcaaatatactagacctgctatcaccaacaaagtcagtagataccacatcatcttcagtgtaacccaaaattcccttcaacttgccctctgattcctccttgatagcagccttgatttgttcataggttgctttcttctcaagccttacagtgaggtcaacaactgaaacatcgacggtagggactcggaaagacattccggtcaatttaccattcagttctggaagaacctttcctacagccttggcagctccagtgctgctgggaataatattgaaggaagcagctcttccacctc

SEQ ID NO: 6246 - DNA, 428 bp, Cicer arietinum; identical to SEQ ID NO: 5143

SEQ ID NO: 6247 - DNA, 246 bp, Cicer arietinum
acgttggacatctcctcacgcttcttcttggcacgtttgtgggttccaagctttctctttgcaaccttaagtggcctcttatcttttccaaccttgagcaactcagttatacgcttctcataaggtgcaaacccagcaacctctctgatgaggtttctcacgaagtgaactctcttgcttgttttccccttgcgatctgaggggcgtggagccaactccttcttggtgacaacgtgacccttgttc

SEQ ID NO: 6248 - DNA, 336 bp, Cicer arietinum
ccatgcaattttctttttaaaaattgaaaagaaattgaaactgggaattttaattgatcaattccataaatcaaaaaggcattctaagcgtggaaaaaaaagtccaggtcacaaatccggaactaaaaatctgtatactgattaacgtaagaaaatacaacaagaagtttaaatgaaaaaacatgcaggttccttgagtcatttccttatataaaacttgggcagactggccccttcgatagaccaaggcgaacttccatcccattatgcatgtccaatggtcgcaaagtctctgattcgcgaggatcatttaaataatcctcaaaactaaagtca

SEQ ID NO: 6249 - DNA, 414 bp, Cicer arietinum
gcggtcgcccgggcaggtacaataaaacttatcgtacttttatttcattaagaacccaagcaaaccgcgaccacatatatattacagcacccatttattacattaattattaactagcgaaaagcagacatcaacaacaacattctttatttattctcttaattatgatattattattttagaaggttataattaatcttgtgcagcttttccagcacgatgatcataaccatgaaccccaagattaattattttgaggtattatgccacgaagagatggccaatagtcaagagttttcttcacaccacccataatggtatcatttgttgatccaggtgtaaaattgatacgtgcataatattctcctttgaaaagataagcttcatttgtcttatgagaagcaaaagctgaat

SEQ ID NO: 6250 - DNA, 265 bp, Cicer arietinum; identical to SEQ ID NO: 1172

SEQ ID NO: 6251 - DNA, 403 bp, Cicer arietinum
actgcaaaaataacccatgagtatgcacggattaccaaaatagctaacggaagacaccacaacagagtttaaaaggatggcaacaaaaataacataaataacgatttccaacatttcaaagcagcagccataactaagctttgaggcgtccatagaacttctgtttctcttgtgttgtctggaagcgaccatgcccaaactttgaagaggtatcgataaacttaagtttgatatcctccaaggcattgcgagaagtctgcttgagtagagactgacgcaaagtaataacccttttcttgggaccaacaacacctcccttgatcatcagataatcctccttcacaacaccatagtgggggaatccacccattggggtgatgtctttctcagtcctatcataatc

SEQ ID NO: 6252 - DNA, 404 bp, Cicer arietinum
acccaaccgcctgtccttgtcctgccggcgccattaaatgtccttgttggctaactgcaacactacttccaccaccaccaacaacaaatccagcattgtcatttctctgatattgcgtcctctgagtcaattgattcagatgattcaacggattcaatgaattcacgtgttgttgctgttgttgttgatgatgtgttttcaccaccttaggtccatcaattgccttctggcagtgcaaaatatgtccctcgaattccttatgaggctcctccaacgccctcctcgcactctcagcgctcttgtaaacaaacaaacagaaccctttcggttttcccattgccttgtcaagccctaacggcccttcctcaatctctccaaaccgcgaaaaaaacgtgaaaagcttc

SEQ ID NO: 6253 - DNA, 402 bp, Cicer arietinum
acttaatcacgaaactcatccatgaacttttcatgaaactctgtcaagcgagtgacaatggccggaatcttatcttcttgaggcaaaattgtgcacctaaaatgccatgtgccaggaacctgtccaaaaccagaaccgggaacaacaacaactcctgtggcattaaggaagcgtttgcaatagaaggcatcaggtgctgtgttttcggcctctgcagctttgatcgccttttcgggcaggcgaatctgaggaaacagatacattgctccttctgctttgttgcaggttacaccctctaatttgttcaaagcttcttccagtgactttgcgcgcgtagcatgggaaggcaaaatactacccttctcagccatgaatgactcataggactcatctccaacctta

SEQ ID NO: 6254 - DNA, 404 bp, Cicer arietinum; identical to SEQ ID NO: 4328

SEQ ID NO: 6255 - DNA, 415 bp, Cicer arietinum
accggtaatgtaggaatcacggtaaaattgtctgttggagtgtgcatagagagtgtcttgaaacgcgtcaatgcggcatcggttgatgacggattgatctgcaccgactcggagagcaactgcctggtgcttctctgggcctgctgtgttttggaatccaatgtcctgagctataaacccatccccaacagcagcgacagttgcacttttgaaagtggttgatccatcaatgacattcaagctgcctgtgattgttgttacatccataccatcacctacaagcatgacattcttctttttctttccaatttctacattctctttgtagattccctttttcacatagataacatacctagtattaccattatctggtgcagatgcaacagcttcaaccacagtcttaaacttgcca

SEQ ID NO: 6256 - DNA, 291 bp, Cicer arietinum
actaccaaacaccaagcaataaacaaagatctaggtgctctcgctcctattcggcttcgtagacacgaaaatcagatgttgatcaaggttgggaacccagtcatttgtagcaggattacttttatatcctctgaattgaatttcaccaacatcaacatagcttgcaggtaacttaatctcatatccatcttcaccaccttctctcaccgcttttataaacccacttcccgtcgcatgatgctgtttatcaatggacaacaactccttgtaatagtgagtctccacaaactc

SEQ ID NO: 6257 - DNA, 356 bp, Cicer arietinum
gcggacgcccgggcaggtactcattacccccaagaggcacctctctactcatagctcggcctacagtagtggtcggtgaagcacgtcccattggacatcaatacagttgatcctcgcagagcttccctccagcagcgtctcccatctagttcatccagcatatcatcggcacaaaggtgcatttactttcaagaggtcatcccgtcagcgggatctattcctctccagcctagaattctcttgcacggataaatcaagtagctttccatgcccaaaggcaggagaaccataacccctaagatcgccagtagctgcaaccttagaactatgcatccttagggaaacccctcgcaggg

SEQ ID NO: 6258 - DNA, 439 bp, Cicer arietinum
acgcggggggacaggttttcttggttcatggattatcaaaagactacttgaagatggttactctgttaataccactgttagagctgatccagaacgtaagagagaccttagcttcctcacaaatcttcctaatgcatctgaaagactacaatttttcaacgccgatctaagcaatccagaaagtttttccacagcaattgaaggttgtgttgggatattccacactgcatctccaattgattttgcagttagtgaacctgaagaagttgtgacaaaaagaacagttgatggagcattaggcattttaaaagcatgtgttcattcaaagacagtaaaaagagttatatacacttcaagtggctctgctgtttcattcactggaaaagacaaacaagtcttggatgagagtgattggagtgatgttgatttgtttagaact

SEQ ID NO: 6259 - DNA, 262 bp, Cicer arietinum
acggctaaacttggtgaatccccacttcctactgacgatgatcttttgacgcccgggaaacttaaacttggcacgacgaagggcctcctgtgcatgatggctattgctgtccttgcagcggactgaaagaaggacctgcccaatagcaactctagcacaagttccctgtggttttccaaaagcacctctcatacctgtctgaagcctatcagctccagcacatgaaagcatcttgttaatcctcagaacatggaaaggatgt

SEQ ID NO: 6260 - DNA, 360 bp, Cicer arietinum
actaatgtttagcctggacccaaagagcctccatctttatcaagggggaagtattgaccaattgatgtaagagcataaactctttctctcttaccctctccattaatacgaatggagcaattaagaagagagtaactggccaacacaggcaacatgcgctcgagcctatcagtcaattcagggtgttgattaggaagctgagaagcaatttcagatgcatataagcttgaaccatgtgaactttgtgttttagctatgatgtcaaacaaattgagatcaacagcagcatttagtattgcgggaaaaatccgactaaaacataataccagagcagagagataagcatcgtcggcctttggt

SEQ ID NO: 6261 - DNA, 363 bp, Cicer arietinum
actgttttataggagaagataagtgaactcgaaggagctgaatcaactgtcttaatggcatctggaatgtgtgctagcatagtcttgttgatggcgctggttccagctggtggacatcttgtgactactacagattgttaccggaagactaggatttttatagagactgtgcttccaaagatggggatcacgaccaccgtggttgatcctgctgatgttggagccttggaatctgcattggagcagaacaatgtgtctcttttcttcactgagtctcctaccaatccattcctgagatgtgttgacattaagctggtttcagagctttgccataagcatggggctttgctctgtattgatggt

SEQ ID NO: 6262 - DNA, 312 bp, Cicer arietinum
acttgggataaccagttttatccaacgctcttagagcaaggatctgacattttacagattgatgttgatactgagaatggtggtctaaaaatcaaccccgacttctttgtggattttggagctgagcctgatggtccttcccttgctcatgagatgagataccctggtggtgactgcacttctgatatatggatttaagctaatgtatcatcattttgttgtataaaaggtatctttggtgtagttgaaacttaaaataaacacgagaaataccgtgcttgttcatcttcaatgaatagtgatatgtattgg

SEQ ID NO: 6263 - DNA, 340 bp, Cicer arietinum
ggacgcacttgacttacaatctcacacttccacaacaaaatgaaaagaagaagagagtatgacatttggcaaccaaattaagcacactaaatatgataaaatgtgtcacaaaacaacacaccaggtataataaaagcacttaattggaattaggattggccaaacaataaccctcaagtgccttgaaaagaccatcacccttggctttgccacttttgagctcctcttcagaaggagtaaaatctcctttggagagatacttcacactcaactttgcaatgaatcctccatttgggcctgcaatcaatttagcctcaaatgagatcttctcaactgtgtc

SEQ ID NO: 6264 - DNA, 294 bp, Cicer arietinum
accattattaatgcaatgaagaaaaaatgttcaaatacattgaattaaatttaggggacgctgaattatttggcacattgcaagttacaacaaagaaaaactaaactttttctctccccttaaattccttgtttgaacttccaaagcaaaccactcttaatttattggcaaacaaatttattaaccacaaaaagaatctagtcactccttgcgaattcctttgtttacatgtttcctccgtataacatgcactgtttgcgacttggtgttcaattaaagcacagaacaatcagt

SEQ ID NO: 6265 - DNA, 403 bp, Cicer arietinum
actgtatccccattcgttgtcataccaagaaacaacctttacaaagttatcattcaaagcaattcctgccttggcatcaaatatactagacctgctatcaccaacaaagtcagtagataccacatcatcttcagtgtaacccaaaattcccttcaacttgccctctgattcctccttgatagcagccttgatttgttcataggttgctttcttctcaagccttacagtgaggtcaacaactgaaacatcgacggtagggactcggaaagacattccggtcaatttaccattcagttctggaagaacctttcctacagccttggcagctccagtgctgctgggaataatattgaaggaagcagatcttccacctctccagtccttgcttgatggaccgtcaaca

SEQ ID NO: 6266 - DNA, 404 bp, Cicer arietinum
acctgccttgtgcaaaccagatttgacatatcccatagctatgttcttcttgagacaaggactgaatccaccacttgtgacttcaccaatgttgttgcctccttcatcttgaatctcactgtgacttctaggaggtggacccgaagaaatgaaaccgacacgcctgatcaaaggaccatctccgagctgtttcaggataacatcagctccaagaaaaccgccttctgctcttctccgctttcctatagcccatgtcagtcctgcctcaataggtgtaatatgctgttccaggtcattgccgtataagcacaatccagcttcgaggcgaagactatctctagcacctagtcctgtcaatcttattttcccttcagatttttccagtaatgccttggcaagatcta

SEQ ID NO: 6267 - DNA, 373 bp, Cicer arietinum
actcattacccccaagaggcacctctctactcgtagctcgccctacagtagttgtcggtgaagcacgtcccattggacatcaatacagctgatcttagcagagcttccctccagcagcgtctcccatctagttcatccagcatatcatcggcacaaaggcgcatttactttcaagaggtcatcccgtcagcgggaactattcctctccagcctagaattctcttgcacagatagatcgagtagctttccataccctgaggcaggaagtccatgatccccaaagatcgccagtagctgcaaccctagaaccgtgcatccttggggaaacccctcgcagggaaaaacccaaggcggctagaacgctgctctgtgg

SEQ ID NO: 6268 - DNA, 366 bp, Cicer arietinum
acaagtggtttgcataaaaggcaaaaccatccatcaatagtttctcaacatcttagagcagcattattcaaaaattgacaaacaatggaacctccattgacactaaacaaggaaacaagccgtctaagagaggcatgagtaagccaaagccttctcctcagaaagctcttctgctgtcgagtccaattttttccttgagaactcatcaattgaaagtccttgaactatttgccattccccgttgcgacaggtgacgggaaatgaatatatcagtccagctggcacattgtatgatccatcagaataaactcccatggatacccaggttccctcaggagttccaagaacccaatctctaatgtggtc

SEQ ID NO: 6269 - DNA, 426 bp, Cicer arietinum
cacaattttccaactaagaaaaagttagggttagggatttcgcaccttttcccaaaatctcatcaaaatcaaatcactatgtcttcaacgaaaaagatcacccttaagagttccgatggagaggcctttgaggtcgatgaagcggtggctttggagtcacagacgattaagcacatgattgaagatgattgtgccgacagtggaattcctcttcctaacgtgacaagcaagatcttggcgaaggtaatcgagtattgtaagaaacatgttgaggctgcgagttctgatgataaacctactgaggatgatcttaaggcttgggatgctgattttgttaaggttgaccaggctacgctcttcgatctcatactggctgcaaactacttgaacatcaagagccttcttgatcttacctgccagacagtt

SEQ ID NO: 6270 - DNA, 276 bp, Cicer arietinum
acttcagtgttttcaattacaggtagcaggaccaaatggacaaatatggaaaggtgctgatgctaaggttagcatggatgaaagacctggtctcactgttccaagagcacataatctcgtttgtgttccacttgcaagacctggtgctgctgctaaactcctttcctcctaaaacatacattcaaacacttaattcgtccatgtccgtttataaactaaataatcattttcaataaggtatcattgagagagtccacgaggtgtgctagtgatggt

SEQ ID NO: 6271 - DNA, 400 bp, Cicer arietinum
actgcaaaaataacccatgagtatgcacggattaccaaaatagctaacggaagacaccacaacagagtttaaaaggatggcaacaaaaataacataaataacgatttccaacatttcaaagcagcagccataactaagctttgaggcgtccatagaacttctgtttctcttgtgttgtctggaagcgaccatgcccaaactttgaagaggtatcgataaacttaagtttgatatcctccaaggcattgcgagaagtctgcttgagtagagactgacgcaaagtaataacccttttcttgggaccaacaacacctcccttgatcatcagataatcctccttcacaacaccatagtgggggaatccacccattggggtgatgtctttctcagtcctatcata

SEQ ID NO: 6272 - DNA, 241 bp, Cicer arietinum
gaagaaaccctatcctgaaaccaaactcggggctcaactatgacattggggcgcgggaatggtggccgcaacaagcacggtcgtggccatgtcaaattcatccgatgctcaaactgcggcaaatgctgtcctaaggacaaggcaatcaagagatttcttgtaaggaacatcgttgaacaggccgcagttagagatgttcaagaagcttgcgtctatgaccaatacacccttcctaagttgt

SEQ ID NO: 6273 - DNA, 750 bp, Cicer arietinum
tttccgggaaggttccacccaactatggtttccccggaaaacaccaattggctttttgattacgctttgatggacgatattcccgtccctgatggctccttcaacttcacgtggcccccaccggacccttccaatgttggtgttgaaattgatggctctctgggggattctgatggtatcaaagatcctggttcgaagaagaggggtagatcggattcatgtgctccttccagctctaaggcgtgtcgagagaagttgcggagggataggctgaatgacaagtttgttgaattaggctcaatcttggagcctggaaggcctcccaaaacagacaaagctgcaattctgattgacgctgtccgaatggtgacacaattgcgaggtgaagctcagaagttgaaagcctcaaattcaagtcttcaagagaagattaaagagttaaaggtcgagaagaatgaactccgtgatgagaaacagaggcttaaggccgataaagagaagttggagcagcaggtgaaatcaatgaatacccaacctggtttcttgacaccccctcctgcaatccctgctgcatttgctccacaaggccaagcccctagcaacaagttaatgcctttcattagttaccctggagttgcaatgtggcaatttgtgccaccggcaaccatggatatctcacaggatcatgaactccgcccaccagttgcctaagttggcactgactgtacctcggccgcgaccacgccacgc

SEQ ID NO: 6274 - protein, 228 aa, Cicer arietinum
MVSPENTNWLFDYALMDDIPVPDGSFNFTWPPPDPSNVGVEIDGSLGDSDGIKDPGSKKRGRSDSCAPSSSKACREKLRRDRLNDKFVELGSILEPGRPPKTDKAAILIDAVRMVTQLRGEAQKLKASNSSLQEKIKELKVEKNELRDEKQRLKADKEKLEQQVKSMNTQPGFLTPPPAIPAAFAPQGQAPSNKLMPFISYPGVAMWQFVPPATMDISQDHELRPPVA

SEQ ID NO: 6275 - DNA, 27 bp, ARTIFICIAL SEQUENCE
  SYNTHETIC PRIMER
ggatccatggtttccccggaaaacacc

SEQ ID NO: 6276 - DNA, 28 bp, ARTIFICIAL SEQUENCE
  SYNTHETIC PRIMER
gcggccgcttaggcaactggtgggcgga

SEQ ID NO: 6277 - DNA, 29 bp, ARTIFICIAL SEQUENCE
  SYNTHETIC PRIMER
ccggaattcatggtttccccggaaaacac

SEQ ID NO: 6278 - DNA, 29 bp, ARTIFICIAL SEQUENCE
  SYNTHETIC PRIMER
cgcggatccttaggcaactggtgggcgga

SEQ ID NO: 6279 - DNA, 37 bp, ARTIFICIAL SEQUENCE
  SYNTHETIC PRIMER
gaagatctatggtttccccggaaaacaccaattggct

SEQ ID NO: 6280 - DNA, 31 bp, ARTIFICIAL SEQUENCE
  SYNTHETIC PRIMER
ggactagtggcaactggtgggcggacttcat

SEQ ID NO: 6281 - DNA, 29 bp, ARTIFICIAL SEQUENCE
  SYNTHETIC PRIMER
cgcggatccatggtttccccggaaaacac

SEQ ID NO: 6282 - DNA, 29 bp, ARTIFICIAL SEQUENCE
  SYNTHETIC PRIMER
cccgagctcttaggcaactggtgggcgga

SEQ ID NO: 6283 - DNA, 25 bp, ARTIFICIAL SEQUENCE
  SYNTHETIC PRIMER
aagaagaggggtagatcggattcat

SEQ ID NO: 6284 - DNA, 25 bp, ARTIFICIAL SEQUENCE
  SYNTHETIC PRIMER
attaggctcaatcttggagcctgga

SEQ ID NO: 6285 - DNA, 30 bp, ARTIFICIAL SEQUENCE
  SYNTHETIC PRIMER
gttggtgttgaaattgatggctctctgggg

SEQ ID NO: 6286 - DNA, 32 bp, ARTIFICIAL SEQUENCE
  SYNTHETIC PRIMER
atggtttccccggaaaacaccaattggctttt

SEQ ID NO: 6287 - DNA, 20 bp, ARTIFICIAL SEQUENCE
  SYNTHETIC PRIMER
ttaggcaactggtgggcgga

SEQ ID NO: 6288 - DNA, 21 bp, ARTIFICIAL SEQUENCE
  SYNTHETIC PRIMER
gttttcccagtcacgacgttg

SEQ ID NO: 6289 - DNA, 24 bp, ARTIFICIAL SEQUENCE
  SYNTHETIC PRIMER
tgagcggataacaatttcacacag

We claim:

1. An isolated cDNA sequence as set forth in SEQ ID NO: 6273 encoding a protein having the amino acid sequence as set forth in SEQ ID NO: 6274.

2. A recombinant vector comprising the cDNA sequence as set forth in SEQ ID NO: 6273 encoding a protein having the amino acid sequence as set forth in SEQ ID NO: 6274, wherein the cDNA sequence is operably linked to a heterologous promoter.

3. A recombinant host cell comprising the cDNA sequence as set forth in SEQ ID NO: 6273 encoding a protein having the amino acid sequence as set forth in SEQ ID NO: 6274, wherein the host cell is *E. coli, Agrobacterium*, or yeast.

4. A method of improving immunity against a fungal pathogen in plants, comprising: (a) transforming a plant cell with the cDNA sequence as set forth in SEQ ID NO: 6273 encoding a protein having the amino acid sequence as set forth in SEQ ID NO: 6274, (b) selecting the transformed plant cell, and (c) regenerating the transformed plant cell into a transgenic plant that demonstrates improved immunity to the fungal pathogen, as compared to a plant that does not express the amino acid sequence of SEQ ID NO: 6274.

5. The method of claim 4, wherein the fungal pathogen is selected from the genus of *Fusarium*.

6. The method of claim 4, wherein the plant is a monocot or a dicot.

7. The method of claim 4, wherein the plant is selected from the group consisting of tobacco, potato, sweet potato, cassava, sugar-beet, *arabidopsis, brassica* species, tomato, brinjal, *capsicum*, chili, banana, mango, *vitis, papaya*, sunflower, cotton, groundnut, pea, soybean, chickpea, pigeon pea, *medicago*, lotus, rice, maize, wheat, rye, barley, oats, sorghum, nuts, avocado, turmeric, saffron, ginger, garlic, onion, and nutmeg.

8. A transgenic plant or parts thereof having immunity against a fungal pathogen, wherein the transgenic plant overexpresses a polypeptide encoded by the sequence as set forth in SEQ ID NO: 6273.

9. A transgenic seed obtained from the transgenic plant of claim 8, wherein the seed overexpresses a polypeptide encoded by the cDNA sequence as set forth in SEQ ID NO: 6273.

10. A transgenic progeny obtained from the transgenic seed of claim 9, wherein the progeny overexpresses a polypeptide encoded by the cDNA sequence as set forth in SEQ ID NO: 6273.

* * * * *